United States Patent 8,299,318 (NUCLEOTIDE SEQUENCES AND CORRESPONDING POLYPEPTIDES CONFERRING MODULATED PLANT CHARACTERISTICS) - sequence listing, part 15

SEQ ID NO: 44867 - DNA, 676 bp, Panicum virgatum
  misc_feature: Ceres CLONE 2022341
  misc_feature: Encodes the peptide sequence at SEQ ID NO. 44868
aatggttcgtgatgtgttccgtttggctaaggagaatgccccagcaatcattttcattgatgaggttgatgctatagcaactgctcgttttgatgctcagactggtgccgatcgagaagttcagcgtatccttatggagctacttaatcagatggatgggtttgatcaaacagtgaatgtgaaagttataatggcaactaaccgagcagatactctggatcctgcactgttacgtcctggtagacttgacaggaaaattgagttccctcttcctgaccggcggcagaagaggcttgttttccaggtctccactgccaaaatgaatttgagtgatgaggttgatttggaagattatgtttccagacctgacaagatcagtgctgctgatattgctgctatctgtcaagaagctggcatgcatgctgtccgcaaaaaccggtatgtcatcctccccaaggacttcgagaagggctaccgaaccaatgtgaagaagcctgagacagacttcgatttctacaaatgatgtgatatgagtgttgaactggtttcatgtttatcaatagtatgtttttagcatcagggttgaaattctggaacattgcccattatcaaaatgttcatgttgtttctcagtggcgatattaaaacgcctgtaatgaatttatagtttgtccgt

SEQ ID NO: 44868 - protein, 173 aa, Panicum virgatum
  misc_feature: Ceres CLONE 2022341
  misc_feature (1)..(143): Pfam Name: AAA Pfam Description: ATPase family associated with various cellular activities (AAA)
  misc_feature: SWISSPROT Homolog: EC 3.6.4.3 Microtubule-severing ATPase
MVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVSTAKMNLSDEVDLEDYVSRPDKISAADIAAICQEAGMHAVRKNRYVILPKDFEKGYRTNVKKPETDFDFYK

SEQ ID NO: 44869 - DNA, 643 bp, Panicum virgatum
  misc_feature: Ceres CLONE 2022347
  misc_feature: Encodes the peptide sequence at SEQ ID NO. 44870
atcgcagcctaaacccctgcggcgccgacatggccgtccaccacctccgccgccgcggggtctccggcgggtcctcgatccgcggcatcctcctcgcctcccaggagatcggaaggcgtccgttgagctcggcagcggcgggggacgcggcagccgagctgaggggcgcgcgggaggacgtgaagaagctgctcaagaccaccttctgccatcccatcctggttcgattggggtggcatgatgctggtacctatgacaagaacattgcggagtggccaaagtgcggaggagctaatggtagcttgagatttgaaatcgagttaaagcatggggctaatgctggtcttgtgaatgctttgaagctgatccagccaatcaaagataagttttcaggtgtcacatatgcagatctgtttcagctagccagcgccacagccattgaggaagcaggtggccccaaaattcccatgatctatggaagggttgatgttacagcccctgaacaatgcccaccagaggggaggcttcctgctgccggcccaccttcacctgcggaacatttgcatgaagtattctatagaatgggcctgaacgacaaggaaattgttgcactgtcaggagctcatacacttggacgggcaag

SEQ ID NO: 44870 - protein, 204 aa, Panicum virgatum
  misc_feature: Ceres CLONE 2022347
  misc_feature (47)..(204): Pfam Name: peroxidase Pfam Description: Peroxidase
  misc_feature: SWISSPROT Homolog: EC 1.11.1.11 L-ascorbate peroxidase
  misc_feature: Functional homolog of the protein sequence given in SEQ ID NO 51696
  misc_feature: Useful for making plants with altered carbohydrate content
MAVHHLRRRGVSGGSSIRGILLASQEIGRRPLSSAAAGDAAAELRGAREDVKKLLKTTFCHPILVRLGWHDAGTYDKNIAEWPKCGGANGSLRFEIELKHGANAGLVNALKLIQPIKDKFSGVTYADLFQLASATAIEEAGGPKIPMIYGRVDVTAPEQCPPEGRLPAAGPPSPAEHLHEVFYRMGLNDKEIVALSGAHTLGRA

SEQ ID NO: 44871 - DNA, 680 bp, Panicum virgatum
  misc_feature: Ceres CLONE 2022359
  misc_feature: Encodes the peptide sequence at SEQ ID NO. 44872
acatcgctccctctccctctcccccacagcaggctagctagggttttctggggtttgcgagggggttgctccggtccggcgggaggggggagatggcggcggagcgggctcaggggacggtgaagtggttcaacgggatcaaggggttcggcttcatcagccccgacgacggcggccaggacctcttcgtccaccactcctccgtcaaggccgacggcttccccaacctcaaggacggtgacgccgtcgagttcaccgtcggcgccgacaacgacggccgcgccaaggccatcgacgtctccgcgcccggcggcggcgcgcttgccggcggggagcgcccggacaacggctacggcggacgcggtggcggcggctacggcggcggaggcgaccgcggctacggtggaggaggtgaccgcggctacggcggaggcggcgaccgcggctacggcggaggcggcgaccgcggctacggcgaccgcggctacggcggaggcggcggcgaccgcggctacgggggaggaggtggctacggaggaggcggcgaccgtggctacggcggcggcggcggaggcggccgcggctccgggtgctacaagtgcggcgaggagggccacatcgcacgggactgctcccacggcggcggcggctacggcggtggcggtggtggcggctacggc

SEQ ID NO: 44872 - protein, 195 aa, Panicum virgatum
  misc_feature: Ceres CLONE 2022359
  misc_feature (5)..(72): Pfam Name: CSD Pfam Description: 'Cold-shock' DNA-binding domain
  misc_feature (165)..(182): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGIKGFGFISPDDGGQDLFVHHSSVKADGFPNLKDGDAVEFTVGADNDGRAKAIDVSAPGGGALAGGERPDNGYGGRGGGGYGGGGDRGYGGGGDRGYGGGGDRGYGGGGDRGYGDRGYGGGGGDRGYGGGGGYGGGGDRGYGGGGGGGRGSGCYKCGEEGHIARDCSHGGGGYGGGGGGGY

SEQ ID NO: 44873 - DNA, 688 bp, Panicum virgatum
  misc_feature: Ceres CLONE 2022362
  misc_feature: Encodes the peptide sequence at SEQ ID NO. 44874
atggctgcacctgctgacaccggcgccgctacagcagcagcatcaaccctagttcctcctcggcttgccacgcctcacggcgacctggccgagatcctcccttccctccccctcgagacgcggtgcctgccatcgttccatctccgctgctacaagggtttttggctgtccgagaaagccctcaccgggtacttcccagccatccacgcccacttcgagcccaggcccgacgacatctttctagccagcttccccaagtccggcaccacgttgctcaaggccctcgccttcgcgacgttgaaccgggccgcgcacccgccatccgacgccgatcacccactccgccggcgcaacccccacagctgcgtgaggttcctcggggcgagcggtgccgacgacacagaagatgagccggcggcggcgctccgctctccgcgcgtgctcgccacccacttgccctactccttgctgccggagcgcatcaggggaggccgaggggaggggtcgaggatcgtgtacatctgtcggaaccccaaagatgtgctggtctccggatggctcttcaccaagaaaacatcagcgatgttcgggctggacgtgcagtcgtacaccctccaggaggcgttcgatctcttctgcgagggtcgctgcatcaatggcccgcactggcagcacgccctcgagtact

SEQ ID NO: 44874 - protein, 229 aa, Panicum virgatum
  misc_feature: Ceres CLONE 2022362
  misc_feature (76)..(228): Pfam Name: Sulfotransfer_1 Pfam Description: Sulfotransferase domain
  misc_feature: SWISSPROT Homolog: EC 2.8.2.14 Bile-salt sulfotransferase
MAAPADTGAATAAASTLVPPRLATPHGDLAEILPSLPLETRCLPSFHLRCYKGFWLSEKALTGYFPAIHAHFEPRPDDIFLASFPKSGTTLLKALAFATLNRAAHPPSDADHPLRRRNPHSCVRFLGASGADDTEDEPAAALRSPRVLATHLPYSLLPERIRGGRGEGSRIVYICRNPKDVLVSGWLFTKKTSAMFGLDVQSYTLQEAFDLFCEGRCINGPHWQHALEY

SEQ ID NO: 44875 - DNA, 742 bp, Panicum virgatum
  misc_feature: Ceres CLONE 2022365
  misc_feature: Encodes the peptide sequence at SEQ ID NO. 44876
gatctacatcgacaacaccgagcccagcttcgccgtcgcggagatatggacctcgctggcgtacggcggcgacggcaagcctttctacgaccagaacgcgcaccggcaggagctggtgaactgggtggaccgcgtgggcaggtccagcccggccacgacgttcgacttcaccaccaagggcatcctcaacgtcgccgtcgacggcgagctgtggcggctccgcggcgccgacggcaaggcgcccggcatgatcgggtggtggccggccaaggccgtgaccttcatcgacaaccacgacaccggctcgacgcagcacatgtggccgttccccgccgacaaggtcatgcagggctacgcctacatcctcacgcaccccggcaccccaatgatcttctacgatcacttcttcgactggggcctgaagaacgagatcgcacacctggtgtccatcagggaccgccacgggatccagccggacagcgagctgcacatcatcgaggccgacgccgacctctacctcgctgagatcgacggcaaggtcgtcgtgaagatcggatcgagattcgattgtgagcacctaatccccgaaggcttccaggtctcggcgcacggcgatggctacgctgtttgggagaaaatctgagccaaatctgtgtctctggcacgaagagcttttgcagttttgacctgcaagtttttcttacctaatacggggataactgccacctatatgcgagatgat

SEQ ID NO: 44876 - protein, 213 aa, Panicum virgatum
  misc_feature: Ceres CLONE 2022365
  misc_feature (152)..(212): Pfam Name: Alpha-amyl_C2 Pfam Description: Alpha-amylase C-terminal beta-sheet domain
  misc_feature: SWISSPROT Homolog: EC 3.2.1.1 Alpha-amylase
IYIDNTEPSFAVAEIWTSLAYGGDGKPFYDQNAHRQELVNWVDRVGRSSPATTFDFTTKGILNVAVDGELWRLRGADGKAPGMIGWWPAKAVTFIDNHDTGSTQHMWPFPADKVMQGYAYILTHPGTPMIFYDHFFDWGLKNEIAHLVSIRDRHGIQPDSELHIIEADADLYLAEIDGKVVVKIGSRFDCEHLIPEGFQVSAHGDGYAVWEKI

SEQ ID NO: 44877 - DNA, 656 bp, Panicum virgatum
  misc_feature: Ceres CLONE 2022367
  misc_feature: Encodes the peptide sequence at SEQ ID NO. 44878
gcaaactgggtgatcattacactccacctgcaactgtagatgtttctcgcatgccaccaatctgcaagtggatactctcagtgcttaacaaggctattggcaaaaccgttaccgctttagaagcatacaaattctctgatgcaacgtctactatatactcgtggtggcagtaccagctatgtgatgtatttatcgaagctatcaaaccttatttcttcagtgattctcaagagtttgaatcagcaagaactgcctccagagataccctttggatctgcctggagactggcctgcgcctgctccacccattcatgccttatgtaacagaagagctgtggcagcgtcttccacagcccaaagattcttgtaggaaagattcaattatgatttcggaatatccatctcttgttgaggaatggactaatgatagacttgaaaacgaaatggacattgtcttagatgccgtgaacagaataagatcgatgaagccaccaacagattcaaatgaaagacgacctgcttttgcactttgccgaggccaagagattgctgccactatccaatgctatcaatctctaattgtgtctctttcctccgtatcacatctcaagatcctgacagagaacgatgaaactccagctgactgtgccactgct

SEQ ID NO: 44878 - protein, 217 aa, Panicum virgatum
  misc_feature: Ceres CLONE 2022367
  misc_feature (21)..(176): Pfam Name: Anticodon_1 Pfam Description: Anticodon-binding domain
  misc_feature: SWISSPROT Homolog: EC 6.1.1.9 Valine--tRNA ligase
KLGDHYTPPATVDVSRMPPICKWILSVLNKAIGKTVTALEAYKFSDATSTIYSWWQYQLCDVFIEAIKPYFFSDSQEFESARTASRDTLWICLETGLRLLHPFMPYVTEELWQRLPQPKDSCRKDSIMISEYPSLVEEWTNDRLENEMDIVLDAVNRIRSMKPPTDSNERRPAFALCRGQEIAATIQCYQSLIVSLSSVSHLKILTENDETPADCAT

SEQ ID NO: 44879 - DNA, 667 bp, Panicum virgatum
  misc_feature: Ceres CLONE 2022373
  misc_feature: Encodes the peptide sequence at SEQ ID NO. 44880
atgcgattcacaccgagcctatagcaagcattaatcactttagttctcaattaccatcttacaaagttctctacttcttcaaaatgtcgttgattccaagtttctttggtggccgaaggagcaacgttttcgatccattctcccttgacgtttgggaccccttcaaggattttccattctccaattcttcactttctgcttcttcattccctggtgagaattccgcttttgtgagcacaagagtggactggaaggaaactccagaagcacatgtcttcaaagctgatcttccaggactgaagaaggaggaagtgaaggttgaaattgaagatgacagagttcttcagataagcggagagaggaatgtcgaaaaagaagataagaacgatcaatggcatcgcgtggagcgtagcagtggaaagttcatgaggagattcagattgccggagaatgctaaaatggatcaagtgaaagctgcgatggagaatggtgttctcactgttactgttcctaaggaagagatcaagaagcctgatgttaaatccattgaaatctctggttgaacacatattcaagctctgttactctgtttttgggttgaaaatagtgtgaactgtgaagtgtgtgtgtgttctgtttcattgtaatgcgtacctgtttatatgct

SEQ ID NO: 44880 - protein, 159 aa, Panicum virgatum
  misc_feature: Ceres CLONE 2022373
  misc_feature (55)..(158): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIPSFFGGRRSNVFDPFSLDVWDPFKDFPFSNSSLSASSFPGENSAFVSTRVDWKETPEAHVFKADLPGLKKEEVKVEIEDDRVLQISGERNVEKEDKNDQWHRVERSSGKFMRRFRLPENAKMDQVKAAMENGVLTVTVPKEEIKKPDVKSIEISG

SEQ ID NO: 44881 - DNA, 674 bp, Panicum virgatum
  misc_feature: Ceres CLONE 2022377
  misc_feature: Encodes the peptide sequence at SEQ ID NO. 44882
acgcagagcaagcgagcgcagcacaagcagtcaagcagtagcagcagcagctgtagcttgtacgtgcacaaggagctcgctcggtcgcgatggcagctagagcggcgctcctcctggccgtgagcctggtcctggccgccgtggcgagcgcgaccaactgcccgccgccgccggccccgacgccgacgcccagcggcggcggccaccactgccccagggacgcgctgaagctgggcgtgtgcgccaacgtgctgggcctcgtcaaggccaagatcggctcgccgccgtacctgccctgctgctcgctgctggacgggctcgtggacctggaggccgccgtctgcctctgcaccgccatcaaggacaacatcctcggcatcaaactcaacctccccatcgacctcagcctcatcctcaacaactgcggcaagagctgccccaacgacttccactgcgcatagatcgcccactgatcgaccgtcctcgctcctccatcgccggcggccgcggtcgtccatcattccattctgtcattccgtggcggctctgtggttgatctcatcatcaactcgctgtcagttcgagcttgtttgtttttattcgtttcgttatacaaattaatgagtggttttttcacttgtacgtagccccctcccccgcaaaagtcaccacgt

SEQ ID NO: 44882 - protein, 123 aa, Panicum virgatum
  misc_feature: Ceres CLONE 2022377
  misc_feature (41)..(122): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50545
  misc_feature: Useful for making plants with modulated oxidative stress sensitivity
MAARAALLLAVSLVLAAVASATNCPPPPAPTPTPSGGGHHCPRDALKLGVCANVLGLVKAKIGSPPYLPCCSLLDGLVDLEAAVCLCTAIKDNILGIKLNLPIDLSLILNNCGKSCPNDFHCA

SEQ ID NO: 44883 - DNA, 575 bp, Panicum virgatum
  misc_feature: Ceres CLONE 2022382
  misc_feature: Encodes the peptide sequence at SEQ ID NO. 44884
cttcgtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggtggtggctacggcggcggcggcggctacggtcgccgcgagggcggtggcggctacggtggcagcggcggcggcggcggctacggtgcccgtgtaggttattgtggtggggggcgcggcggctacagtgttaaccgatgcggcagctactgaaagtcagat

SEQ ID NO: 44884 - protein, 153 aa, Panicum virgatum
  misc_feature: Ceres CLONE 2022382
  misc_feature (10)..(81): Pfam Name: RRM_1 Pfam Description: RNA recognition motif. (a.k.a. RRM, RBD, or RNP domain)
  misc_feature (48)..(146): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGGGGYGGGGGYGRREGGGGYGGSGGGGGYGARVGYCGGGRGGYSVNRCGSY

SEQ ID NO: 44885 - DNA, 682 bp, Panicum virgatum
  misc_feature: Ceres CLONE 2022403
  misc_feature: Encodes the peptide sequence at SEQ ID NO. 44886
aaacctcaaagcttcgaagtcacgggttcacactcactcgtgcttcaacgcagaatcggagcaaaggcgcccgcggtttcttcagcatgggcggcgttcccggcgccgcgcgccgccacatcctgctcctcctctccgtcgccctggccgccatctccctctaccgcggcgccgcggctccctcgccggtgtacgacacggacgggcaggagctgagcgccgacgcggactactacgtgctcccggccgcccgcgggggcggcgggctcaccatggcgcccaacgtgttccggtgcccgctgttcgtggcgcaggaggccgacccgctccgcaagggcttccccgtgcgcctcaccccgctgcacgggcacggcggcgaccgcaccgtgcgcgtctccttcgacgtcggcgtgcacttcgccgccgtgacgacgtgcgtgcagaccaccgagtggcacgtcgccgtccgcggcgacgagggcgggggcggcgcccgccggcacgttgtcactggcccggtcctggccccgaccgcgggcggccgggagagggtgttccgcgtcgaggggcgtgatagggggtttccgcttgcagcgtgcgtgagcgtgtgcgtgccgaataagaacgcgcttgttccgttactagcgactaactctgctgttgtattacggatacggtatac

SEQ ID NO: 44886 - protein, 198 aa, Panicum virgatum
  misc_feature: Ceres CLONE 2022403
  misc_feature (34)..(196): Pfam Name: Kunitz_legume Pfam Description: Trypsin and protease inhibitor
MGGVPGAARRHILLLLSVALAAISLYRGAAAPSPVYDTDGQELSADADYYVLPAARGGGGLTMAPNVFRCPLFVAQEADPLRKGFPVRLTPLHGHGGDRTVRVSFDVGVHFAAVTTCVQTTEWHVAVRGDEGGGGARRHVVTGPVLAPTAGGRERVFRVEGRDRGFPLAACVSVCVPNKNALVPLLATNSAVVLRIRY

SEQ ID NO: 44887 - DNA, 747 bp, Panicum virgatum
  misc_feature: Ceres CLONE 2022404
  misc_feature: Encodes the peptide sequence at SEQ ID NO. 44888
aatcccggccagaagattccctccccagccgcgcacgacccctttctatcctccggtgcccctgaccaggaccgccaacaccggccgccgccatgtctccggccccgccgccgccgtcgcgcgcccgcatccggccgtggctggtggtgggggacctggcgctggcggccgcgtgggtgtgcgcgggcgcgctggtgaagctgctcgtgtacggcccgctcggcttcgggggccggcctcaggccgaggcggtgaaggtctcgctctccatcgtgtacatgttcatcttcgcctggctcgaggccgccacgggcggcgcctcctacaacccgctcaccatccttgccgccgccgtcgcctcccacggcggaccggccgtatacctgttcaccgccttcgcgcgaatccctgcccaggtgattggggcggttctgggagtgaagctgattcagtttactttccctaatgtgggtaaggggccccgcttaagtgttggtgctcatcatggagcattagctgaaggattagcaactttcatggttgttatggtgtcagtgactcttaagaagaaggagatgaaaagtttctttatgaagacatggatcacaagcatctggaagaacacaattcatatccttagctcggacataactggagggataatgaaccctgcatctgcttttgcttgggcatatgctcgaggagatcatacaacatttgaccacctactggtatattggctggcgc

SEQ ID NO: 44888 - protein, 218 aa, Panicum virgatum
  misc_feature: Ceres CLONE 2022404
  misc_feature (52)..(218): Pfam Name: MIP Pfam Description: Major intrinsic protein
MSPAPPPPSRARIRPWLVVGDLALAAAWVCAGALVKLLVYGPLGFGGRPQAEAVKVSLSIVYMFIFAWLEAATGGASYNPLTILAAAVASHGGPAVYLFTAFARIPAQVIGAVLGVKLIQFTFPNVGKGPRLSVGAHHGALAEGLATFMVVMVSVTLKKKEMKSFFMKTWITSIWKNTIHILSSDITGGIMNPASAFAWAYARGDHTTFDHLLVYWLA

SEQ ID NO: 44889 - DNA, 735 bp, Panicum virgatum
  misc_feature: Ceres CLONE 2022406
  misc_feature: Encodes the peptide sequence at SEQ ID NO. 44890
agatccacgaattggaaaaaagaggaaaaacaaggggacaggaaaggtctcgcctttgctcgacgacggcggcggcggcgatgtctctccctccggccccggtgttaggcggcggcggcggttcccccggcggcgactggttcctcgactgcggcatcctcgacgacctcccggccgcggcctgccgggccttcccgtgggacgcgtccccgtcgtcctccaaccccagtgtggaagttggcagctatgtaaacaccggtgatgtcttcaaggagcctggcagtaataaacgtttaaggtcaggatcttctggtaggccaacatctaaagcttgtagggaaaaaatgagaagggacaagctcaatgacaggtttcttgaattgggctctaccttagaacctgggaaaccagtaaaagctgacaaagctgctatcctaagtgatgctactcgcatggttattcagcttcgctctgaagcacagcagctcaaggacaccaatggtagtcttgaagaaaagattaaggaactaaaggcagagaaggatgagcttcgcgatgagaagcagaagctgaaatagagaaggagagtttagagcaccagatgaagctaatgacctcaactccagcctacatgcctcatccaaccctgatgccagcgcccctcccacaggctcagctagcaccgtttcatccccatgtgcaagctgcagggcagaagctgatgatgccctttgt

SEQ ID NO: 44890 - protein, 165 aa, Panicum virgatum
  misc_feature: Ceres CLONE 2022406
  misc_feature (79)..(130): Pfam Name: HLH Pfam Description: Helix-loop-helix DNA-binding domain
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Functional homolog of the protein sequence given in SEQ ID NO 51532
  misc_feature: Useful for making plants with altered lignin content
MSLPPAPVLGGGGGSPGGDWFLDCGILDDLPAAACRAFPWDASPSSSNPSVEVGSYVNTGDVFKEPGSNKRLRSGSSGRPTSKACREKMRRDKLNDRFLELGSTLEPGKPVKADKAAILSDATRMVIQLRSEAQQLKDTNGSLEEKIKELKAEKDELRDEKQKLK

SEQ ID NO: 44891 - DNA, 649 bp, Panicum virgatum
  misc_feature: Ceres CLONE 2022412
  misc_feature: Encodes the peptide sequence at SEQ ID NO. 44892
gggcgagatcaaccacgacaacgtcctctacatcgttgagaacatcaacgtcgcagcgatcgagactaccttgtggtcgatcgagtggggcatcgctgagctggtgaaccacccggcgatccagtccaagctccgcgaagagatcacctccgtgctgggcgccggcgtggcggtgacggagccggacctggatcgcctgccctacctgcaggccgtggtcaaggagaccctccgcttgcgcatggccatcccgctgctggtcccgcacatgaacctcaacgacggcaagctccacggctacgacatcctcgcagagtccaagatcctcgtcaacgcgtggttcctcgccaacgaccccaagcggtgggtgaagcccgaggagttccgccccgagcggttcctggaggaggagaaggccgtggaggcccacggcaacgacttccggttcgtgcccttcggcgtcggccgcaggagctgccccggcatcgtcctcgcgctgcccatcatcggcatcacgctgggcaggctggtgcagaacttccagctgctgccgccgccggggcaggacaaggtcgacaccaccgagaagcccgggcagttcagcaaccagatcgccaaccacgccaccatcgtctgcaagccgctcgag

SEQ ID NO: 44892 - protein, 215 aa, Panicum virgatum
  misc_feature: Ceres CLONE 2022412
  misc_feature (1)..(211): Pfam Name: p450 Pfam Description: Cytochrome P450
  misc_feature: SWISSPROT Homolog: EC 1.14.13.11 Trans-cinnamate 4-monooxygenase
  misc_feature: Functional homolog of the protein sequence given in SEQ ID NO 51193
  misc_feature: Useful for making plants with altered carbohydrate content
  misc_feature: Functional homolog of the protein sequence given in SEQ ID NO 51196
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: The sequence is a functional homolog of SEQ ID NO 8 in US patent 7148406
GEINHDNVLYIVENINVAAIETTLWSIEWGIAELVNHPAIQSKLREEITSVLGAGVAVTEPDLDRLPYLQAVVKETLRLRMAIPLLVPHMNLNDGKLHGYDILAESKILVNAWFLANDPKRWVKPEEFRPERFLEEEKAVEAHGNDFRFVPFGVGRRSCPGIVLALPIIGITLGRLVQNFQLLPPPGQDKVDTTEKPGQFSNQIANHATIVCKPL

SEQ ID NO: 44893 - DNA, 723 bp, Panicum virgatum
  misc_feature: Ceres CLONE 2022415
  misc_feature: Encodes the peptide sequence at SEQ ID NO. 44894
gttttctatccagcaggcgcacgcccctcaccccacgcgcggctccgcaggagagcgaaaatggcgaccctctccctggtctccgtccccatcgcaccctcctccctttccctctcctcccggggccgcagctcctccttctccttccccgctcccaagaaaggagggattggtcacggcggcctgcggattgagtgcatccgtattggtggtgttgagattccaaacaacaagagggtggagtactcgctgcagtacatccatggcattgggcggtcatgctcccgtcagatccttttggacctcaattttgacaacaagatcaccaaggacctctctgaggaggaggtcatcacactccggaaggaggtcggcaagtacatgattgagggagaccttaaacggttcaaccgtgtggcgattgagaggttgaaggagattaggtgctacaggggcatacgacacaagctgggactcccagttcgtggccagaggacaaagaacaactgccggacactaaagggaaagagggcttcagttgccaagaagaagtcacctgcctcgcaggaggaataagacatattaccttgtatttaagttctgcctgttttttttgtgcaacatcacaactgttgggtgttccatttcgagctctgatgctgtcatagacgaatcatggggttatgatcgggtgctgcaaattctatagctgtgaaatagctt

SEQ ID NO: 44894 - protein, 171 aa, Panicum virgatum
  misc_feature: Ceres CLONE 2022415
  misc_feature (48)..(152): Pfam Name: Ribosomal_S13 Pfam Description: Ribosomal protein S13/S18
MATLSLVSVPIAPSSLSLSSRGRSSSFSFPAPKKGGIGHGGLRIECIRIGGVEIPNNKRVEYSLQYIHGIGRSCSRQILLDLNFDNKITKDLSEEEVITLRKEVGKYMIEGDLKRFNRVAIERLKEIRCYRGIRHKLGLPVRGQRTKNNCRTLKGKRASVAKKKSPASQEE

SEQ ID NO: 44895 - DNA, 690 bp, Panicum virgatum
  misc_feature: Ceres CLONE 2022426
  misc_feature: Encodes the peptide sequence at SEQ ID NO. 44896
ggtggtagaggaagtgcgaggttccgagaaggttctccgccatacggaagaggaggcagatcttacgggagaggctttggtgctcatcctggaaaagatttcattaatattgatggagaatatgttcacaggaatgatccaaatttgtcaccaagagaaggtgattggatatgccagaatccaaattgcggaaatctcaattttgctcggcgcacacactgtaacaactgcaacaagttccgctattcagcacgtgaagcatatgaacctaggcgcagccctccaaggggttacccaaatcctccgcgagggcctccaaggatggttggtccacccggtgatcgagcccccccaagagagatgtccaggtacagatcaccacctcaaggctggggtgcgggtgatcctaggggatatgcagctcgatcccctccagaacgcccagtacggttcacagattcatcacctaaggaaagaatgggcttccgtggtgagcgtgatccaaggggccgtgcaaagtttgagtggtctgctactgatgactacggtcggagggagcgcctgcatgatggttatcttgacagaagtcggcgccgctcagggtctcctcgggctaactgggggaatgatctgcgtgatagaagccgcacccctccacggaacaggctgatgaagagttcttcactggca

SEQ ID NO: 44896 - protein, 229 aa, Panicum virgatum
  misc_feature: Ceres CLONE 2022426
  misc_feature (52)..(83): Pfam Name: zf-RanBP Pfam Description: Zn-finger in Ran binding protein and others
GGRGSARFREGSPPYGRGGRSYGRGFGAHPGKDFINIDGEYVHRNDPNLSPREGDWICQNPNCGNLNFARRTHCNNCNKFRYSAREAYEPRRSPPRGYPNPPRGPPRMVGPPGDRAPPREMSRYRSPPQGWGAGDPRGYAARSPPERPVRFTDSSPKERMGFRGERDPRGRAKFEWSATDDYGRRERLHDGYLDRSRRRSGSPRANWGNDLRDRSRTPPRNRLMKSSSL

SEQ ID NO: 44897 - DNA, 664 bp, Panicum virgatum
  misc_feature: Ceres CLONE 2022437
  misc_feature: Encodes the peptide sequence at SEQ ID NO. 44898
atccatccatccatccatcttgcaagccacgctagctagctactcacagctctcggctgcaatgcgccgccacacgccgctgctcgccgccgccctggcgctcggcgtcgtcgccgtcgggctccaggcccagccgttcgactacccgtcggcgcgcccgtccacgtcctgggccaacacggacgcctccctcccgcaccacgtcaccttcatggacggctccgtggcgcgcgccgcgctgctgcgcctcaaccccgccggcttcggcccctcctacgccttcggcttcttctgcaccaaccacggcaccgccgccggcgcggggccctgcaacgacttcctcctcgccgtcgccgtcgtctactgcaacagcggcgcgctcatgacctccgtcgtcgccggcatcccgcaggtcgtctggtccgccaaccgcgcccgccccgtcggggagggcgccaccctccagttcacgcccgcgggcgacctcgtgctcaaggcgcctgacggcacgctcgtgtggtccgcgggcaccgcggggaagtccgtcgccggaatcagcatcaacagcgacggcaacctcgtcatggtcgacgggaccaaccgggccgtctggcagtcgttcaaccaccccaccgacacgctgctcgtcggccagtccctgcgg

SEQ ID NO: 44898 - protein, 200 aa, Panicum virgatum
  misc_feature: Ceres CLONE 2022437
  misc_feature (115)..(200): Pfam Name: B_lectin Pfam Description: D-mannose binding lectin
MRRHTPLLAAALALGVVAVGLQAQPFDYPSARPSTSWANTDASLPHHVTFMDGSVARAALLRLNPAGFGPSYAFGFFCTNHGTAAGAGPCNDFLLAVAVVYCNSGALMTSVVAGIPQVVWSANRARPVGEGATLQFTPAGDLVLKAPDGTLVWSAGTAGKSVAGISINSDGNLVMVDGTNRAVWQSFNHPTDTLLVGQSL

SEQ ID NO: 44899 - DNA, 735 bp, Panicum virgatum
  misc_feature: Ceres CLONE 2022455
  misc_feature: Encodes the peptide sequence at SEQ ID NO. 44900
gtgcctgtacgggctcccgaacgggggctgggaggtggcgcagccggcggaggaggtgcccccggagatgcccgagcccgcgctggggatcaacttcgccagggacggcatgaagcgccgcgactggctctcgctcgtcgccgtccactccgacgcctggctcgtctccgtcgcctacttctacgccgcccgcctcaacggcaacgacaggaagcgcttatttaacatgatcaatgatcatccatccgtgtgtgaaacaatgtttgaccggaagcaaagggagaataagcctggtgttgataacagcggcaaatccaggcactcaacaaagcgatcaagtgatggcaagatcaagaactcaagatccgcagctgttgaagatgggtatgaggacgacgaagtacacagtgaaaccctctgtggcacttgcagcagtttgtacaactcgaatgagttctggatcggatgtgacatttgtgagcagtggttccacggcaagtgtgtgagaataacaccggcgaaagcggatcagataaagcagtacaagtgccctgattgctccaagaaaagcaggtaataaaaccttggagctgtggcctcccattgctgactcagctgatcaaccaaacaaaactctccaatttggctgtagatgtgaattgccataggcattgtgtttgtttgtgtagatgctggaaaagacacatacaggatagttgggtctaatagactggt

SEQ ID NO: 44900 - protein, 191 aa, Panicum virgatum
  misc_feature: Ceres CLONE 2022455
  misc_feature (139)..(189): Pfam Name: PHD Pfam Description: PHD-finger
  misc_feature: SWISSPROT Homolog: EC 1.14.11.27 [Histone H3]-lysine-36 demethylase
  misc_feature: Functional homolog of the protein sequence given in SEQ ID NO 50175
  misc_feature: Useful for making plants with altered lignin content
  misc_feature: Useful for making plants with modulated flowering time
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Functional homolog of the protein sequence given in SEQ ID NO 50174
  misc_feature: Useful for making plants with altered alkaloid content
  misc_feature: The sequence is a functional homolog of SEQ ID NO 1981 in the 11/479,226 US patent application
CLYGLPNGGWEVAQPAEEVPPEMPEPALGINFARDGMKRRDWLSLVAVHSDAWLVSVAYFYAARLNGNDRKRLFNMINDHPSVCETMFDRKQRENKPGVDNSGKSRHSTKRSSDGKIKNSRSAAVEDGYEDDEVHSETLCGTCSSLYNSNEFWIGCDICEQWFHGKCVRITPAKADQIKQYKCPDCSKKSR

SEQ ID NO: 44901 - DNA, 631 bp, Panicum virgatum
  misc_feature: Ceres CLONE 2022460
  misc_feature: Encodes the peptide sequence at SEQ ID NO. 44902
ccaggaacgagctcgcctcggcggcggcccgcgacgacgacctcctcctcctctttggctccgccgccggcagcgttggcgggcattgtagcgaggagggggcgtggaggcgcggcgattgttcgcggcatgagcttcggcggcagcagctccgtcgcgtccggtgcgaagaggccattcgagtacgggaggacgcatgtggtgaggccgaagggcacgcacaaggccaccattgtctggctccacggcctcggggacaatggagctagctggtctcaactattggaaactcttcctcttcctaatataaaatggatatgcccaactgccccttcgagacccgtgtctgtgtttggaggattcccctccacagcatggtttgatgttgctgatctttcagaggatgctcctgatgatgttgaggggatggatgcctcagcagcacatgttgcaaatttgttgtcaactgaacccgcggacatcaagcttggtgttggtggctttagtatgggtgctgctactgctctgtactctgcaacttgctttgctcatggaaaatatggaaatggcaatccataccctgtgaaccctaattttggctgttgggcttagtggctggcttccatgtgcc

SEQ ID NO: 44902 - protein, 160 aa, Panicum virgatum
  misc_feature: Ceres CLONE 2022460
  misc_feature (19)..(156): Pfam Name: Abhydrolase_2 Pfam Description: Phospholipase/Carboxylesterase
  misc_feature: SWISSPROT Homolog: EC 3.1.1.1 Carboxylesterase
MSFGGSSSVASGAKRPFEYGRTHVVRPKGTHKATIVWLHGLGDNGASWSQLLETLPLPNIKWICPTAPSRPVSVFGGFPSTAWFDVADLSEDAPDDVEGMDASAAHVANLLSTEPADIKLGVGGFSMGAATALYSATCFAHGKYGNGNPYPVNPNFGCWA

SEQ ID NO: 44903 - DNA, 757 bp, Panicum virgatum
  misc_feature: Ceres CLONE 2022511
  misc_feature: Encodes the peptide sequence at SEQ ID NO. 44904
cccgacacccaaaccctagccccctcgagacctatgccccttgcccccttccctccctcccacctccgccgccacagcgaaagtatggaggtcgaaagggccgcggccgccaccgcggcgggtggttcttccgctgagatggcggtggaccacaccacggggccggccgccgtggagaagccgcggttcgatgctctgatgccgagcgagatgagcggcgggaagccccagttccggaaggtgccagtgccgcagcaccgcttcgcgccgctcaagcgctgctggatggagatctacacacccgtctatgagcacatgaaggtcgacatccgcatgaacgtcaaggcaagaagggtggagctcaaaacaaagaaagacacaccagatgtgagcaaccttcagaaatgtgcggactttgtgcatgcttttatgcttggatttgacattgccgatgctgtcgccctgctgcgtcttgatgacctttatgtggattcctttgagatcaaggatgtgaaaacccttcgaggtgagcacctgtcgcgcgctatcggccgcctatcagggaaagggggcaagaccaaatacgccatcgagaactccactaggacccgaatcgttattgctgatacaaagatccatatacttggatcctttgttaacatcaaggttgctcgggattcactttgcagcctcatcttgggttctcctgctggcaaagtgtattctaagcttagggctgtatctgctaggttggggg

SEQ ID NO: 44904 - protein, 224 aa, Panicum virgatum
  misc_feature: Ceres CLONE 2022511
  misc_feature (148)..(200): Pfam Name: KH_1 Pfam Description: KH domain
MEVERAAAATAAGGSSAEMAVDHTTGPAAVEKPRFDALMPSEMSGGKPQFRKVPVPQHRFAPLKRCWMEIYTPVYEHMKVDIRMNVKARRVELKTKKDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLG

SEQ ID NO: 44905 - DNA, 686 bp, Panicum virgatum
  misc_feature: Ceres CLONE 2022518
  misc_feature: Encodes the peptide sequence at SEQ ID NO. 44906
ggcggcggcggcgatggactggagctctgtgacggctgaagatctggtggacgcgctgcgggaggtggactggtcgacaccgccgcgcccagtcgccgagttcttctcccgcttcaccgccccccgatcctactccaagtggaccagccgcctcaagtgcaacctctactattataggacgaactacttcatcttggttatgttcattcttggaatgggctttcttaggaagccagttgccatccttgctgctttagcaactggtctcagcattgcgtttctcaatgacagttttgcagttactttcaatgagaaagtcacaaggagcgtcagacaattttcaccacatttagccgcaaagatgaggccacccataacgcctgtcatccgaggccaaccaagtaaaagaagatcaattcatatctgtggtcgacctcggtgggtctttgtcgtgttgttttccgcagttagctgcatgctctggttaacttcgtgcagcctcctcacggttttgtgggccctacttattggtctgcttgcaaccttgctccatgccagcttcagaacacctaatttgaaagcacgtttgaacacattcagggaggaatttcgagcagtatggcggaattacagtgagctgtagttgtctttgttgttccatgtttgtcataaagaatgatgcaagt

SEQ ID NO: 44906 - protein, 209 aa, Panicum virgatum
  misc_feature: Ceres CLONE 2022518
  misc_feature (16)..(178): Pfam Name: PRA1 Pfam Description: PRA1 family protein
MDWSSVTAEDLVDALREVDWSTPPRPVAEFFSRFTAPRSYSKWTSRLKCNLYYYRTNYFILVMFILGMGFLRKPVAILAALATGLSIAFLNDSFAVTFNEKVTRSVRQFSPHLAAKMRPPITPVIRGQPSKRRSIHICGRPRWVFVVLFSAVSCMLWLTSCSLLTVLWALLIGLLATLLHASFRTPNLKARLNTFREEFRAVWRNYSEL

SEQ ID NO: 44907 - DNA, 609 bp, Panicum virgatum
  misc_feature: Ceres CLONE 2022522
  misc_feature: Encodes the peptide sequence at SEQ ID NO. 44908
gaagattggttacaaccccaagtctgttcccttcgtccccatctctggttggcacggtgacaacatgttggaagaatctaccaacatgccctggtacaagggatggaacaaggaaaccaaggctggtgccaagtctggtaagaccctcttggatgccattgataacattgaccctcctacccgtcctgttgacaagcctctccgtcttcctcttcaagatgtttacaagattggtggtatcggtactgtccccgtcggtcgtgtcgaaaccggtgtcatcaaggctggtatggttgtcaccttcgctcctgctgctgtcaccactgaagttaagtccgtcgaaatgcaccacgaaaccctcactgaaggtcttcccggtgacaacgtcggtttcaacgtcaagaacgtctccgtcaaggatatccgtcgtggtaacgtctgttctgactccaagaacgaccccgccaaggaagccggttccttcaccgctcaagtcattatcttgaaccaccctggtcaaattggtgctggttacgctcccgttttggattgtcacactgctcacattgcctgtaagtttgctgaattgatcgaaaagattgacagacg

SEQ ID NO: 44908 - protein, 202 aa, Panicum virgatum
  misc_feature: Ceres CLONE 2022522
  misc_feature (81)..(148): Pfam Name: GTP_EFTU_D2 Pfam Description: Elongation factor Tu domain 2
  misc_feature (155)..(202): Pfam Name: GTP_EFTU_D3 Pfam Description: Elongation factor Tu C-terminal domain
  misc_feature: SWISSPROT Homolog: EC 2.7.7.4 Sulfate adenylyltransferase
KIGYNPKSVPFVPISGWHGDNMLEESTNMPWYKGWNKETKAGAKSGKTLLDAIDNIDPPTRPVDKPLRLPLQDVYKIGGIGTVPVGRVETGVIKAGMVVTFAPAAVTTEVKSVEMHHETLTEGLPGDNVGFNVKNVSVKDIRRGNVCSDSKNDPAKEAGSFTAQVIILNHPGQIGAGYAPVLDCHTAHIACKFAELIEKIDR

SEQ ID NO: 44909 - DNA, 742 bp, Panicum virgatum
  misc_feature: Ceres CLONE 2022523
  misc_feature: Encodes the peptide sequence at SEQ ID NO. 44910
atccaaaaacaaaagaaaaggggaaacagaaatagagaagcgcacaggaaaaagcctcgccgctctcgcatcgttccagaactcagatcaggatgacgggctccatggatctcccagcgaagggcgggttcagcttcgacctgtgccgacggaacgactttctggagaagaaggggctcaaagtccccggtttcaggaagaccgggactaccatcgtcggcctcgtcttccaggatggggttgttcttggggcagacacaagggcaactgagggtcctatagttgctgacaagaattgtgagaaaatccactttatggcaccaaacatctattgctgtggagcaggaacagctgctgacacagaggctgttacagatatggtgagctcccagctacagcttcaccgatatgcaaccggtcgtgaatcaagagtcgtgactgctcttacactgctgaagtcacaccttttcaagtatcaaggtcatgtcagtgctgctcttgttcttggtggagtggattgtactggaccacatctacacactgtgagtaactgagtataactgtttgttgcttgttgtagttaaaaggtaggatagttaaattaactttggaaagtgcaggtttatccgcatggatccacagatactcttcctttttgcacgatggggtctggatcgcttgctgcaatgtcggtgtttgagtcgaagtacaaagaaggggcttaccagggaggaggggatac

SEQ ID NO: 44910 - protein, 153 aa, Panicum virgatum
  misc_feature: Ceres CLONE 2022523
  misc_feature (35)..(153): Pfam Name: Proteasome Pfam Description: Proteasome A-type and B-type
  misc_feature: SWISSPROT Homolog: EC 3.4.25.1 Proteasome endopeptidase complex
MTGSMDLPAKGGFSFDLCRRNDFLEKKGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVSN

SEQ ID NO: 44911 - DNA, 703 bp, Panicum virgatum
  misc_feature: Ceres CLONE 2022532
  misc_feature: Encodes the peptide sequence at SEQ ID NO. 44912
agatcagctcgagcaaagtagcttactagctagtagtggcatcgatcgttttgcgagtgtgatcgagcagcagagtgatcggtgagctgagctgtgggaatggcgcggcggcggcagtggagcagcggcggcgtcgcggcggcggccgtgctcgggttgctgtccgtgctctgcgcggggcacccggcgccgggcgggttcccgctgcagccgcgcttctacgagcacacgtgcccgcagatgcaggccatcgtgggcgccatcgtggcgagggcgcacgcggaggacccgcgcatggcggcgtccctgctgcggctgcacttccacgactgcttcgtgcaggggtgcgacgcctccgtgctgctcgacgccgacggcagcggcaggttcgtcacggagaagcggtccaaccccaacagggactcgctccgcgggttcgaggtcatcgacgagatcaaggccgcggtcgagcacgcgtgcccgcgcgtcgtctcctgcgccgacatcgtcgccgtcgccgccagggactccgtcgtcctgacgggcggacccggctgggaggtgccgctggggaggagggactcactgacggcgagcctgagcggctcccaacacctcatccccgctcccaacgactcgctccctaccatcatcggcaagttcgccaaccaaggcctcgacgtcgtcgacctcgtcgcccttt

SEQ ID NO: 44912 - protein, 201 aa, Panicum virgatum
  misc_feature: Ceres CLONE 2022532
  misc_feature (52)..(201): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51033
  misc_feature: Useful for making plants with altered cell wall content and/or composition
  misc_feature: Functional homolog of the protein sequence given in SEQ ID NO 51032
  misc_feature: Useful for making plants with altered carbohydrate content
  misc_feature: Functional homolog of the protein sequence given in SEQ ID NO 51034
  misc_feature: Useful for making plants with modulated nitrogen use efficiency
MARRRQWSSGGVAAAAVLGLLSVLCAGHPAPGGFPLQPRFYEHTCPQMQAIVGAIVARAHAEDPRMAASLLRLHFHDCFVQGCDASVLLDADGSGRFVTEKRSNPNRDSLRGFEVIDEIKAAVEHACPRVVSCADIVAVAARDSVVLTGGPGWEVPLGRRDSLTASLSGSQHLIPAPNDSLPTIIGKFANQGLDVVDLVAL

SEQ ID NO: 44913 - DNA, 747 bp, Panicum virgatum
  misc_feature: Ceres CLONE 2022533
  misc_feature: Encodes the peptide sequence at SEQ ID NO. 44914
aagcaagaaattgaagaagcaatcatccatcagcaatgggcggtcgcgagccgccggaggctaggcaccctgctggccctcgcggcggccctcctctccctcctcgccagcccggccgcggcgacggggaagacggggcaggtgaccgtgttctggggccggaacaaggccgagggctcgctccgagaggcctgcgacaccggcacctacaccttcgtcgtcatctccttcctcagcgtcttcggccacggcacgaccagcctggacctctccggccaccccatcggccccgtcggcgccgacatcaagcactgccagtccaagagcatcctcgtcttcctctcgatcggcggccccggcagccagtactcgctccccagcgcccaggccgcgacggacctcgccgactacctctggttcgcgtacctcgccggccgccgcggcggcgtgcgccgcccgttcggcgacgcggagctcgacggcatcgacctcttcatcgaccagggcgcccccgaccactacgacgtgctggcggcgcggctgtggagctacaacaaggagttccgcggccggacgccggcgcagctgtcggcgacgccgcggtgccggtacccggacccccggctggagcgggcgctcgccacgggggtcgtcacccgcatcaacgtcaggttctacggcgacgggtactgcgccgcctactggcaggcggaatgggacaagtggacggcggcgtaccccaactcc

SEQ ID NO: 44914 - protein, 248 aa, Panicum virgatum
  misc_feature: Ceres CLONE 2022533
  misc_feature (46)..(240): Pfam Name: Glyco_hydro_18 Pfam Description: Glycosyl hydrolases family 18
  misc_feature: SWISSPROT Homolog: EC 3.2.1.14 Chitinase
KQEIEEAIIHQQWAVASRRRLGTLLALAAALLSLLASPAAATGKTGQVTVFWGRNKAEGSLREACDTGTYTFVVISFLSVFGHGTTSLDLSGHPIGPVGADIKHCQSKSILVFLSIGGPGSQYSLPSAQAATDLADYLWFAYLAGRRGGVRRPFGDAELDGIDLFIDQGAPDHYDVLAARLWSYNKEFRGRTPAQLSATPRCRYPDPRLERALATGVVTRINVRFYGDGYCAAYWQAEWDKWTAAYPN

SEQ ID NO: 44915 - DNA, 633 bp, Panicum virgatum
  misc_feature: Ceres CLONE 2022541
  misc_feature: Encodes the peptide sequence at SEQ ID NO. 44916
ataaataaatagcttcaaataaaagaaactttaatttcaaatggctgaccaactcaacgaggaacaaatcgctgaattcaaggaagctttctccctcttcgataaggatggtgatggaactattaccactaaggaactcggtaccgtcatgagatctttgggacaaaacccaactgaagctgaacttcaagatatgatcaatgaagtcgatgctgacggtaacggaactatcgatttccctgaattcttgtccctcatggccagaaagatgaaggacactgatactgaagaagaactcatcgaagccttcaaggtcttcgacagagatggaaacggccttatctctgccgccgaacttagacacgttatgactaacttgggtgaaaagctcactgacgaagaagtcgatgaaatgatcagagaagctgatatcgatggtgatggacacatcaactacgaagaattcgttagaatgatgatggccaagtaattttggtaataaagaggcactcttatcttgacatgactttacaatgtaagtttcataaagatggcctgtataacacgaggtgcgaaagacaaggatgctttatgcagtctctgtaatttcattagaaagtcaaaacattttcg

SEQ ID NO: 44916 - protein, 149 aa, Panicum virgatum
  misc_feature: Ceres CLONE 2022541
  misc_feature (121)..(149): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature (85)..(113): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity
MADQLNEEQIAEFKEAFSLFDKDGDGTITTKELGTVMRSLGQNPTEAELQDMINEVDADGNGTIDFPEFLSLMARKMKDTDTEEELIEAFKVFDRDGNGLISAAELRHVMTNLGEKLTDEEVDEMIREADIDGDGHINYEEFVRMMMAK

SEQ ID NO: 44917 - DNA, 580 bp, Panicum virgatum
  misc_feature: Ceres CLONE 2022553
  misc_feature: Encodes the peptide sequence at SEQ ID NO. 44918
gggagatggcggcggagcgggcgcaggggacggtcaagtggttcaacgggagcaaggggttcggcttcatcagccccgacgacggcagccaggacctcttcgtccaccactcctccgtcaaggccgacggcttccccaacctcaaggacggcgaagccgtcgagttcaccgtcggcgccgactgcgacagccgcgccaaggccatcgacgtctccgcgcccggcggcggcacgctcgccggcgggaaacgcccggacagcggctacagcgggcgcggcggcggcggctacggcgggggcggcgaccgcggctacggcggcggcggcgaccgcggctacggcggctggcggcgaccaccgctacaggggaggcgaccgccggtacaggggacgccgctaccacggccacgggggaggcggcgaccgctggtaccggggaggcggcgaccgccagtaccgctagggaggcggctacggatgccggcactatcgtggctaccgccgcggcgagggaagcggccgcggctgctacaagtgcgccgaggagggccacgtcgaacgctactgctcccatggcggcg

SEQ ID NO: 44918 - protein, 191 aa, Panicum virgatum
  misc_feature: Ceres CLONE 2022553
  misc_feature (5)..(72): Pfam Name: CSD Pfam Description: 'Cold-shock' DNA-binding domain
MAAERAQGTVKWFNGSKGFGFISPDDGSQDLFVHHSSVKADGFPNLKDGEAVEFTVGADCDSRAKAIDVSAPGGGTLAGGKRPDSGYSGRGGGGYGGGGDRGYGGGGDRGYGGWRRPPLQGRRPPVQGTPLPRPRGRRRPLVPGRRRPPVPLGRRLRMPALSWLPPRRGKRPRLLQVRRGGPRRTLLLPWR

SEQ ID NO: 44919 - DNA, 1133 bp, Panicum virgatum
  misc_feature: Ceres CLONE 2022556
  misc_feature: Encodes the peptide sequence at SEQ ID NO. 44920
tctggcctcccactgcccacatgcgcgcacagtccactctccactcctacccagctgcttttccggcgagcagcagagctgagctccgtcgccagtagcctcagaccagcgccgaactcaactagctagccgccgccaccggtaggttaggtcgcgcgccatgagcaaggagaagcaccaccgcgactggatcctccggcgctgctgcggcgccttctgcgcctgcttcctcacgctcgccgccgtggtgggcttcatcgtgctcgtcatctacctggcgctccacccctccaagccctctttctacctccaggacgtgcagctccgctccatcgacctcagcgaccccgcgctctccctcaacctccaggtgacgatcgcgtcgcgcaacccgaacgagcgcgtgggcgtctactacatgagcctggacgcgttcgcgacgtaccgggacgagccggtgacggtggcggtggcgctgccggccatctaccagggccacaaggacgcgtcggtgtggtcgccggtgctggcgggggagtcggtgccggtgtcggtgtcggggggcgcggcggacgccatgcggcaggacatcgcggccgggtacgtgctgctccacgtccgggtggaggggcgcgtcaagtggaaggtcggcagctgggtctcgggcgggtaccacctctccgtcaactgccccgcgctgctcgccgcctcgggcggcgccgccgccggcggggccttcgccttcagcgccgcggccggcgccgccgtgcccgccggcgtcaacaccaccgtctcgctcaagttcacgcaccccgccgactgcaccgtcgacgtgtgatgcatgacctctgacgacggccgggcgacgggcgtccgttcgctcagtcgccgttcgtgcgtacgatgacccgtcgctcgcgcgtagctatcgacgatgcagcaaccagcaatcttgtagcagttgaaaattaatgttcctctccttgattgttatttcccaaccctttttttcccccgaacctgtgcagaataaattattaaagctagtactctacatgaacgcactctgtctcgtagctttgcaatttataatcatgtaatatttccaacgaaatagaattaatttccatccc

SEQ ID NO: 44920 - protein, 225 aa, Panicum virgatum
  misc_feature: Ceres CLONE 2022556
  misc_feature (38)..(177): Pfam Name: Hin1 Pfam Description: Harpin-induced protein 1 (Hin1)
MSKEKHHRDWILRRCCGAFCACFLTLAAVVGFIVLVIYLALHPSKPSFYLQDVQLRSIDLSDPALSLNLQVTIASRNPNERVGVYYMSLDAFATYRDEPVTVAVALPAIYQGHKDASVWSPVLAGESVPVSVSGGAADAMRQDIAAGYVLLHVRVEGRVKWKVGSWVSGGYHLSVNCPALLAASGGAAAGGAFAFSAAAGAAVPAGVNTTVSLKFTHPADCTVDV

SEQ ID NO: 44921 - DNA, 393 bp, Panicum virgatum
  misc_feature: Ceres CLONE 2022586
  misc_feature: Encodes the peptide sequence at SEQ ID NO. 44922
gaaaaccaggactagaagcgatcggacatcggggtaaggcgagcaaggcacggcgaggcgacgacggcgccatgagctaccagaaggtcccggagtcctacccgccgccagggtactcgcagccgtacccgccgccgggcagtcagtatccacctccccaggctccaccgcaggggccttactaccctgctgcctcggcttcctgaaaggatggtgggccgctctttgctgctgctgcatactggacgagtgctgcggctgctgtttctgacgtatatgcctttgaagcctcctcgtgtctggcatccttggacagcaaaatttgtctctgtatttaacttgctatgattgttggatagtataaaagtgaatcttagttgtgttactcttcgt

SEQ ID NO: 44922 - protein, 44 aa, Panicum virgatum
  misc_feature: Ceres CLONE 2022586
  misc_feature: Functional homolog of the protein sequence given in SEQ ID NO 50391
  misc_feature: Useful for making plants with altered carbohydrate content
  misc_feature: Functional homolog of the protein sequence given in SEQ ID NO 51697
  misc_feature: Useful for making plants with modulated flowering time
MSYQKVPESYPPPGYSQPYPPPGSQYPPPQAPPQGPYYPAASAS

SEQ ID NO: 44923 - DNA, 745 bp, Panicum virgatum
  misc_feature: Ceres CLONE 2022597
  misc_feature: Encodes the peptide sequence at SEQ ID NO. 44924
tgatgttgctgttatcgatgaccttctgtccaagttagaagaatgtgcaaagaatctgccaccagggttccaaatgaaacctatccaattcgagaaggatgatgacactaattttcacatggatttaatatctgggtttgcgaacatgcgtgcaaggaactacagcattcctgtggttgacaagttgaaggccaagttcatcgctggaagaatcatccctgctattgcaacttcaacagccatggccacaggtcttgtgtgccttgagctatacaaggttattgctggggagcaccctattgaggactaccgcaacacatttgccaacctagcgctgcctctgttctcgatcgccgagcctgttccagccaaggtgatgaagcaccaagaccttagctggaccgtatgggatcgatggttggtcaagggcgacctgactgttgcggagctcctgcaatggttcagcgacaagggcctcagtgcttacagcatgtcctgtggcacgtctctgctgtacaatagcatgtttccgaggcacaaggaaagactgcagaagaaggttgttgatgtcgcgagggaagtcactaaggtggaggtccctgagtacaggaggcacatagatattgtggtggcctgcgaggacaatgatggggacgacattgatatccctctcgtatccgtctacttccgatagtctgcttctggatccagattgtaaaaagatggttgcggtgattgtgagact

SEQ ID NO: 44924 - protein, 230 aa, Panicum virgatum
  misc_feature: Ceres CLONE 2022597
  misc_feature (29)..(97): Pfam Name: UBACT Pfam Description: Repeat in ubiquitin-activating (UBA) protein
DVAVIDDLLSKLEECAKNLPPGFQMKPIQFEKDDDTNFHMDLISGFANMRARNYSIPVVDKLKAKFIAGRIIPAIATSTAMATGLVCLELYKVIAGEHPIEDYRNTFANLALPLFSIAEPVPAKVMKHQDLSWTVWDRWLVKGDLTVAELLQWFSDKGLSAYSMSCGTSLLYNSMFPRHKERLQKKVVDVAREVTKVEVPEYRRHIDIVVACEDNDGDDIDIPLVSVYFR

SEQ ID NO: 44925 - DNA, 728 bp, Panicum virgatum
  misc_feature: Ceres CLONE 2022605
  misc_feature: Encodes the peptide sequence at SEQ ID NO. 44926
  misc_feature (627)..(627): n is a, c, t, g, unknown, or other
acgtacgtgtcaactgcacttccaaaaaggcatatccattccaattccatggagctcgcgccgctgctcctgctccccctactgctgctcccggcggcggccgtcgcctccggcggtgagccggcggcgcacccgggctacgcgcacggcgccgaggaggcatgcggcgtggcggtgctgccggcgccggagcggcgcgaggagttcgacggcggccggatcgtggacatcagccactactaccgcgcggacatgccggcgtgggagtcggcggagggctccggcgagttcctgcggctggcgcggtccatgcgcaacggctccgacatcgccaacttctcggagctccgcctcaccgcgcactccggcacccacgtcgacgcgccggggcacgtcttcgagcactactacgacgccggcttcgacgtcgacacgctcgacctcgccgtcctcaacgggccagcgctgttggttgatgttcccagagataagaacataacagctgatgtcatggcatcccttcacattcccgaaggtgttcgacgtgtactcttccgaaccttaaataccgatagaaagcttatgtggaagaaagagtttgatacaagttatgttggcttcatgaangatggtgcacaatggttggttgacaatactaacattaaactagttggagtcgattacttgtctgtgggtgcatttgatgaatgcattccagcccatctagt

SEQ ID NO: 44926 - protein, 226 aa, Panicum virgatum
  misc_feature: Ceres CLONE 2022605
  misc_feature (58)..(225): Pfam Name: Cyclase Pfam Description: Putative cyclase
  misc_feature: Functional homolog of the protein sequence given in SEQ ID NO 51698
  misc_feature: Useful for making plants with modulated salt sensitivity
  misc_feature (193)..(193): Xaa is any aa, unknown, or other
MELAPLLLLPLLLLPAAAVASGGEPAAHPGYAHGAEEACGVAVLPAPERREEFDGGRIVDISHYYRADMPAWESAEGSGEFLRLARSMRNGSDIANFSELRLTAHSGTHVDAPGHVFEHYYDAGFDVDTLDLAVLNGPALLVDVPRDKNITADVMASLHIPEGVRRVLFRTLNTDRKLMWKKEFDTSYVGFMXDGAQWLVDNTNIKLVGVDYLSVGAFDECIPAHL

SEQ ID NO: 44927 - DNA, 571 bp, Panicum virgatum
  misc_feature: Ceres CLONE 2022607
  misc_feature: Encodes the peptide sequence at SEQ ID NO. 44928
agaccgctttccttccgtcgacattgtcctcatcttcttcactcattgacactcaactgcaacttctattgatctctaccagaaacccgtgcttctaactacccctcattctcagacacaatggtcaaagcagttgttctcggtgccgccggtggcattggccagccattgtcgctgctcttgaagatctctcccctcgtcgacgagctctccctctttgatgtggtcaacactcctggtgttgctgctgatctttcacacatttcctcacccgcggtcattgatggcaccgtggccgccaagggcgacttcaagggcgaacaaccagagacagaagaggccaagaagcaggcattaactggtgcagacatcgtcattattccagctggtgtccctcgcaaacctggtatgacccgagatgatctcctcaagattaatgcaggtatcgtcaaggatcttgtggttgcaattgcaaagtatgctcccaaggcgagcattgccatcatctccaatcccgtcaactcaacagttcccatcgccgctgaagtgctgaaggaggctggtgtcttca

SEQ ID NO: 44928 - protein, 150 aa, Panicum virgatum
  misc_feature: Ceres CLONE 2022607
  misc_feature (2)..(150): Pfam Name: Ldh_1_N Pfam Description: lactate/malate dehydrogenase, NAD binding domain
  misc_feature: SWISSPROT Homolog: EC 1.1.1.37 Malate dehydrogenase
MVKAVVLGAAGGIGQPLSLLLKISPLVDELSLFDVVNTPGVAADLSHISSPAVIDGTVAAKGDFKGEQPETEEAKKQALTGADIVIIPAGVPRKPGMTRDDLLKINAGIVKDLVVAIAKYAPKASIAIISNPVNSTVPIAAEVLKEAGVF

SEQ ID NO: 44929 - DNA, 651 bp, Panicum virgatum
  misc_feature: Ceres CLONE 2022607-R
  misc_feature: Encodes the peptide sequence at SEQ ID NO. 44930
tcccccgtggttggtggccactccggcaatactatcgtccctctcttcagccaagccaagccttccgtcaatatccctgccgataagcttgatgctttggtcaaccgtgttcagttcggtggtgacgaggtggtcaaggccaaggacggtgcaggatctgcaactctgtcaatggcatacgccggtttcagattcaccgaggctcttttgaaggctgcaaagggcgagaagggcatcgtcgaaccgacctttgtctatctccctggtgtggaaggtggtgatgctgttgccaaggtgactggtaccgattacttctctgtccctgttgagctcggtcccgacggagctgaaaaagctatcaacatcctcagcggcgccaatgactacgagaagaagctcttggatgaagcagtcaagggcttgaagaccaacatcgagactggtgttagcttcatcaagaatcctcccaagttatgaacatatcgtcaaagtctggttctctgtgagctggacctcaagcaattcagcccttcactgcaaaccctttttagacaaaatatttgccactggttggaagacttttcgaggctcttagagcatataagacattatcgaaaatgcccagccgaaatgaaatgatgtgacaatttg

SEQ ID NO: 44930 - protein, 158 aa, Panicum virgatum
  misc_feature: Ceres CLONE 2022607-R
  misc_feature (1)..(152): Pfam Name: Ldh_1_C Pfam Description: lactate/malate dehydrogenase, alpha/beta C-terminal domain
  misc_feature: SWISSPROT Homolog: EC 1.1.1.37 Malate dehydrogenase
SPVVGGHSGNTIVPLFSQAKPSVNIPADKLDALVNRVQFGGDEVVKAKDGAGSATLSMAYAGFRFTEALLKAAKGEKGIVEPTFVYLPGVEGGDAVAKVTGTDYFSVPVELGPDGAEKAINILSGANDYEKKLLDEAVKGLKTNIETGVSFIKNPPKL

SEQ ID NO: 44931 - DNA, 698 bp, Panicum virgatum
  misc_feature: Ceres CLONE 2022613
  misc_feature: Encodes the peptide sequence at SEQ ID NO. 44932
aggcctgaatgcccttgcccttgcccttgcccttgccccctcgatcaggtcgtcaggtcagtcagagctgacgacgacgaactaaaatttaagcagctagctagcgtgcccgccacgcgccatatatatggtcgtcgacatggggaagaaggaggaggacgagctgcagctgctggtccgacaagcggctgtgaatgatgatgatgatgatgagcaagtccaagcactggtgcgcaagatctccggtctcgccgcggccatcgccaagctgccgtccctgagcccgtcccccgaggtgaacgcgctcttcaccgagctggtgacggcctgcgtcccgcccagcgccgtcgacgtcgccaagctggggcccgagctgcaggcgatgcgcgcgcgcctcatccgcctctgcgccgacgccgagggcctgctggaggcgcactactcggacctcctggccgccttcgacagcccgctcgaccacctcgcgctcttcccctacctcagcaactacatcctgctcagcgagctggagcacggcctgctggcgcgccacctgcccggcccgccgccggcgcgcgccgacgccgacctgggcgcgcgcatggcgttccgcacctccgacgtggccctgctcacgcgggagctgctggcgtcctacgacgccgtgttcctggcggcgctggtgggcatggccgccg

SEQ ID NO: 44932 - protein, 190 aa, Panicum virgatum
  misc_feature: Ceres CLONE 2022613
  misc_feature (27)..(190): Pfam Name: NAS Pfam Description: Nicotianamine synthase protein
  misc_feature: SWISSPROT Homolog: EC 2.5.1.43 Nicotianamine synthase
MVVDMGKKEEDELQLLVRQAAVNDDDDDEQVQALVRKISGLAAAIAKLPSLSPSPEVNALFTELVTACVPPSAVDVAKLGPELQAMRARLIRLCADAEGLLEAHYSDLLAAFDSPLDHLALFPYLSNYILLSELEHGLLARHLPGPPPARADADLGARMAFRTSDVALLTRELLASYDAVFLAALVGMAA

SEQ ID NO: 44933 - DNA, 879 bp, Panicum virgatum
  misc_feature: Ceres CLONE 2022639
  misc_feature: Encodes the peptide sequence at SEQ ID NO. 44934
gcagatcacacacagcaaaccacatttcctccacccccacctgctcgggggctctcgcctccctgccccactcctctctcgctggtaccttgctgccgcgcagagatggtaaacctcacagcaagagatgtcgaggtcaccatgcgcaaccagcacagggtgcgcaacgtctctatcgttgctcacgtagaccatggcaagtccacgctgacggactccatgctctccgcggcgggcctcatggcgctggaggacgctggcaaggtgcgtgccacggacacgcgcgacgatgaggccgagcgtggcatctcggtcaaggccacggcagtctccttcggctacgacttcggagcaacgcgcacaggcatcgcgaccagcgacagctacgtcgtcaacctcgtggactgccccggccacgttgacttctcgccggaggtgacggctgctttgcgcctcaccgacggcgccctcgtcgtcgtagactgcgttgagggcgtctgcgtgcagacgcagaccgtgctgcgccaggcgctgggcgagagaatcaaacccgtcctcgttgtcaacaagctggaccgcttcttcctcgagctcgaggtccatgtcctttccgatttgcattgccctgttaggaaaattgtaattgtgaaagcttccatgtttgtaacgtgaaacaacaaggacatgtatcggccaaggagtgctatagatagaactgactatagatagaattattctttcttgtaaagcaatccttggccggctctcctgtttgttctcacgctatatatgtaagccatgagaggggcttttcctccatcaatacaattaacacgcaaccgaccgagagacccaagatagggctccgtcgttcctcct

SEQ ID NO: 44934 - protein, 188 aa, Panicum virgatum
  misc_feature: Ceres CLONE 2022639
  misc_feature (17)..(185): Pfam Name: GTP_EFTU Pfam Description: Elongation factor Tu GTP binding domain
MVNLTARDVEVTMRNQHRVRNVSIVAHVDHGKSTLTDSMLSAAGLMALEDAGKVRATDTRDDEAERGISVKATAVSFGYDFGATRTGIATSDSYVVNLVDCPGHVDFSPEVTAALRLTDGALVVVDCVEGVCVQTQTVLRQALGERIKPVLVVNKLDRFFLELEVHVLSDLHCPVRKIVIVKASMFVT

SEQ ID NO: 44935 - DNA, 697 bp, Panicum virgatum
  misc_feature: Ceres CLONE 2022641
  misc_feature: Encodes the peptide sequence at SEQ ID NO. 44936
atagacggccgtcgaagcctccggagatgccactccccgcgccgttccgggttttctccccaccctccgccgccgtcgcctcagccggtcccgccggagcgcagcgcgcgctgatctacggacgccgcgcgcccctcgcgggagcgctcctgttcttcagcatcggcgctgtcagcgccgccgtcgcctgcaggacggggtgctccttgtcccaccgccgcctcccattcctcggggcaagaggtctcagctctgctcgaatggagtctacttccaccaccgtgccttccattgttgtatatgttacggttccaaatagagaagcaggcaagaagctgtcacagagcattatcagcgagaagcttgctgcttgtgtcaatatagtacctggtttgaatttgattttcttctcgcttatttttttttttcatgtttgacattatgaacacactgcacatgaaaatgtgattgttcattgttgtgtcaagtggcttgtataagggtgggggcaggggttcggggattttctcggcctgcgtgagaatgcctcttcttacatgcaatgcccggagggcgacttgcccctcgcaggtcgagttttttttaaaaaaattatttattcttcctaaaatggaagattttactctatgcaaataatattaacaatatttaaattatttattacatcttttggaag

SEQ ID NO: 44936 - protein, 136 aa, Panicum virgatum
  misc_feature: Ceres CLONE 2022641
  misc_feature (88)..(132): Pfam Name: CutA1 Pfam Description: CutA1 divalent ion tolerance protein
MPLPAPFRVFSPPSAAVASAGPAGAQRALIYGRRAPLAGALLFFSIGAVSAAVACRTGCSLSHRRLPFLGARGLSSARMESTSTTVPSIVVYVTVPNREAGKKLSQSIISEKLAACVNIVPGLNLIFFSLIFFFHV

SEQ ID NO: 44937 - DNA, 592 bp, Panicum virgatum
  misc_feature: Ceres CLONE 2022671
  misc_feature: Encodes the peptide sequence at SEQ ID NO. 44938
aacaaacaagttactgccgcagatctgccatttctagcttacctctatacctatggagccatccaagctagtagttgttttgctcgtgctggccatggcggccgtgcggccttccagcgctcagaactcgcctcaagactatctcacgccccacaaccaggcccgcgcctccgtcggcgtcggcgcggtgacctggagcacgaagctgcagcaattcgcggtgaggtcgtgggtggacgagaagcagtggtacgactacgccgccaacagctgcgccgccggcaaggtgtgcggccactacacgcaggtggtgtggcgtgccaccaccagcatcggctgcgcgcgcgtcgtctgcaacagcaaccgcggggtcttcatcacctgcaactacgagccccgcggcaacatcgtcggacagaagccctactgatcgctaaactgctatcttctagctcatggattatggcgtggatgcatggaactttctactatacgaaaacgaaattacgaatgcccatataataaggcatgcactgagtaaataaagggtcagtgtgccgtgtgctagctacctccatctcttaataaagcc

SEQ ID NO: 44938 - protein, 125 aa, Panicum virgatum
  misc_feature: Ceres CLONE 2022671
  misc_feature (31)..(113): Pfam Name: SCP Pfam Description: SCP-like extracellular protein
  misc_feature: Functional homolog of the protein sequence given in SEQ ID NO 50414
  misc_feature: Useful for making plants with modulated biotic stress sensitivity
MEPSKLVVVLLVLAMAAVRPSSAQNSPQDYLTPHNQARASVGVGAVTWSTKLQQFAVRSWVDEKQWYDYAANSCAAGKVCGHYTQVVWRATTSIGCARVVCNSNRGVFITCNYEPRGNIVGQKPY

SEQ ID NO: 44939 - DNA, 553 bp, Panicum virgatum
  misc_feature: Ceres CLONE 2022672
  misc_feature: Encodes the peptide sequence at SEQ ID NO. 44940
aagatcggcaagaaaccatcggtcgagcaatggcgctcgcgagcccgatcagggcagcctccgtcgtggccctggcggccctggtggtctgcctcgccgtgccggcggcggcggcggggaacaagaccgggcaggtgaccgtgttctggggccggaacaaggacgagggcacgctccgggaggcctgcgactccggcctctacaccatggtcatcatgtccttcctcgacgtctacggccagggcaggtaccacctcgacctctccggccaccccctcgccggcatcggcgccgacatcaagcactgccagtacaagggcgtccccgtgtcgctctccgtcggcggcttcggctccggctactcgctcccgtccgagcaggcggcgttcgacctcttcgaccacctctggaacgcctacttcggcggccgcaagccgggcgtccgccggcccttcggcgacgcgtggctcgacggcgtcgacctcttcctggagcgcggcacggcggcggaccggtacgacgtgctggcgcgggagctcgcccagcacaacat

SEQ ID NO: 44940 - protein, 174 aa, Panicum virgatum
  misc_feature: Ceres CLONE 2022672
  misc_feature (34)..(174): Pfam Name: Glyco_hydro_18 Pfam Description: Glycosyl hydrolases family 18
  misc_feature: SWISSPROT Homolog: EC 3.2.1.14 Chitinase
MALASPIRAASVVALAALVVCLAVPAAAAGNKTGQVTVFWGRNKDEGTLREACDSGLYTMVIMSFLDVYGQGRYHLDLSGHPLAGIGADIKHCQYKGVPVSLSVGGFGSGYSLPSEQAAFDLFDHLWNAYFGGRKPGVRRPFGDAWLDGVDLFLERGTAADRYDVLARELAQHN

SEQ ID NO: 44941 - DNA, 680 bp, Panicum virgatum
  misc_feature: Ceres CLONE 2022684
  misc_feature: Encodes the peptide sequence at SEQ ID NO. 44942
aacagcaacacaacaccctctgcccggcaacacccattgctcacctcactccccaccccacatcgtcgaccaccatggcggcgcccatagccacaagaaccaccctgtccctgctggcggcgtgcgccgccgtcctcgtggcggtggtcgtggtgtcgtccttggcaccggcggcggcggcgaacgaggaaggggacgcgctgatggccctacgccgcggcgtcgaggaccccgacggcgtgctcgcgagctgggacccgaatctggtgaacccgtgcacctggtttcacgtcggttgcaacgacgacaaccgcatcgaccgcatagagcttgctaacatgaggttgtccggacccctgccggcggagctggggaaactggagcagctgcaatacatggagatgagcgggaacaatctccagggcccgatcccgtcggagttcggcgacctgaggaacctgatcagcatggacctgtacaacaacgacatctcggggcacctgcccagcacgctcgggaatctcaagtccctgcggttcctgcgcatcgaccacaaccgcctgacgggcccgatccccagggagctgtccgggactgccaacctcgagtccgtggatttctccagcaacgacctgtgcggcaccatcccgacgtccgggccgttcgagaacgtgcccctc

SEQ ID NO: 44942 - protein, 201 aa, Panicum virgatum
  misc_feature: Ceres CLONE 2022684
  misc_feature (36)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAPIATRTTLSLLAACAAVLVAVVVVSSLAPAAAANEEGDALMALRRGVEDPDGVLASWDPNLVNPCTWFHVGCNDDNRIDRIELANMRLSGPLPAELGKLEQLQYMEMSGNNLQGPIPSEFGDLRNLISMDLYNNDISGHLPSTLGNLKSLRFLRIDHNRLTGPIPRELSGTANLESVDFSSNDLCGTIPTSGPFENVP

SEQ ID NO: 44943 - DNA, 585 bp, Panicum virgatum
  misc_feature: Ceres CLONE 2022685
  misc_feature: Encodes the peptide sequence at SEQ ID NO. 44944
aaaaaaaaaaagaagaaagcagaatgctgaccaagctattcttgctctcaattgttgcgtgcttcttcatcgccagttcgctggcgacaacgccacgcagccaagctgtgattacgagcctgccaggccaaacttttcaagcaacttttcctcagtattctggctacatcaccgtcgatgaagcccacggccggaacctcttctactggttccagaccattcaaagcaacaaccgctctgccaacgaccctgtggttttgtggctgaacggtggtccaggctgttcgacgattggcgccggatgccttgaagagaatggtgcctaccgaactgtgcttctgggcggcccgaacaacactgtgggcgtggattcggagttctgggcgtggaacaaggtggcgaacatcatctacctcgactctcctgcaggcgtcggctactcctactccgacacaccttccgactacttcaccaacgacaacaagaccgccattgatacgacgaccttcctcaacctgttcttcaccgaagtcttccccgactacgccgacaactctttctggattgccggtgagagctacgcgg

SEQ ID NO: 44944 - protein, 187 aa, Panicum virgatum
  misc_feature: Ceres CLONE 2022685
  misc_feature (34)..(187): Pfam Name: Peptidase_S10 Pfam Description: Serine carboxypeptidase
  misc_feature: SWISSPROT Homolog: EC 3.4.16.6 Carboxypeptidase D
MLTKLFLLSIVACFFIASSLATTPRSQAVITSLPGQTFQATFPQYSGYITVDEAHGRNLFYWFQTIQSNNRSANDPVVLWLNGGPGCSTIGAGCLEENGAYRTVLLGGPNNTVGVDSEFWAWNKVANIIYLDSPAGVGYSYSDTPSDYFTNDNKTAIDTTTFLNLFFTEVFPDYADNSFWIAGESYA

SEQ ID NO: 44945 - DNA, 591 bp, Panicum virgatum
  misc_feature: Ceres CLONE 2022699
  misc_feature: Encodes the peptide sequence at SEQ ID NO. 44946
tcttgtgcggcttcgtcttcctccagaccagagtcccacacgcttcccattccactcaccccccctccgcgtgaacgcgccggagccgcggatcctgccgccaagaatggaggcatggccggacgacttccggtgccccatcacgctggaggtcatgaccgaccccgtcatcctcccctccggccacaccttcgagcgccgcagcatccagcgctggctcgacggggggcacctcacctgccccgtcaccaacctcccgctcccgccctccccgccgctcatccccaaccacgcgctgcgccgcctcatagccgccgtcgcgccttcagcggtggccgcccccgtcccctctgagggacctgcgcaggggaggcaagaagcggcggcggcggaggcggttcagtcctccttcgtccgtgccggcgctgctgaggctggccaagtccggcgccgccggacggagggaggtgctggagtccggcaacgcggcggtgctgctgcggcacgcggcggccggggacgaggcggcggcccgggcgctcctgctcctcaccctggacggcgacgactcgcgcgtcggggtcctggcgg

SEQ ID NO: 44946 - protein, 161 aa, Panicum virgatum
  misc_feature: Ceres CLONE 2022699
  misc_feature (5)..(78): Pfam Name: U-box Pfam Description: U-box domain
MEAWPDDFRCPITLEVMTDPVILPSGHTFERRSIQRWLDGGHLTCPVTNLPLPPSPPLIPNHALRRLIAAVAPSAVAAPVPSEGPAQGRQEAAAAEAVQSSFVRAGAAEAGQVRRRRTEGGAGVRQRGGAAAARGGRGRGGGPGAPAPHPGRRRLARRGPG

SEQ ID NO: 44947 - DNA, 568 bp, Panicum virgatum
  misc_feature: Ceres CLONE 2022702
  misc_feature: Encodes the peptide sequence at SEQ ID NO. 44948
caagatgctacaaatgtgggtgatgaaggtggctttgcacctaacattcaggaaaacaaagagggccttgaactgttgaaggcagctatagaaaaggctggctacactggaaaggtggttattggaatggatgttgctgcttctgaattcttcagtgagaaggataagacttatgatcttaatttcaaggaggaaaacaacgatggttcaaacaaaatctcaggtgacagcctgaaagatctgtacaagtcctttgtttctgagtatcctattgtgtccatcgaagacccatttgatcaggatgactgggccacctatgccaaactcactgatgagattggagagcacgtgcagattgtaggagatgatcttcttgttactaatccaacgagggttgccaaggccatcagtgagaagacctgcaatgctcttctgttgaaggtgaatcaaatcgggtcagtgactgagagtattgatgctgttagaatgtccaagcgtgctggatggggagtgatggcaagccacaggagtggtgagacagaggacaccttcattgctgacctctctg

SEQ ID NO: 44948 - protein, 189 aa, Panicum virgatum
  misc_feature: Ceres CLONE 2022702
  misc_feature (1)..(189): Pfam Name: Enolase_C Pfam Description: Enolase, C-terminal TIM barrel domain
  misc_feature: SWISSPROT Homolog: EC 4.2.1.11 Phosphopyruvate hydratase
QDATNVGDEGGFAPNIQENKEGLELLKAAIEKAGYTGKVVIGMDVAASEFFSEKDKTYDLNFKEENNDGSNKISGDSLKDLYKSFVSEYPIVSIEDPFDQDDWATYAKLTDEIGEHVQIVGDDLLVTNPTRVAKAISEKTCNALLLKVNQIGSVTESIDAVRMSKRAGWGVMASHRSGETEDTFIADLS

SEQ ID NO: 44949 - DNA, 649 bp, Panicum virgatum
  misc_feature: Ceres CLONE 2022709
  misc_feature: Encodes the peptide sequence at SEQ ID NO. 44950
ggcgcggtgcggccggtggagagcgcggcgggggagacgatgctcctctggggcctcggccagcccacggcgcaccgcaacaacgccttggtccgccaggccgcgcactccttcgagctcgacgcctgcgggcggcgcctctccctgctgcagtccccctcctccatggccaccccgggggtcaccggggcggtcgtctgggacagcggcgtcgtgctcgccaagtttctcgagcacgccgtcgactcccagcagctgctgatgcgcgacgcgcgagccgtcgacctcggatccggatgcggcctggtggggtgcgtcgccgcgctgctgggagcccatgtggtcctcaccgacctccccgaccgcctcaagctgctcaggaagaacgtcagcctcaacgtcgacgacccccacgtcccgggctccgctcgggtcacggagcttgtatggggcgatgatcctcaccatgaattggttcgggagccactgcccaatttcgtgctcggctccgacgtcatctacaacgaggaagcggtggatgatctgctgctcaccctcaaccaactctcaggacaacacaccacaatactactagctggagagctccgcaacgatgctgtgctggagtgcttcttggaggcagcaatgg

SEQ ID NO: 44950 - protein, 216 aa, Panicum virgatum
  misc_feature: Ceres CLONE 2022709
  misc_feature: SWISSPROT Homolog: EC 3.5.4.26 Diaminohydroxyphosphoribosylaminopyrimidine deaminase
GAVRPVESAAGETMLLWGLGQPTAHRNNALVRQAAHSFELDACGRRLSLLQSPSSMATPGVTGAVVWDSGVVLAKFLEHAVDSQQLLMRDARAVDLGSGCGLVGCVAALLGAHVVLTDLPDRLKLLRKNVSLNVDDPHVPGSARVTELVWGDDPHHELVREPLPNFVLGSDVIYNEEAVDDLLLTLNQLSGQHTTILLAGELRNDAVLECFLEAAM

SEQ ID NO: 44951 - DNA, 692 bp, Panicum virgatum
  misc_feature: Ceres CLONE 2022721
  misc_feature: Encodes the peptide sequence at SEQ ID NO. 44952
atcactcacaacatccaaaaccatcccaccaccctccacgcacatcgaccgagccaccatggcgttccgacgccggtcaagccctccggcggcggcggtggccctcctcccgctcgcgttcctgctgctagcctgcctctccggcgccgccgcggccaagcagaccggccagctcaccgtcttctggggccggaacgcgggcgagggcaccctgcgcgaggcctgcgacacggggctctacaccaccgtcgttatctccttctacagcgtcttcggccacggccgctactggggcgacctgtcgggccacccgctcgccggcgtcggcgccgacatcaagcactgccagtcgaggaacgtcctcgtgctcctctccatcggcgggcccggggacggctactccctcccgtcgtcccagtccgcggccgacgtcgccgacaacctctggaacgcgcacctcggcgggcgccgccgcggcgtgttccgccccttcggcgacgccgccgtcgacggcatcgacttctacatcgaccgcggcgggccggggcactacgacgagctggcgcgccgcctcgacgggtacaaccggttctaccgcgggcggaagggggtgcggctgacggcgacgccgcggtgcggcttccccgacgcgcggctcgaccgcgcgctgcggacggggctgttcgagcgcg

SEQ ID NO: 44952 - protein, 211 aa, Panicum virgatum
  misc_feature: Ceres CLONE 2022721
  misc_feature (37)..(211): Pfam Name: Glyco_hydro_18 Pfam Description: Glycosyl hydrolases family 18
  misc_feature: SWISSPROT Homolog: EC 3.2.1.14 Chitinase
MAFRRRSSPPAAAVALLPLAFLLLACLSGAAAAKQTGQLTVFWGRNAGEGTLREACDTGLYTTVVISFYSVFGHGRYWGDLSGHPLAGVGADIKHCQSRNVLVLLSIGGPGDGYSLPSSQSAADVADNLWNAHLGGRRRGVFRPFGDAAVDGIDFYIDRGGPGHYDELARRLDGYNRFYRGRKGVRLTATPRCGFPDARLDRALRTGLFER

SEQ ID NO: 44953 - DNA, 728 bp, Panicum virgatum
  misc_feature: Ceres CLONE 2022730
  misc_feature: Encodes the peptide sequence at SEQ ID NO. 44954
aatacctttcccttctctcggactcgctcgtcccttgctcttccttccccggcggcgacgaccgggcgagcggcggcgccatttgtcacgtatccgcccagccctttgccggcgacgagcatccgccagggtcaggacgatcattgattttggacaaacaagatcttccatggaaccatcctcacagccgcagcctgtgatgggtgttgctactggtggatcacaagcttatcctgctgctgcttcctatgcgcctccagcaatggtacctggagctcctgctgttgttcctcctggctcacagccagcagcaccatttgccaatccagctcaactcagcgctcagcaccagatggtctaccaacaagctcagcaatttcaccaacaactgcagcaacagcaacagcagcagctcagagagttctggactacccagatggatgagatcgagcagacaactgacttcaagaaccacaccttgccacttgcaaggataaagaagataatgaaggctgatgaggatgtgcggatgatttctgcagaagctcctgttgtctttgcgaaggcatgtgaggtattcatattggagctgacattgagatcatggatgcacacagaagagaacaagcgccggaccttacagaagaacgacattgcagctgccatcactaggactgacatatatgacttcctggtggacatatttcctagggatgaaatgaaagaag

SEQ ID NO: 44954 - protein, 186 aa, Panicum virgatum
  misc_feature: Ceres CLONE 2022730
  misc_feature (102)..(166): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: The sequence is a functional homolog of SEQ ID NO 1109 in the 10/374,780 US patent application
  misc_feature: The sequence is a functional homolog of SEQ ID NO 1189 in the 10/412,699 US patent application
  misc_feature: The sequence is a functional homolog of SEQ ID NO 836 in the 10/374,780 US patent application
  misc_feature: The sequence is a functional homolog of SEQ ID NO 1108 in the 10/374,780 US patent application
  misc_feature: The sequence is a functional homolog of SEQ ID NO 712 in the 11/479,226 US patent application
MEPSSQPQPVMGVATGGSQAYPAAASYAPPAMVPGAPAVVPPGSQPAAPFANPAQLSAQHQMVYQQAQQFHQQLQQQQQQQLREFWTTQMDEIEQTTDFKNHTLPLARIKKIMKADEDVRMISAEAPVVFAKACEVFILELTLRSWMHTEENKRRTLQKNDIAAAITRTDIYDFLVDIFPRDEMKE

SEQ ID NO: 44955 - DNA, 640 bp, Panicum virgatum
  misc_feature: Ceres CLONE 2022778
  misc_feature: Encodes the peptide sequence at SEQ ID NO. 44956
agagcaccagaccatctcagctttgcttctcagctagctagctttaggctccggttgcagcgagaagcaggcaggcaggcatggaggggaaggaggaggacgtccgcctgggcgccaacaagttctccgagcgccagcccatcggcacggcggcgcagggcaccgatgacaaggactacaaggagcccccgccggcgccgctcttcgagcccggggagctcaagtcctggtccttctaccgcgccggcatcgccgagttcgtcgccaccttcctcttcctctacatcagcatcctcaccgtcatgggcgtcagcaattcccaatccaagtgcgccaccgtcggcatccagggcatcgcctggtccttcggcggcatgatcttcgccctcgtctactgcaccgccggcatctccggtaccgtaccacccgcccctgtttgtgcttcttgccggcgccgtcgtgctagctgctgacgggttctttaatttttggctctcgaatccgcaggcggccacatcaacccggcggtgaccttcggcctgttcctggcgaggaagctgtcgctcaccagggccatcttctacatcgtcatgcagtgcctgggcgccatctgcggcgccggcgtcgtcaagggctttca

SEQ ID NO: 44956 - protein, 130 aa, Panicum virgatum
  misc_feature: Ceres CLONE 2022778
  misc_feature (46)..(129): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MEGKEEDVRLGANKFSERQPIGTAAQGTDDKDYKEPPPAPLFEPGELKSWSFYRAGIAEFVATFLFLYISILTVMGVSNSQSKCATVGIQGIAWSFGGMIFALVYCTAGISGTVPPAPVCASCRRRRASC

SEQ ID NO: 44957 - DNA, 671 bp, Panicum virgatum
  misc_feature: Ceres CLONE 2022789
  misc_feature: Encodes the peptide sequence at SEQ ID NO. 44958
acgatccagcaccacgaagcgaactcggccgaatcaccggtggtcttgagccacgacgatgccctcccgcgacggcggccctgccgtcatgcaccctccgccgctgcctcctctgccgtcgtccagcttcgctcacatcgtgccccagtaccacccagccatggtgccgtacgcgccgcagcccgcgcagctggtgtactcggccaaggcccaggtccgggacgtgtggtccgggaacctcgaggaggagctcgccaacatcgcggcgctgctgccctactacccgtgcgtgtgcatggacacggagttccccggcgccgtgcacgactcgggcacgccgcgctacctccgcggcccgcgcgagagctacgcgctggtgaagaggaacgtcgacgacctcaagctgctccaggtcgggttcgcgctgtccggcgccgccggccgctgccccgtcgcgtggcagttcaacgtccggggcttcgaccccgcgcgcgacccgcacgcgccggcctccgtcgccatgctccgcgcgcagggcatggacttgggcacgctgcgggagttcggcgtccgcccgggcgacctggccgcagggttctaccgctgcggcctcggctgcgggaacctcacctgggcggcgttcgccggcgcctacgacttcgcgtacctcg

SEQ ID NO: 44958 - protein, 204 aa, Panicum virgatum
  misc_feature: Ceres CLONE 2022789
  misc_feature (54)..(204): Pfam Name: CAF1 Pfam Description: CAF1 family ribonuclease
  misc_feature: SWISSPROT Homolog: EC 3.1.13.4 Poly(A)-specific ribonuclease
MPSRDGGPAVMHPPPLPPLPSSSFAHIVPQYHPAMVPYAPQPAQLVYSAKAQVRDVWSGNLEEELANIAALLPYYPCVCMDTEFPGAVHDSGTPRYLRGPRESYALVKRNVDDLKLLQVGFALSGAAGRCPVAWQFNVRGFDPARDPHAPASVAMLRAQGMDLGTLREFGVRPGDLAAGFYRCGLGCGNLTWAAFAGAYDFAYL

SEQ ID NO: 44959 - DNA, 1321 bp, Panicum virgatum
  misc_feature: Ceres CLONE 2022791
  misc_feature: Encodes the peptide sequence at SEQ ID NO. 44960
aagaaggcggtggagagttcaaaaagaagaagaagaagaaggcgcatcagcagcgcagttactagtagaagcaacgaggcccatcgtcagtggcgcaaggagagcggccgcgcgcgtgtgacttctcccagaaacccccaaaccgccggcgtctcgccttccccttccctcccccggcccacccgagcccccggtccacgcgccgcggagacacacgatggcggtgaccgacgctgcggcgatggccgtcgtgagggcggcgcgcccggcccttcgcggcgcccacgacggcgtcgccttcgccgcccacgccgccttcctcgccgccgggtactcgctctgcaccgtcggccccgccgcgctcgccgaccccccgccctcaggcgaagaggaggtggggatcgatggttggaacagcatggaaaactgctacgcctttttgtatagcaaggaggagaaaagcaagaagaaacgggtgctagtgaaatgtctggtgatcggtgaattacttgccatcgatgtcctcgatcttgaggcacaagataagggcccatataatatccagatcaacgtgaaagatttcttctccgaagagcagcccaagaattatggggatatgtataagaactttgccggcctcattgagactgtgaattcaaatgtgttgtgcaaattgtatgggaaggatgaaggtgcagtagctggtaagaaccctgatgctactgctgagaattctaatgctgaaagcagttcatcaatacacagctctgagaatccagatcctagaactgctgacccttccagcctgatatatcctccaacagctcctcttggtattgatgacctgtacccagggcctggtgcaggcttctaccctcacagtggtattggtggtggcagcatgcatgttggtccaaatgatccacgtttcttcccttcaaatcccttcccttccccatttggtggccctgggagtgttccaccaggtggtcgctatgatccaattggcccgcctggtgtaccagggtttgaaccatcaaactttgttaggcgtccaaggaggcctcctggcgggagcactcacccagacctcgagttcttccagcaaggcccagacttctgagactcagaggccaaactccacctactcccacgaaataacatggctctgtttggcacctcaagctagagagcgctctatatatgtgtgacttcgacttctatatggcagatagttgtgtgttccagacttcgcctgtaaagatggatgtgaacctttctgtatctacccttagctcgaaaccgttcttttctcgcagcc

SEQ ID NO: 44960 - protein, 301 aa, Panicum virgatum
  misc_feature: Ceres CLONE 2022791
  misc_feature (204)..(265): Pfam Name: PI31_Prot_Reg Pfam Description: PI31 proteasome regulator
MAVTDAAAMAVVRAARPALRGAHDGVAFAAHAAFLAAGYSLCTVGPAALADPPPSGEEEVGIDGWNSMENCYAFLYSKEEKSKKKRVLVKCLVIGELLAIDVLDLEAQDKGPYNIQINVKDFFSEEQPKNYGDMYKNFAGLIETVNSNVLCKLYGKDEGAVAGKNPDATAENSNAESSSSIHSSENPDPRTADPSSLIYPPTAPLGIDDLYPGPGAGFYPHSGIGGGSMHVGPNDPRFFPSNPFPSPFGGPGSVPPGGRYDPIGPPGVPGFEPSNFVRRPRRPPGGSTHPDLEFFQQGPDF

SEQ ID NO: 44961 - DNA, 585 bp, Panicum virgatum
  misc_feature: Ceres CLONE 2022823
  misc_feature: Encodes the peptide sequence at SEQ ID NO. 44962
aattttagcaacactcctgcttgggtcttcttctcgatctctgctggatgctccgcgagttcagatatgctagctgcagagaggcatcatcatatatagcatcagagatttgaggagtagcttttctcttccatctgcagatctatatcgacatatatcatatatggaggactcaagcaccttcctccagtgggcaatggaccagctgcaccatcagcacccctctgccgccgccgcttctgcataccacgacggcgccagagatggggaagttatcttcccgtcgctccatgcgctccgcagcggagccgaccagacccactcccagtcccagcccgtggccgccagcgtccgagtccgcgacctgacagtgcaggtggaccacttgaccaacagctctagctccggcgacagcccgggcgcaggcggcgctgccatggaccacgacgcggccgccgggtggtccccccacaccgcccgctccaggactaccggccttggcggcggcggcaacagctggcccgtgagctggaacttcagcgccgtgtcagcggagccagcacgcgagagcggaggggggcgtcg

SEQ ID NO: 44962 - protein, 140 aa, Panicum virgatum
  misc_feature: Ceres CLONE 2022823
  misc_feature: The sequence is a functional homolog of SEQ ID NO 1272 in the 10/666,642 US patent application
  misc_feature: The sequence is a functional homolog of SEQ ID NO 1701 in the 10/374,780 US patent application
MEDSSTFLQWAMDQLHHQHPSAAAASAYHDGARDGEVIFPSLHALRSGADQTHSQSQPVAASVRVRDLTVQVDHLTNSSSSGDSPGAGGAAMDHDAAAGWSPHTARSRTTGLGGGGNSWPVSWNFSAVSAEPARESGGGR

SEQ ID NO: 44963 - DNA, 659 bp, Panicum virgatum
  misc_feature: Ceres CLONE 2022845
  misc_feature: Encodes the peptide sequence at SEQ ID NO. 44964
atcatctcaagcaagtaatacaccatgcaagaagtcgcagcactcgtagttgataatggatctggaatgtgtaaagcaggatttgctggagatgatgctccaagagctgtctttccatctattgttggacgtccaagacacaagggagttatggttggtatgggacaaaaggactcatatgtcggagatgaagctcaatccaaaagaggaatcttaactctcaaatatcctattgaacacggaattgttactaactgggatgatatggaaaagatctggcatcacaccttctacaatgagctccgtgttgctccagaagaacacccagtccttcttactgaagcaccaatgaacccaaaggcaaacagagaaaaaatgactcaaattatgtttgaaaccttcaacaccccagcaatgtatgttgctattcaagctgtcctctccctctatgcttccggaagaaccaccggaatcgtccttgatatcggagatggtgtctgccacactgtcccaatttatgaaggttatgctctccctcatgctatcatgagactcgatcttgctggacgtgatcttactgattacatgatgaaaattttgactgaacgaggatatgctttcaccactactgctgaaagagaaattgtcagagatatcaa

SEQ ID NO: 44964 - protein, 211 aa, Panicum virgatum
  misc_feature: Ceres CLONE 2022845
  misc_feature (1)..(211): Pfam Name: Actin Pfam Description: Actin
  misc_feature: SWISSPROT Homolog: EC 2.7.10.2 Non-specific protein-tyrosine kinase
  misc_feature: Functional homolog of the protein sequence given in SEQ ID NO 50711
  misc_feature: Useful for making plants with modulated biomass
  misc_feature: Useful for making plants with modulated flowering time
MQEVAALVVDNGSGMCKAGFAGDDAPRAVFPSIVGRPRHKGVMVGMGQKDSYVGDEAQSKRGILTLKYPIEHGIVTNWDDMEKIWHHTFYNELRVAPEEHPVLLTEAPMNPKANREKMTQIMFETFNTPAMYVAIQAVLSLYASGRTTGIVLDIGDGVCHTVPIYEGYALPHAIMRLDLAGRDLTDYMMKILTERGYAFTTTAEREIVRDI

SEQ ID NO: 44965 - DNA, 726 bp, Panicum virgatum
  misc_feature: Ceres CLONE 2022851
  misc_feature: Encodes the peptide sequence at SEQ ID NO. 44966
tttctggaggcttcctgggggtgcgtggagacagagggagagggggaagaacgaagaagaacaggcgccatccgcttgcttccttccccttctctccctcccccaccgccggcgcctctttccgcgggtcctcgccgacagggcatcgcgtcgctgtacccgtgagtgcgtgccggaggaatttgacttctccggcgacaacggcatggatgccggggcagagaagtgccgcgacgccgcggcggcggccggggaggccggcagcgacctctacgcggtccttgggctcaagaaggagtgctccgacaccgagctgaaggtcgcctaccggaagctcgccatgagatggcacccagacaaatgctcctcctccagcagcgtgaagcacctgcaggaagccaaggagaagttccaagagatccagagcgcctattccgtcctctccgacgctaacaagcggttcctctacgacgtgggtgtatatgacaatgaggccgacgaggacagtctgcagggaatgggggacttcattggtgagatggcccagatgatgagccaggcgcgtccgacgaggcaggaaagctttgaggagctgcaacagctgttcgtggacatgttccagtccgatcttgattcaggattctgcaatgggcctgccaagggccatcaggtgcatgggcaagcccaaagtagaacatccttcacctcgccttcatcatcaccatc

SEQ ID NO: 44966 - protein, 173 aa, Panicum virgatum
  misc_feature: Ceres CLONE 2022851
  misc_feature (21)..(89): Pfam Name: DnaJ Pfam Description: DnaJ domain
MDAGAEKCRDAAAAAGEAGSDLYAVLGLKKECSDTELKVAYRKLAMRWHPDKCSSSSSVKHLQEAKEKFQEIQSAYSVLSDANKRFLYDVGVYDNEADEDSLQGMGDFIGEMAQMMSQARPTRQESFEELQQLFVDMFQSDLDSGFCNGPAKGHQVHGQAQSRTSFTSPSSSP

SEQ ID NO: 44967 - DNA, 937 bp, Panicum virgatum
  misc_feature: Ceres CLONE 2022853
  misc_feature: Encodes the peptide sequence at SEQ ID NO. 44968
aacaaacgctaaaaaagtaacagtttctgtactttattgcttcgcccagcatggctgtcggaaagaaccctcgcgtctccaagggcggtcgccgtggcgccaagaagaagattcaggagcccatgacccgcaaggagtggtacgacgtggttgcgcccaacaccttcaagaaccgccagttcgcgaagacgatctgcaacaagactcagggtcttaagatcgccgccgagaacctccgcggccgtgtgtacgaggtcaaccaggctgacctcgacggcgcgcacaacaaggaccaggctttccgcaagcccaagttcgaggtccaggaggtcgatggccgcaacctgctcacccagttccactcgctgtcgctgacgaccgacaaggtccgctcgatgctccgcaagtggtgcacgctcatcgaggcgcccgtggaggccaagaccgccgacggctacgttctccgcctgttcgtgacgtgcttcaccaagaagcagcccggccagctgtcgaagaactgctattcgaagacccgccttgagaagtgggtgcgccaccgcatggccaagatcatccagaagaagctcgagaagatcgacatcaaccagacggtgaccctgctgaccaacgacgtgctcgttgatgccctccacaagcgctgcaacgcgattctccccctccgtgacgtcaagttctcgaaggtgaaggtgatccgcacgcccaagctggacatccagaagatccgcgacgcgcacgagccgatccccgagtcgatcgaggccaacccgcgtgtggtgtcggaggccgccgagcccgctgttgccgccgaggaggagaagaaggccgagtaaaaccccaagggcgccttaccagcgctcgtaactaatggatggcagcgcggctgggcgtgccattcaaaaaagacccctcacagtcc

SEQ ID NO: 44968 - protein, 266 aa, Panicum virgatum
  misc_feature: Ceres CLONE 2022853
  misc_feature (12)..(225): Pfam Name: Ribosomal_S3Ae Pfam Description: Ribosomal S3Ae family
MAVGKNPRVSKGGRRGAKKKIQEPMTRKEWYDVVAPNTFKNRQFAKTICNKTQGLKIAAENLRGRVYEVNQADLDGAHNKDQAFRKPKFEVQEVDGRNLLTQFHSLSLTTDKVRSMLRKWCTLIEAPVEAKTADGYVLRLFVTCFTKKQPGQLSKNCYSKTRLEKWVRHRMAKIIQKKLEKIDINQTVTLLTNDVLVDALHKRCNAILPLRDVKFSKVKVIRTPKLDIQKIRDAHEPIPESIEANPRVVSEAAEPAVAAEEEKKAE

SEQ ID NO: 44969 - DNA, 932 bp, Panicum virgatum
  misc_feature: Ceres CLONE 2022860
  misc_feature: Encodes the peptide sequence at SEQ ID NO. 44970
acatcaaaacgtacacacaactctcaagctcctccagctaatcagactcttcgaaacttaatacaatcagagtccacccgtcaaaatggctgacagatttccctcgctggatgattttgactctggtgcccagactgatgtcaaggacacctctgatgttccctctgcgtccaactttctggagcgagagaaggcgattctaggcgacgatgccacccagtttgcgacagtcgaggatgccgagttcgacgagggtgacgacgatttgctaggtgggggcggcggcgttagctcccccggcaacaacgctgcgttcgagagccagttccccgaccttagcagccctaacgagggcgtcgcaccgggcggtaccatcacaggcggcccctccgtcagctacaactcgggttaccagccgcacgccgaggatgaggaggagcccgaggtcatcaaggagtggcgcgagaagcgggacgcgcagattgcgaagcgtgccgagcagttcgcccagcagcgcgaggagacggtccgggaagcccagcagaacatcgacgacttctacgagaactacaacaacaagaaggagaagacgattgcgcaaacccgcaaggacgccgagcaatttctagccaaccgtgaggacaccacctcgggtggcacgagctgggagcgcatcgcgaagctggttgacgtgagcgggaagggcgccaagggtggtgcggctgggtcgggcaaggagcggttccgcgagctccttgtgagccttcggaaggacgagaaggcgccaggtgctggtggttattagagatgctggacacacagtgactggcgacagcagggtggcgggggtcgctcacagatcgggttccctctgccacaacccatggcaatgacaattacagaaaactgcgtttaatgtacttctagacggt

SEQ ID NO: 44970 - protein, 239 aa, Panicum virgatum
  misc_feature: Ceres CLONE 2022860
  misc_feature (1)..(236): Pfam Name: Clathrin_lg_ch Pfam Description: Clathrin light chain
MADRFPSLDDFDSGAQTDVKDTSDVPSASNFLEREKAILGDDATQFATVEDAEFDEGDDDLLGGGGGVSSPGNNAAFESQFPDLSSPNEGVAPGGTITGGPSVSYNSGYQPHAEDEEEPEVIKEWREKRDAQIAKRAEQFAQQREETVREAQQNIDDFYENYNNKKEKTIAQTRKDAEQFLANREDTTSGGTSWERIAKLVDVSGKGAKGGAAGSGKERFRELLVSLRKDEKAPGAGGY

SEQ ID NO: 44971 - DNA, 995 bp, Panicum virgatum
  misc_feature: Ceres CLONE 2022865
  misc_feature: Encodes the peptide sequence at SEQ ID NO. 44972
accaggtaagcaacgcgcgtcgcaaagcacagcgagtaatcatcaaccaacagctccgacgatctcaaacgttctcggtcaggcctcaacgtttcagttcctagatcccagtagcgcaatggcagctgctccgttcgcgatcgccagccgcctctccccggccgcgcgcctccctgtccgcgcatggagggcggcgaggccggcgcccgggctggtgtcgtccgggagggcccgctccctctccgtggcgtccgcggcgcaggaggacaggaacaacgccgtcgacgtccaggtcagccagaacggcggcaaccggcagcagggcaacgccgtccagcgccgcccgcgccgcgcggcgccactcgacatctccccgttcgggctagttgatccgatgtccccgatgcggacgatgcggcagatgctggacacggtggaccggctgttcgacgacgctgtgggattccccatggcgacgcggaggtccccggcggcaggcggcggcgaggtgcgcctgccgtgggacatcgtggaggacaagaaggaggtgaagatgcggttcgacatgccggggctggcgcgtgacgaggtgaaggtgatggtggaggacgacacgctggtgatccgcggcgagcacaaggaggaggagggcgcggaaggcgccggtggggacgggtggtggaaggagcgcagcgtgagctcgtacgacatgcggctggcgctgccggacgagtgcgacaagagcaaggtgcgcgccgagctcaagaacggcgtgctcctcgtcaccttgcccaagaccgaggtggagcgcaaggtcatcgacgtgcacgtccagtagcgttttttcagctcatcaagggatgagatgctcttctgtatgtagcgtgcatctcactcatccagctttctctccgcgcgcgagcagattgtgtgttgtgtgtaaatgctgctcgcaatcaaaggaggagaataatgtgaataaaactttttaactc

SEQ ID NO: 44972 - protein, 239 aa, Panicum virgatum
  misc_feature: Ceres CLONE 2022865
  misc_feature (136)..(239): Pfam Name: HSP20 Pfam Description: Hsp20/alpha crystallin family
  misc_feature: Functional homolog of the protein sequence given in SEQ ID NO 51699
  misc_feature: Useful for making plants with modulated heat sensitivity
MAAAPFAIASRLSPAARLPVRAWRAARPAPGLVSSGRARSLSVASAAQEDRNNAVDVQVSQNGGNRQQGNAVQRRPRRAAPLDISPFGLVDPMSPMRTMRQMLDTVDRLFDDAVGFPMATRRSPAAGGGEVRLPWDIVEDKKEVKMRFDMPGLARDEVKVMVEDDTLVIRGEHKEEEGAEGAGGDGWWKERSVSSYDMRLALPDECDKSKVRAELKNGVLLVTLPKTEVERKVIDVHVQ

SEQ ID NO: 44973 - DNA, 1172 bp, Panicum virgatum
  misc_feature: Ceres CLONE 2022870
  misc_feature: Encodes the peptide sequence at SEQ ID NO. 44974
ctccggccccctctccagtcccccaccacctcaccgccggcttcgcccccaaaaccctcgcggctcgcgccggcagccgcctccccgccggccccgccgcgccatgcccgtcgacgcctgattcatgtctcagccccacgctgcccctgccgcctcgaagcgccccttctcgtccaccaccgcatccccctccccgacctcctcccccgcgccgtcgctcatgaagaaggccaagcaccccgctgcctcctcatcctctgcggggactaccgagaagaacggcatccaccttgatgccgccgccgccgcgagcggggggcgaacgaacggcgaggaggacacggagatggcgctcgcggaccaggacgagctccccacgcccagcgccccgggctccgcgggtgtcgccgctaacctcttccggaagaaggccacgctcccgcagccgtcgacctcgtcccgcaagcccctccgcatcaaaataggtcaaccgaaactgccaaaaaacttcgaggaagatacatgggcgattttgaaggatgctattacagctatttttctcaagaagaagctttcatgtgatgttgagaaactctatcaggctgctggtgatctttgtctacacaagctaggagcaagcctatatgaacgaatcaagaaagaatgtgaaatacacatagccgagaaaatatcagcattagtgggtcaaagcccagatttggttgtatttttgtctctgatccaaagaacatggcaagatttttgcgatcagatgttgattattcgtggtattgctctacttcttgacgtaaaatatgtcaagaatgttgcaaatatttgttctgtgtgggatatggggttgcagctgttccgcaagcatctatcactgtctccggagattgaacacaaaactgtaactggccttctcagattgattgagagtgagaggcttggtgaagcaatagataggacattacttagccatcttctgaagatgtttactgctcttggaatgtattctgagagttttgaaaagcccttccttgaatgcacttctgaattttatgctacggaaggtgttaaatatatgcaacaatctgatattccagactacctgaaacatgtggagtcgaggttgcaagaagaacatgaaaggtgtattttatatttgg

SEQ ID NO: 44974 - protein, 317 aa, Panicum virgatum
  misc_feature: Ceres CLONE 2022870
  misc_feature (102)..(317): Pfam Name: Cullin Pfam Description: Cullin family
MKKAKHPAASSSSAGTTEKNGIHLDAAAAASGGRTNGEEDTEMALADQDELPTPSAPGSAGVAANLFRKKATLPQPSTSSRKPLRIKIGQPKLPKNFEEDTWAILKDAITAIFLKKKLSCDVEKLYQAAGDLCLHKLGASLYERIKKECEIHIAEKISALVGQSPDLVVFLSLIQRTWQDFCDQMLIIRGIALLLDVKYVKNVANICSVWDMGLQLFRKHLSLSPEIEHKTVTGLLRLIESERLGEAIDRTLLSHLLKMFTALGMYSESFEKPFLECTSEFYATEGVKYMQQSDIPDYLKHVESRLQEEHERCILYL

SEQ ID NO: 44975 - DNA, 918 bp, Panicum virgatum
  misc_feature: Ceres CLONE 2022886
  misc_feature: Encodes the peptide sequence at SEQ ID NO. 44976
aatttcacgcccgccaacccacgttcgtcgtcgaaaccgtcactcaccacccaagtcgccgagatggttcgatacgctgccaccgagatccagtcctcgaagtcggcccgcgcccgcggtgcctacctccgagtgtctttcaagaacactcgcgagaccgcccaggccatcaacggctggaagcttcagcgtgctgttaccttcctcgagaacgtcaaggagcacaaggaggccgtccccatgcgacgatatgccggcagcactggccgcaccgcccaaggcaagcagttcggtgtctccaaggctcgatggcccgtcaagtccgccgagttcctcctcggtctcctcaagaacgctgaggccaacgctgatgccaagggtctcgacaccggtgccctgattgtcaagcacatccaggtcaaccaggcccctaagcagcgacgaaggacataccgtgcccacggtcgtatcaacccctacatgtccaacccctgccacatcgagctcatcctgaccgagggtgaggaggttgtccagaagtccgatgctgttgtcgagcgcgagcacctcagctcgcgccagcgcggtgcccgtctccgcaaggctatcaccgccgcttaaacaatcaccaacctctatcaaatagacaaaatttaagcgctggttgaaaactgggtttacgtcgggcatcttctgtgctgtaactgtgtgacttttgacaagactcttgaacaaagggacactacaccaagattacattacaaaactcgatcaattgttctagggtttttgcgagggtggttcgtggcttttcatcaactggtgtatggcaggctacggtgagcatggcattaaagggaaattcatgcaaaagttcgcaaggttttcttgacgaaataaaatcattcaagtcctccc

SEQ ID NO: 44976 - protein, 185 aa, Panicum virgatum
  misc_feature: Ceres CLONE 2022886
  misc_feature (17)..(152): Pfam Name: Ribosomal_L22 Pfam Description: Ribosomal protein L22p/L17e
MVRYAATEIQSSKSARARGAYLRVSFKNTRETAQAINGWKLQRAVTFLENVKEHKEAVPMRRYAGSTGRTAQGKQFGVSKARWPVKSAEFLLGLLKNAEANADAKGLDTGALIVKHIQVNQAPKQRRRTYRAHGRINPYMSNPCHIELILTEGEEVVQKSDAVVEREHLSSRQRGARLRKAITAA

SEQ ID NO: 44977 - DNA, 598 bp, Panicum virgatum
  misc_feature: Ceres CLONE 2022898
  misc_feature: Encodes the peptide sequence at SEQ ID NO. 44978
gcccatctagaccgtcggcggcgaactctctccctccaggtctccattgacaaccacaaccaacgtaatgatggagctcaagtccagggccgccgcgtgcgcgctcctgctcgtgctgctcgtcctcccccacgacggaggaggcggcggcaacgtcagggccggcggcggggtggaggcggcggaggcgcgcgtgtgcacggggaagagccaacaccgctccttcccctgcatctccgaccgcctctgcacccgcaactgcgtcaacgagggcggcggctggaccgccggctactgccaccggaggttctgcacctgccagaaggcctgctgatcgccggccggccggctggacggcggcgatcgatcgatcggtcagctcgtccgctccggccttccgacaagctagcttcgcttcgccgcacgtgcgctgcgctctgctttgacagtgcaaaatcatgcacacgcatggcgcatgtcgcgatgtaataatgatatgatatactactactgcaataataagagcaggacgggcggcgcacaagtgtgtcaacacgtgtgaccaaatgttctacccatcaaaataaattattttcag

SEQ ID NO: 44978 - protein, 87 aa, Panicum virgatum
  misc_feature: Ceres CLONE 2022898
  misc_feature (41)..(87): Pfam Name: Gamma-thionin Pfam Description: Gamma-thionin family
MELKSRAAACALLLVLLVLPHDGGGGGNVRAGGGVEAAEARVCTGKSQHRSFPCISDRLCTRNCVNEGGGWTAGYCHRRFCTCQKAC

SEQ ID NO: 44979 - DNA, 584 bp, Panicum virgatum
  misc_feature: Ceres CLONE 2022899
  misc_feature: Encodes the peptide sequence at SEQ ID NO. 44980
aggagaccggcgcggcggcaagaggaagagaggagctgccgagcgagcagagtgaaggaggaggaaaagaagaagatcagtcgatcacagccagcacccacccgcaccactcgcctgccagccgccaccaccaaacaccaatcccccccgagccagcgcggatccagcgatcctgccgccgccgagccccgccatggccgccacgctcagggccgcgccgccgtccccggccaccgccaggcccgcggagaccttcgccaagtcggtgctggcgtcgcgggtcgcggcacgcggcggcgtcggggcggcggcggccgggaggaaggcgcgcggcgtggcggtccgggcgtcgctgttctcgcccaagcccgcggcggccaaggacgcgcggccgtccaaggtgcaggagctctacgtgtacgagatcaacgagcgcgaccgcgagagccccgcgtacctccgcctcagcgccaagcagacggagaacgcgctgggcgacctcgtgcccttcaccaacaaggtgtacaacgggagcctggacaagcggctgggcatcacggcgggcatctgcgtgctgatccagc

SEQ ID NO: 44980 - protein, 130 aa, Panicum virgatum
  misc_feature: Ceres CLONE 2022899
  misc_feature: SWISSPROT Homolog: EC 5.3.99.6 Allene-oxide cyclase
MAATLRAAPPSPATARPAETFAKSVLASRVAARGGVGAAAAGRKARGVAVRASLFSPKPAAAKDARPSKVQELYVYEINERDRESPAYLRLSAKQTENALGDLVPFTNKVYNGSLDKRLGITAGICVLIQ

SEQ ID NO: 44981 - DNA, 637 bp, Panicum virgatum
  misc_feature: Ceres CLONE 2022899-R
  misc_feature: Encodes the peptide sequence at SEQ ID NO. 44982
tcgcgacggcgagcatggactggaaggagacgccgacggcgcacgtgttcatggcggacctccccggggtgcgccgcgacgaggtgaaggtggaggtggaggaggagaaggtgctcaagatcagcgggcagcggcagcgcgccgccgaggacaagggcgaccggtggcaccgcgtcgagcggagctccgagcgcttcgtgcgcaccgtgcggctgccgcccaacgccaacaccgacaccgtccacgccacgctcgagaacggcgtgctcaccgtcaccgtgcccaaggacaacgaacgcaaggcctacggccgcctcatccccatcgccaactagctctctcgaccgattgataactcgacccatcaatcggcgatatggattattcatgatcactacttaccataatacagtacatgatagcgtccgatcaaaatatgtgtgtgtgtgtgtgtctcagtgttgaagcatgcctatgttcttgcttggttgaccaagtggtagtaaaagcacatctagatatgtatgcatacgtagagaggatcaataataaatgacttgcactgttgcatggtatggatgcatatggtgctcgtcaccacttcatccaacttgcatggtgaaagtcttttgtggcg

SEQ ID NO: 44982 - protein, 110 aa, Panicum virgatum
  misc_feature: Ceres CLONE 2022899-R
  misc_feature (6)..(109): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
ATASMDWKETPTAHVFMADLPGVRRDEVKVEVEEEKVLKISGQRQRAAEDKGDRWHRVERSSERFVRTVRLPPNANTDTVHATLENGVLTVTVPKDNERKAYGRLIPIAN

SEQ ID NO: 44983 - DNA, 1432 bp, Panicum virgatum
  misc_feature: Ceres CLONE 2022900
  misc_feature: Encodes the peptide sequence at SEQ ID NO. 44984
agtcgcccgcgcgcatcggcgcatgctccggcttgggcttacccgtctaggtttagctccgtcccccttccgcgccgcggttcttgctgctggtttcgtcggcgcgcgagagaagatcgatctccttgtgatttgatctgatcggatcggatcggatcggtcgcgggttaagctagcgtcgtcttcggttccggcgtctactgctcgtctattagctgccgcgtcgggtcagatgacgaagatggcggtggtgaagaggcggagggatgctagcagcaggcggcggctgagcgccggcgtgagcgtgcggccgcgcgtccaggtggacgcgaaggtcgcgcccgcgccgacgccgctgctccagcggctgctcgcggcgtgccgccgcgcgttccggggcccagggaccgtgccggcgcccgacgacgtcgccctcatcagaggcatcctcgacaagatgggaccagaagacgtgcacctgagcgccgtcaccaaggccgccgccgattccggcgtccagagacggcggcgtccgatcatcacgcgcaccaccatccacgagtgcacaaacttctcgatcgtggtcttcctcctgcccccgggcgcggtcatcccgctgcacgaccacccggggatgacggtgttcagcaagctgctccacggctcgctgcacgtcacctcctacgactgggccgccgccggcgcggactcccatggtcgtccggcggcgaggctggcgaggctggtgctggacgccgacctccgcgcgccgtgcggcgcgctggtgctgttcccggagtccggcgggaacatgcaccggctcgccgcggccacggcgtgcgcggtcctcgacgtgctcggcccgccctactccggcgaccgggactgcacctactaccgggacctcccgtactcccagcaccgcctccttgcccgctgcgaagatgatggtgaggccgccgccggcgacgacgacgtgcgtgccggtgccgccgcgggtgatgatgagcatcgtcggcgtcagggggcgcgccgccgcctggggtggctgctggagacgggcaggcccaaggagctggagatgtacgagctaggttgccgcgcaggggagctgtagctccaatcctagctacagaagcaccggcgggcctgctgacagcagagatcgatcagatggtgcagctagtcgcgcagatgcatgagctacaacctacaagcaattactctacgtgtccttcgtaattcgttggctcgttgccaacagcagcttcagactttcagtgtacgcagcacagacgaccttccggccggtctgcttgtaattacgtgttggaaagattggtatccatcgtgtgcgaacatccggaccgccaatcggttgttgctttgtaggaagtggatcgatgagctctagtcggagtgttttgagtcc

SEQ ID NO: 44984 - protein, 291 aa, Panicum virgatum
  misc_feature: Ceres CLONE 2022900
  misc_feature: SWISSPROT Homolog: EC 1.13.11.19 Cysteamine dioxygenase
MAVVKRRRDASSRRRLSAGVSVRPRVQVDAKVAPAPTPLLQRLLAACRRAFRGPGTVPAPDDVALIRGILDKMGPEDVHLSAVTKAAADSGVQRRRRPIITRTTIHECTNFSIVVFLLPPGAVIPLHDHPGMTVFSKLLHGSLHVTSYDWAAAGADSHGRPAARLARLVLDADLRAPCGALVLFPESGGNMHRLAAATACAVLDVLGPPYSGDRDCTYYRDLPYSQHRLLARCEDDGEAAAGDDDVRAGAAAGDDEHRRRQGARRRLGWLLETGRPKELEMYELGCRAGEL

SEQ ID NO: 44985 - DNA, 695 bp, Panicum virgatum
  misc_feature: Ceres CLONE 2022912
  misc_feature: Encodes the peptide sequence at SEQ ID NO. 44986
gtgatctggcctcccgagcgcggccaaaaaggcgccccaacgccgcgcggcagatcgagcccagctcagcatcagcctcccccggcgagccagcggagccgggagcggtcgtgcctggtgctacgcgccgcgagaatgctgcaccggtgcgggctgctcccgtgcctccgcggcgacagcggcgaggcgggccggctggacccccgcgtcgcggatgagccgggcgccggcgcgtcgtccgccgcgccggccagcaagggcgccggcggggaggccaggcggttcgcgtgggccgagatcgagtccgtcacggcgggcttctcgtcccgcgtcatcggccagggcggcttcggcaccgtgtacctcgcctgcctctcctcctcccgcctcggcgccgtcaaggtgcagcgcagcagcgagcgcctccaccgcgccttccgccaggagctcggcgtgctcctctcgctccgccacccgcacgtcgtgcgcctgctcggctactgcgacgaacgagaggaaggcgtcttggtgttcgagtacgccccgaacggcgacctccacgggaggctccacggccgcggcaagccggcgctcccgtgggcgcgccgcatggcgatcgcgttccaggtcgccatggcgctggagcacctccacgaagcccgcgacccgcccgtgatccacggcgacatcaaggc

SEQ ID NO: 44986 - protein, 186 aa, Panicum virgatum
  misc_feature: Ceres CLONE 2022912
  misc_feature (58)..(185): Pfam Name: Pkinase_Tyr Pfam Description: Protein tyrosine kinase
  misc_feature: SWISSPROT Homolog: EC 2.7.11.1 Non-specific serine/threonine protein kinase
MLHRCGLLPCLRGDSGEAGRLDPRVADEPGAGASSAAPASKGAGGEARRFAWAEIESVTAGFSSRVIGQGGFGTVYLACLSSSRLGAVKVQRSSERLHRAFRQELGVLLSLRHPHVVRLLGYCDEREEGVLVFEYAPNGDLHGRLHGRGKPALPWARRMAIAFQVAMALEHLHEARDPPVIHGDIK

SEQ ID NO: 44987 - DNA, 664 bp, Panicum virgatum
  misc_feature: Ceres CLONE 2022916
  misc_feature: Encodes the peptide sequence at SEQ ID NO. 44988
aaggcacaagctagtagcgaagagatctatctgttgcatacatagcttacggcgagtaaactcctcattctcatctgagcttacagtaggaggatggccggaggaggcgggcggcttgcgctggtggcggcgctgctgtgcgcggcggcggccatggccgcggcgcagcaggcgtccggcgtgcgcgcgacctacaactactaccgcccgcagaacatcaactgggacctgaacgccgccagcgtgtactgcgccacctgggacgccggcaagtcgctcgcgtggcgcagccggtacggctggacagccttctgcgggcccgccggccccaccggccaggcctcgtgcgggcagtgcctccaggtgacgaactcggcgacgggggcatcgacgacggtgagaatagtagaccagtgcagcaacggcgggctggacctggactacgacacggcgtttagcaagatcgacaccgacgggtcgggcgtccgggacggccacctcaccgtcagctaccagttcgtcaactgcggcgacgacaactgaaactgatgacgactactccatcaccagtactagcagcagcagctgctgctgcacgtacgtacaggattatattatgtaaccccacatggcgaaattatacttgaaggatgcatgaataagt

SEQ ID NO: 44988 - protein, 149 aa, Panicum virgatum
  misc_feature: Ceres CLONE 2022916
  misc_feature (26)..(145): Pfam Name: Barwin Pfam Description: Barwin family
MAGGGGRLALVAALLCAAAAMAAAQQASGVRATYNYYRPQNINWDLNAASVYCATWDAGKSLAWRSRYGWTAFCGPAGPTGQASCGQCLQVTNSATGASTTVRIVDQCSNGGLDLDYDTAFSKIDTDGSGVRDGHLTVSYQFVNCGDDN

SEQ ID NO: 44989 - DNA, 675 bp, Panicum virgatum
  misc_feature: Ceres CLONE 2022921
  misc_feature: Encodes the peptide sequence at SEQ ID NO. 44990
atcagctcgtatctctcatctctccatccaccaccaacaaccacaccgaattaaccacacactgcagcttgcaacagctaccaattctagatcagggacagctttgctccgctaaccagatcatcaggaagcgatggagatgtacatggacggcaagcagtgggcgaagctgtcttcgagctcgaagaaagggagccggaggtcggcggcggtggcgccggcggccgacgaggggagcccgaggggcgtcagagcccgggcggcgtcgaggggcccggcggccaggtcgtcggcgtcacggcggctggccagcatggtgagggagcagcgggcgcggttctacatcatgcgccgctgcgtcaccatgctcgtgtgctggaaggactagctgctgctgctgctgcttctgggcttctggctgacaccgcctgaaggttgtgggcttgtaggcccgggcccggcccatcaggagctctacagaagccacgggccctgctgggcccagcccaacctgagggagagagatgtgccgatgtttgctgtggccatcctgtggttcctggtagtgtttctagtgtgccaacaaattatagcttggatgtaattgctgcctgaagcgcagctagcattgttgtaaaaacgctaagccattgttactgctactccccttttctc

SEQ ID NO: 44990 - protein, 84 aa, Panicum virgatum
  misc_feature: Ceres CLONE 2022921
  misc_feature (63)..(81): Pfam Name: DVL Pfam Description: DVL family
MEMYMDGKQWAKLSSSSKKGSRRSAAVAPAADEGSPRGVRARAASRGPAARSSASRRLASMVREQRARFYIMRRCVTMLVCWKD

SEQ ID NO: 44991 - DNA, 674 bp, Panicum virgatum
  misc_feature: Ceres CLONE 2022936
  misc_feature: Encodes the peptide sequence at SEQ ID NO. 44992
gaagacgtaacacaaattcgcgactgccaacggaagaacaattcattctagagaggacatgggaactttatgaaagaaaggaattagttggactgatagatacgtcactaaacggggaattcgatgccgagcaggcctgcaagtttctgaagattggccttctttgcactcaggaatctccaaagcgccggccatccatgtcttctgtggtcaagatgcttactggagaaatggaaatcgacgacagtatgatgacaaaacctgccttaatttctgatcttatggatctcaaagttagtcataaacaagaaagtataattgatatgaagacttcctacataacatcctctgcctcagagcatgaggacactaccattacatcagcagcaactacaaccttttacaatgctctttatctttaaattaaaattcttaaattcatttccttaggcttatatctcatgtaaatttatgtgagttttttttttttttatatattttggttgtaaggcttcatgactagggagtgctaaaaagccttcggatgtgtatttccggatgggataacaactgcatttttgtccggaaatacacatcttaatggctcaaaaactgcgtttttttccggatgtgtacatctgaagtagttttggaggtgagaaaagttcctacag

SEQ ID NO: 44992 - protein, 139 aa, Panicum virgatum
  misc_feature: Ceres CLONE 2022936
  misc_feature: SWISSPROT Homolog: EC 2.7.11.1 Non-specific serine/threonine protein kinase
RRNTNSRLPTEEQFILERTWELYERKELVGLIDTSLNGEFDAEQACKFLKIGLLCTQESPKRRPSMSSVVKMLTGEMEIDDSMMTKPALISDLMDLKVSHKQESIIDMKTSYITSSASEHEDTTITSAATTTFYNALYL

SEQ ID NO: 44993 - DNA, 659 bp, Panicum virgatum
  misc_feature: Ceres CLONE 2022965
  misc_feature: Encodes the peptide sequence at SEQ ID NO. 44994
ggatggtcaaacccgtgagcacgcccttcttgctttcaccttgggtgtccgtcaattgattgttgctatcaacaagatggataccaccaagtggtctcaagatcgttacaacgaaattgtcaaggaagtttccggtttcatcaagaagatcggtttcaaccccaagtctgttcctttcgttcccatttctggctggcacggtgataacatgttggatgaatccaccaacatgccctggttcaagggatggaacaaggagaccaaggccggttccaagactggtaagactctcctcgaagccatcgatgccattgagccccctgtccgtccttctgacaagcctctccgtcttcctcttcaagatgtctacaagattggtggtattggtacagttcccgtcggtcgtgttgaaactggtactatcaaggctggtatggttgtcaacttcgctcccgctgctgtcaccactgaagtcaagtccgttgaaatgcatcacgaaaccctctctgaaggtctccccggtgacaacgttggtttcaacgtcaagaacgtctccgtcaaggatatccgtcgtggtaacgtctgctccgattccaagaacgatcccgctaaggaatctgcctctttcaccgctcaagttattatcttgaaccatcccg

SEQ ID NO: 44994 - protein, 219 aa, Panicum virgatum
  misc_feature: Ceres CLONE 2022965
  misc_feature (129)..(196): Pfam Name: GTP_EFTU_D2 Pfam Description: Elongation factor Tu domain 2
  misc_feature (1)..(106): Pfam Name: GTP_EFTU Pfam Description: Elongation factor Tu GTP binding domain
  misc_feature: SWISSPROT Homolog: EC 2.7.7.4 Sulfate adenylyltransferase
DGQTREHALLAFTLGVRQLIVAINKMDTTKWSQDRYNEIVKEVSGFIKKIGFNPKSVPFVPISGWHGDNMLDESTNMPWFKGWNKETKAGSKTGKTLLEAIDAIEPPVRPSDKPLRLPLQDVYKIGGIGTVPVGRVETGTIKAGMVVNFAPAAVTTEVKSVEMHHETLSEGLPGDNVGFNVKNVSVKDIRRGNVCSDSKNDPAKESASFTAQVIILNHP

SEQ ID NO: 44995 - DNA, 741 bp, Panicum virgatum
  misc_feature: Ceres CLONE 2022966
  misc_feature: Encodes the peptide sequence at SEQ ID NO. 44996
accatcaccatcaccacttctcgccggagaaccacaaatccaccgcacccaagagagtagaggggagaattcggcggcggacaagatggtgtgcatccggcaggcgaccatcgacgacctgctcgcgatgcaggcgtgcaacctgatgtgcctgccggagaattaccagatgaagtactacctctaccacatgctctcgtggccgcagctcctcttcgtcgccgaggactacggcggccgcatcgtcggctacgtgctcgccaagatggaggaggacccctctgagccctgccacggccacatcacctccctcgccgtcctccgctcccaccgcaagctggggctcgccaccaagctcatgtccgccgcgcaggccgccatggaccaggtcttcggcgccgagtacgtctccctccacgtgcgccggtccaaccgcgccgccttcaacctctacacctccacactcgggtaccagatccacgacatcgaggccaagtactacgccgacggagaggacgcgttcgatatgcgcaagcctctgcggcagccgcagcctaagaagcaccaccatcatcaccaccaccaccaccacggccccggtggatgctgctcccacgacgctcctgcggcggcggctggttcttcaccacagtcttctaattcgccggataagaagtctaacacttgacatggggagtgaatctatggagatgcgttgcggaacccattggataccacact

SEQ ID NO: 44996 - protein, 200 aa, Panicum virgatum
  misc_feature: Ceres CLONE 2022966
  misc_feature (45)..(130): Pfam Name: Acetyltransf_1 Pfam Description: Acetyltransferase (GNAT) family
  misc_feature: SWISSPROT Homolog: EC 2.3.1.88 Peptide alpha-N-acetyltransferase
MVCIRQATIDDLLAMQACNLMCLPENYQMKYYLYHMLSWPQLLFVAEDYGGRIVGYVLAKMEEDPSEPCHGHITSLAVLRSHRKLGLATKLMSAAQAAMDQVFGAEYVSLHVRRSNRAAFNLYTSTLGYQIHDIEAKYYADGEDAFDMRKPLRQPQPKKHHHHHHHHHHGPGGCCSHDAPAAAAGSSPQSSNSPDKKSNT

SEQ ID NO: 44997 - DNA, 525 bp, Panicum virgatum
  misc_feature: Ceres CLONE 2022968
  misc_feature: Encodes the peptide sequence at SEQ ID NO. 44998
gtgctctctcagaggtgggttggcttctcctccccctccagttcggttcggttcgggttcgtgaggttcttggggttccgttcgggggtgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaactaggcccactcccgcggcggcccgcgctccggcggcggcggcggctacgggcgccgcgagggcgggggtggctacgggggcggctgcggctacggtcgcctccagggcgttggcggcttcagcggcggtgggttcagctgcatctccagtggctctgtaagcgactccgccgtgaccac

SEQ ID NO: 44998 - protein, 82 aa, Panicum virgatum
  misc_feature: Ceres CLONE 2022968
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVN

SEQ ID NO: 44999 - DNA, 662 bp, Panicum virgatum
  misc_feature: Ceres CLONE 2022974
  misc_feature: Encodes the peptide sequence at SEQ ID NO. 45000
caggttcatctcctctcctccctctgctaacctttcccttctcttggtctcggactctctcttgcttccccggcggcgacgactgggcgagcggcggcgccatttgtcacgtcttcgccccaccctttgccggcgacgagcatccaccaaggtcaaaagaaagaagaggcggcaagtgctgctggaaaggcccctgttaagaaacagtctgctggggagctacgcctccataaagatattagtgagctcaacctaccgaagactacatcgatttcttttcctaatggcaaggatgatctaatgaattttgagatcatcatccgacctgatgaaggatattatatgggaggcactttcattttcacctttcaagtgtccccatcttatcctcatgagcctccaaaggtcaagtgcaagaccaaggtgtaccatccaaatattgatttggaaggcaatgtatgtctgaacattctgcgtgaagattggaaacctgttcttaacatcaacactgttatttatggcctgaatcttcttttcacgcaaccaaacgacgaggatccattgaaccatgaagctgcagttgtccttcgcgacaacccgaagatgttcgaggcaaatgttaagagggcgatggctggaggctacgtaggccaacactattt

SEQ ID NO: 45000 - protein, 120 aa, Panicum virgatum
  misc_feature: Ceres CLONE 2022974
  misc_feature (1)..(111): Pfam Name: UQ_con Pfam Description: Ubiquitin-conjugating enzyme
  misc_feature: SWISSPROT Homolog: EC 6.3.2.19 Ubiquitin--protein ligase
MNFEIIIRPDEGYYMGGTFIFTFQVSPSYPHEPPKVKCKTKVYHPNIDLEGNVCLNILREDWKPVLNINTVIYGLNLLFTQPNDEDPLNHEAAVVLRDNPKMFEANVKRAMAGGYVGQHY

SEQ ID NO: 45001 - DNA, 688 bp, Panicum virgatum
  misc_feature: Ceres CLONE 2022978
  misc_feature: Encodes the peptide sequence at SEQ ID NO. 45002
aatcttgctcacttgctcacttgctcagttactttccattgttgattgcaagaatgggatttcatcaccttctccttttcatttcagttctctctcttgcacttgcaggagaaagccatgcaccactgcctgaagaagaatattgggaagctgtttggcccaacactcccattcccacttctttgcgagaacttctaaagcctggaccagaaggtgttgaaattggtgacctacccatggaagttgacgacacacaatatccaaaaacttttttctatgaacatgagctttatccaggaaaaacaatgaaagtgcaattcagcaagcgtccctttgcacaaccttttggtgtttatacatggatgcgcgaaattaaagacattgaaaaagaaggatacacatttaatgaggtatgtgtaaagaaagcacctgcagaaggagaacaaaaattttgtgcaaaatccttaggaacattaattggatttgcaatttctaagcttggaaaaaatattcaatcactttcaagttccttcatagataagcatgaacaatacaaaatagagtcagtgcaaaatcttggagagaaagcagttatgtgtcataggttgaatttccaaaaggttgtattttattgtcatgaaattcatggaacaacagcttttatggttccatttggtggcaaatgatg

SEQ ID NO: 45002 - protein, 210 aa, Panicum virgatum
  misc_feature: Ceres CLONE 2022978
  misc_feature (71)..(210): Pfam Name: BURP Pfam Description: BURP domain
MGFHHLLLFISVLSLALAGESHAPLPEEEYWEAVWPNTPIPTSLRELLKPGPEGVEIGDLPMEVDDTQYPKTFFYEHELYPGKTMKVQFSKRPFAQPFGVYTWMREIKDIEKEGYTFNEVCVKKAPAEGEQKFCAKSLGTLIGFAISKLGKNIQSLSSSFIDKHEQYKIESVQNLGEKAVMCHRLNFQKVVFYCHEIHGTTAFMVPFGGK

SEQ ID NO: 45003 - DNA, 1447 bp, Panicum virgatum
  misc_feature: Ceres CLONE 2022988
  misc_feature: Encodes the peptide sequence at SEQ ID NO. 45004
aatcacgcctccgttctccttccccgccgcataccccgccgccgcctcccctcctctgtcctctccccactctcccctgccgcccttccaactcccctccccctgcagtcccccctgcggaggcgacgcgatgcccggccagcaacgcagcagcggcccggcggcgcgactcgcgctacccgcgaggtggaggagtggcctggatgctgcacaacagcggggcgtgccgctgccgagatcgccgcccgtctagcccgcgctgtcgaccaacaggtggggtccgctgcttgccggcgccgtcgctcttggaggcgtcgtacgagcctcgcctccgcattcaccctcgacgccgccacggcctcctcccctcctgctgctcgccttgcgcccgcacggtgccatggtctcttccccctcctgccgcttgccgccgccacgtcctcctccccctcctggatgcttagggcgaaatcgcaggcaggcggccaggggctcatctgcgcctgagcggaattgcaggcaggcggcaggcgggcacatctcttcaccaatgcctatgacggcagcgagccccccacgctgaagggcggcgacgcagtgcgcctcctccctcccccagacgactctccctcaccaatccggcgtccatactccatacgtcagcttcaagtccaccccaaggaaatagtgcaacataatcgatgcattatcttttgcacctaaggctgcaagggatggattggagactgatcgacagatggggctggattttcaggattgctgcttggccctctacaacaacagctggtcctggatgtgcgctggtgaaggtgacggccaggcgatgaagctgagtttggggcaagctgctgcaacagcaacgataacaggaagttttatcaaacccagtgagagaacctatctagaagagatgattcaaacaggaatatccaccattgatgtgatgaactcaattgcacgagggcataaaattcctctcttctctgctgctgggcttccacacaatgagattgctgcttagatatgtcgtcaagctggtcttgtcaaaaggctggagaattctggcaagcacaaggaggctgcagatggatgattggcatacatacacatattgtgttgcctgatggcatcaaatttggggttgtggctcgagctgaggagctaaacgagttctacgatgtaccacgctcaaagttctaaacgagttctatgatgtaccacgatcaaagttatgaagattaaaattctgcaataaaatatatgtatgactgaccagtagctcgagtcttttaggaatgtaaaaattaaagaatgtttgtaggagtccatttacagagtgattgctacagtattggcaaacaaggttaattctttagtagtcgtttcttgtaatgcaattattctttaaatatattttttttatgat

SEQ ID NO: 45004 - protein, 94 aa, Panicum virgatum
  misc_feature: Ceres CLONE 2022988
  misc_feature: SWISSPROT Homolog: EC 3.6.3.14 H(+)-transporting two-sector ATPase
MGLDFQDCCLALYNNSWSWMCAGEGDGQAMKLSLGQAAATATITGSFIKPSERTYLEEMIQTGISTIDVMNSIARGHKIPLFSAAGLPHNEIAA

SEQ ID NO: 45005 - DNA, 700 bp, Panicum virgatum
  misc_feature: Ceres CLONE 2022990
  misc_feature: Encodes the peptide sequence at SEQ ID NO. 45006
accccaatctctgcgccgccgccgttcccgtcgtcctccgccgtcgcggtcgcgccctcgccgtcgcctgccgaccgcgagcttcctcgccactaccggtccaccgggggcggcgccatgtcccagtcccagaacaacaacccctcgcagctcctcccctcagagctgatcgaccggtgcatcgggtccaagatctgggtgatcatgaagggggacaaggagctcgtcggcaccctctgcggcttcgatgtctacgtcaacatggtgctggaggacgtcaccgagtatgaatacacagctgaagggcgtcgcattacaaaacttgaccagatactgctgaacggcaacaacatagccatcttggttcctggtggttcaccacccgatgtgtaacgagcttgtgcttccagagtaacgatttgaggcgaaggcagcttggtgaactctgcaccttgtgttggtcagaagcatcggatgttttctcagctcaaatgtgtttctcctgttcgtgattgtaccgaagtttattagcaagtctgtcaacatggaagctctctcctgtaatgaacttactgatctcagtagaggacttgcgcatgcttatacgattggctatgctaattccgatgctcatcatcgtcgtgctgcaatgtgaatccgagtaatggatttaatgcaatgtgctgagttttatatcggc

SEQ ID NO: 45006 - protein, 91 aa, Panicum virgatum; identical to SEQ ID NO: 14215
  misc_feature: Ceres CLONE 2022990
  misc_feature (16)..(84): Pfam Name: LSM Pfam Description: LSM domain
  misc_feature: Functional homolog of the protein sequence given in SEQ ID NO 50544
  misc_feature: Useful for making plants with modulated cold sensitivity
  misc_feature: Useful for making plants with modulated drought sensitivity

SEQ ID NO: 45007 - DNA, 705 bp, Panicum virgatum
  misc_feature: Ceres CLONE 2023016
  misc_feature: Encodes the peptide sequence at SEQ ID NO. 45008
gtcgccggtgactcggataaagctgcatttgatcctcagagatgatgaacgagtcttttcttgataggatggtttcccagcttcggtcaacatgcaagtactacactggatatcccaaggacctagggccatcaagaattataccattcacatctgagcgtcagtttgtacagctattgcatgaaggaaggcctgtagttgttgcctttactattaagtatagtaactctgctgtattttgttcagaaacaccaactagaatagcaaatcctcatatatgacagcattcactcacttcaatcctgaaaattgcctttttaggtgcacttatacacagcatcttgataaagtactggaagaggctgctgccacattttatccacatatcaagtttgtcagagttgaatgcccaaagtatcctgggttttgcctcacgaggcaaaggaatgaatatccatttgttgaagtattttacaatccagaacaggctgcaagccaaggaaagagtgtggatcctaacatcaccaagtattctgtaaaagtgctacctttcaactatgatcagagcttgtatggatttcgggaatatttcaagaagcatggtttcaagtattctgaaacaaactaattctgtcaataaaaatatgcgatgtgagaacttctagggacttaacatggaggcattcattgtcggagttgaactgt

SEQ ID NO: 45008 - protein, 116 aa, Panicum virgatum
  misc_feature: Ceres CLONE 2023016
  misc_feature: SWISSPROT Homolog: EC 5.3.4.1 Protein disulfide-isomerase
MTAFTHFNPENCLFRCTYTQHLDKVLEEAAATFYPHIKFVRVECPKYPGFCLTRQRNEYPFVEVFYNPEQAASQGKSVDPNITKYSVKVLPFNYDQSLYGFREYFKKHGFKYSETN

SEQ ID NO: 45009 - DNA, 911 bp, Panicum virgatum
  misc_feature: Ceres CLONE 2023020
  misc_feature: Encodes the peptide sequence at SEQ ID NO. 45010
aacttgaacctcgacttggactcgatccacctccaacaacagcacgcaaatcttacgctgtcacggctttcgctttattgacggcacttgccatcgccatggaacagaggcaatagtcgatatagtaatagctttttgcgacacgagttcaacatggcttctagattcgcctcctcctccctccaccagcgcgactcgcgcagcgacctcttcaaaggctacaccggcggcgcctcctccagcagacccgtcagcgccagcccgagcggccgtccacaatatggcgccggcagcagtagcagcggatacggatacggcgggtaccagccgagtgttggcgttggcggcagcagcggaagcagtcacctgggtgtagggatggcgggggagagcaggggagggtttaggcctgctacgccgaatcggaaaggccagtacagcgacgcggtgctcaacgagctcgagagccagaacgagcagcaggtggaggggatcatgggcaaggtcaagctgctgaaggatatgacgatagcaatcggcgacgagatccgcgactcgtcagccctcgccgagaagatgaacgaggggttcgaccagacgcggctgcggatcggcaggaccatgaacaggatgcttgtcatggccgagcggacgggcgtcggctggcgggtgtggctggctttctttttggccgtcatcttcttgtttgtttacgtgtggctgttttgagggggatgacgggctgagaacgctggttagacatgggtcgctttctttgccacgaggctggctggttggctgcatcggcgcttggagtttgggaagcatgtctgatcttgcttggcttggtgggtttgggatacgactgcgggcatgatggactgacacactcgaatgcagtcatgaactag

SEQ ID NO: 45010 - protein, 191 aa, Panicum virgatum
  misc_feature: Ceres CLONE 2023020
  misc_feature (106)..(168): Pfam Name: SNARE Pfam Description: SNARE domain
MASRFASSSLHQRDSRSDLFKGYTGGASSSRPVSASPSGRPQYGAGSSSSGYGYGGYQPSVGVGGSSGSSHLGVGMAGESRGGFRPATPNRKGQYSDAVLNELESQNEQQVEGIMGKVKLLKDMTIAIGDEIRDSSALAEKMNEGFDQTRLRIGRTMNRMLVMAERTGVGWRVWLAFFLAVIFLFVYVWLF

SEQ ID NO: 45011 - DNA, 723 bp, Panicum virgatum
  misc_feature: Ceres CLONE 2023039
  misc_feature: Encodes the peptide sequence at SEQ ID NO. 45012
aaaaaaccccgcccgccgcctcctcgatcccatggcggccatgcagaggctcctccgggcagccgcctccggtggcgcggcggcggcgaggaggcgcatggggtcgctggcggcggagcaggcgcctcccgcggcggcggcgccgaaggggttcccgttcgcggcggaggagaggatgaggcggcgcccggcggcggagcgaaacgtgcagtgggtgttcctgggctgccccggcgtgggcaagggcacctacgcgagccgcctctcgcgcctcctcggcgtgccccacatcgcaacgggggaccttgttcgcgacgagctcgcctccaccgggccacttgctgcgcagcttgctgaaattgttaaccaggggaaattggtttctgatgagattattatcaatctattgtccaaaaggcttaaaaaaggagaagacaagggagaatctggatttattcttgatggttttccacgcacagtaaaacaagcggaaattcttgatggagttacggacatcgatatggtggttaatctaaaactgagggaagatatcttagtagaaaagtgccttggtaggaggatttgcagccagtgcggaaagaacttcaatgtggcttgcattgatgttaagggtgaaaacgggttaccagcaatctacatggcaccattattaccccccaataactgcatgtcgaagatgatcacccgagctgatgatactga

SEQ ID NO: 45012 - protein, 230 aa, Panicum virgatum
  misc_feature: Ceres CLONE 2023039
  misc_feature (63)..(205): Pfam Name: ADK Pfam Description: Adenylate kinase
  misc_feature: SWISSPROT Homolog: EC 2.7.4.3 Adenylate kinase
MAAMQRLLRAAASGGAAAARRRMGSLAAEQAPPAAAAPKGFPFAAEERMRRRPAAERNVQWVFLGCPGVGKGTYASRLSRLLGVPHIATGDLVRDELASTGPLAAQLAEIVNQGKLVSDEIIINLLSKRLKKGEDKGESGFILDGFPRTVKQAEILDGVTDIDMVVNLKLREDILVEKCLGRRICSQCGKNFNVACIDVKGENGLPAIYMAPLLPPNNCMSKMITRADDT

SEQ ID NO: 45013 - DNA, 509 bp, Panicum virgatum
  misc_feature: Ceres CLONE 2023053
  misc_feature: Encodes the peptide sequence at SEQ ID NO. 45014
gctttggcgttttcgcttcgcttgtccccgacgcgcaacgcaattcccaccgatctcaattctcaacacgcacagctggcttctgatcccgcccggcccaacgcgacccaccgaccaggaccccggagcgatggaagcggcggccggcggccggagggaggcggcgctggggggcctcgccgtgctccccgacgaggtgctctgcgccgtcgtcgacctcctccctcccgccgacatcgggcgcctcgcctgcgtcagcagtgtcatgtacatactttgtaatgaagaacctctctggatgagcaaatgtctttcaattgggggtcctcttgaatacaaaggttcttggaagaagacaacattgtccaggcttggcctatgttcagaaaatgatgagaacttgcagaaacctcgtcagtttgatgggttcaattctttatatctatataggagatggtatagatgttttactagtttgagtagtttttcatttgatgatggacatgtgg

SEQ ID NO: 45014 - protein, 126 aa, Panicum virgatum
  misc_feature: Ceres CLONE 2023053
  misc_feature (14)..(61): Pfam Name: F-box Pfam Description: F-box domain
MEAAAGGRREAALGGLAVLPDEVLCAVVDLLPPADIGRLACVSSVMYILCNEEPLWMSKCLSIGGPLEYKGSWKKTTLSRLGLCSENDENLQKPRQFDGFNSLYLYRRWYRCFTSLSSFSFDDGHV

SEQ ID NO: 45015 - DNA, 655 bp, Panicum virgatum
  misc_feature: Ceres CLONE 2023054
  misc_feature: Encodes the peptide sequence at SEQ ID NO. 45016
ggctttgatagttactggctccgcagacaaaaatttgaagatttggggtatggattttggggactgccacaggtccatatttgctcattcagacagcgtgatggatgttaagttcgtgtacagaactcattatatcttcagtgtggggaaagatcgcactgtgaagtactgggatgctgataaatttgagttgttgttgacacttgaaggacatcatgctgaagtttggtgtctcacaatcagcagtcgtggtgactttattgtaacaggttcccatgatcgctctatccggcgttgggaccgtactgaagaacaactgttcattgaggaagagaaggagaaaagattggaagaaaccttcgaggctgatttagacaatgataatgagtatagatatgggcagaaagatgatgctcctgaagaaggttccgttggcgttcctggtaggaaaacaaaagagacagttacttctgctgatgcaattatggatgcacttgacactgctgaggaagaactaaaacgccttaatcagcataaacaggaagagcaaaataatgggacggcagctaaatttcaacctaatgttataatgcaagggcaatcaccctcagattatgttctaaatgtagtttcaagtatccgcccaaatgatctg

SEQ ID NO: 45016 - protein, 217 aa, Panicum virgatum
  misc_feature: Ceres CLONE 2023054
  misc_feature (62)..(100): Pfam Name: WD40 Pfam Description: WD domain, G-beta repeat
  misc_feature (20)..(58): Pfam Name: WD40 Pfam Description: WD domain, G-beta repeat
  misc_feature: SWISSPROT Homolog: EC 2.7.11.7 [Myosin heavy-chain] kinase
ALIVTGSADKNLKIWGMDFGDCHRSIFAHSDSVMDVKFVYRTHYIFSVGKDRTVKYWDADKFELLLTLEGHHAEVWCLTISSRGDFIVTGSHDRSIRRWDRTEEQLFIEEEKEKRLEETFEADLDNDNEYRYGQKDDAPEEGSVGVPGRKTKETVTSADAIMDALDTAEEELKRLNQHKQEEQNNGTAAKFQPNVIMQGQSPSDYVLNVVSSIRPND

SEQ ID NO: 45017 - DNA, 511 bp, Panicum virgatum
  misc_feature: Ceres CLONE 2023056
  misc_feature: Encodes the peptide sequence at SEQ ID NO. 45018
gttcgttcgaccacaaccaaaccaacctccgcgtcttccaaaaccaacacacagccatgtctgactgggagaccggcctctgcgaatgcttctctgacttcccgacctgtctgtcggcctacttctgcggctgcttcgacgttgcgtaccactacgccgccgctgaggaccgcgagtgcggcgtcgttgacggcctcctcgcctactgcttcttcccctgctgcgcctgcattgctcgtggtaagatcagggagaagtacaacatctcgggcagcttcctgggcgacgtcctggccgtgtggtgctgtggctgctgcgccgtctcccagcagtcgagggagctcaagcacaagggtgtcagcaagtactcctgcttctaagtcgaaccttgtctcttccttctcgttattcttcttcttcttcgcccggtcctcctgttcgtccgcttctttgctgtggcgggtgaccgccacaacgagcaacatccaacaatgtaacactcttactcccc

SEQ ID NO: 45018 - protein, 107 aa, Panicum virgatum
  misc_feature: Ceres CLONE 2023056
  misc_feature (4)..(96): Pfam Name: PLAC8 Pfam Description: PLAC8 family
MSDWETGLCECFSDFPTCLSAYFCGCFDVAYHYAAAEDRECGVVDGLLAYCFFPCCACIARGKIREKYNISGSFLGDVLAVWCCGCCAVSQQSRELKHKGVSKYSCF

SEQ ID NO: 45019 - DNA, 715 bp, Panicum virgatum
  misc_feature: Ceres CLONE 2023059
  misc_feature: Encodes the peptide sequence at SEQ ID NO. 45020
actccgtccacctctcaaaaaaaaaaaattccactccgtccatccatccgccatggcaacggccacgctgctgagctcctccttcgccatgcccgccgccgcccggagggcctcctcctcttcctccacctccctgggcttcgccacgtcgcagctcgccggcctctccctctccgccgccgcgcccacttcaaccgccgcggcccccctccacaagaggccgctccagcccatcgtcgcgcgccgggtgtgccccttcactgacaagaagacgaaccgggcgaacaaggtgtccttctccaaccacaagacgaagaagcagcagttcgtgaacctgcagtacaagaagctgtggtgggaggccggcaagcgctacgtcaagctgcgcctctccaccaaggccctcaagaccatcgagaagcacggcctcgacgccgtcgcgcgcaaggccggcatcgacctcaacaagaagtgagccgagcttgagtagtcaagccggtgatggcagtaaggtcaggccgagcaatctcgcgaacagatgccactagctaagtcttcatggtatgggtccgtctcgtctgtctcaatgtctgctgctgctgctgctgctgctcattcagtcatacagtattttttcctttcctccctaatttgatttgcatcctaccaatgtaggcagatcgaggttgcgtatatttttattctatggaaagag

SEQ ID NO: 45020 - protein, 140 aa, Panicum virgatum; identical to SEQ ID NO: 40529
  misc_feature: Ceres CLONE 2023059
  misc_feature (65)..(125): Pfam Name: Ribosomal_L28 Pfam Description: Ribosomal L28 family

SEQ ID NO: 45021 - DNA, 976 bp, Panicum virgatum
  misc_feature: Ceres CLONE 2023076
  misc_feature: Encodes the peptide sequence at SEQ ID NO. 45022
actgccatggcgtcgtccaagctgcagcttccggcggacgacagcgtcctcctgctcgtcacccactccaatctctccaccttcgcggcagacatccgcgtctcgcaacagaccaccgtcgaggcgctcaaggacaagctctggcgcaagaccggcaccgccgtcgcctccatgcgcctccagctccgcgacgacaccggcgccaacctcgccgacctcgatgatgacgccgcgcccctcgcagcctacggcccctacaacggctgccggatccatgtcctcgatctcgatccttcctcactcacctctggtggctggttggaagacacctcccttgttgacaagtacaaaatgtccaatgaagcatacgacaagctccacagtaactggacatcttttttttttttggaactggtcatcttgtttaccaacactggtgttataatttttttgtcagctaactttcgaaaatttaaagaaaagatgaccccgaaaacccccacatcagagtcagaggataataaacaacaattagaaaagcacatggaggaattgtgctccaaaatcaaggtgggagatagatgtgaagttgagccaggtgccaagaggggcactgtcaaattcgttggcagagctgaagctcttggacgtggattctgggttggtgtgcaatatgatgagccacttggaaagcacgatggcatggtgaaaggcattcgcttctttgagtgccctcaaggtcatggggcaattgtgagaccagagaaagtaaaggttggagactacccagagagagacccattcgaagaagaggagatataggcaagcaaggtgtggcgcatttgtttagtaattttcaatgggagggggggtcgttgtggagttgtatttgaaacgcgtgcgaaattgctgctacgatcttgttgatcaatcagactcgattactctagtgttgtagtaagttggtcgttgcacc

SEQ ID NO: 45022 - protein, 271 aa, Panicum virgatum
  misc_feature: Ceres CLONE 2023076
  misc_feature (189)..(256): Pfam Name: CAP_GLY Pfam Description: CAP-Gly domain
MASSKLQLPADDSVLLLVTHSNLSTFAADIRVSQQTTVEALKDKLWRKTGTAVASMRLQLRDDTGANLADLDDDAAPLAAYGPYNGCRIHVLDLDPSSLTSGGWLEDTSLVDKYKMSNEAYDKLHSNWTSFFFLELVILFTNTGVIIFLSANFRKFKEKMTPKTPTSESEDNKQQLEKHMEELCSKIKVGDRCEVEPGAKRGTVKFVGRAEALGRGFWVGVQYDEPLGKHDGMVKGIRFFECPQGHGAIVRPEKVKVGDYPERDPFEEEEI

SEQ ID NO: 45023 - DNA, 708 bp, Panicum virgatum
  misc_feature: Ceres CLONE 2023080
  misc_feature: Encodes the peptide sequence at SEQ ID NO. 45024
atcaccccacatcgttggtagatcttgcagcgttgggtctcacagtcccaagaagctagcagagcaactgagcaagcgatggcgccgccgaaggtgtacggatgggcgatctcgccgttcgtgtcgcgcgcgctgctggcgctcgaggaggccggcgttgactacgagctcgtccccatgagccgccaggacggcgaccaccgccgcccggagcacctcgccagaaacccttttggtcaggtgcccgttcttgaggacggcgacctcacggtcttcgagtcccgggcgatcgcgaggcacgtcttccgcaagcacaagccggagttcctgggcgccggcagcctggagcggtcggcgatggtggacgtgtggctggaggtggaggcgcaccagctgcacccggcggcgggcgccgtcgtggtggagtgcgtcttcgcgccgatcctcggccgcccccgcaaccaggcggccgtcgacgagaacctcgggaagctgcggaaggtgctggaggtgtacgaagcgcggctggcgcagagcaagtacctcgccggcgacttcctcagcgtcgccgacctcagccacttcaccatcatgcactacttcatggccaccgagtacgcggcggtcgtagaggcgctcccgcacgtgagggcgtggtgggaggagctcgccgcgcggccagcggcgaggaaggtggccgggttcatg

SEQ ID NO: 45024 - protein, 209 aa, Panicum virgatum
  misc_feature: Ceres CLONE 2023080
  misc_feature (2)..(77): Pfam Name: GST_N Pfam Description: Glutathione S-transferase, N-terminal domain
  misc_feature (106)..(201): Pfam Name: GST_C Pfam Description: Glutathione S-transferase, C-terminal domain
  misc_feature: SWISSPROT Homolog: EC 2.5.1.18 Glutathione transferase
MAPPKVYGWAISPFVSRALLALEEAGVDYELVPMSRQDGDHRRPEHLARNPFGQVPVLEDGDLTVFESRAIARHVFRKHKPEFLGAGSLERSAMVDVWLEVEAHQLHPAAGAVVVECVFAPILGRPRNQAAVDENLGKLRKVLEVYEARLAQSKYLAGDFLSVADLSHFTIMHYFMATEYAAVVEALPHVRAWWEELAARPAARKVAGF

SEQ ID NO: 45025 - DNA, 724 bp, Panicum virgatum
  misc_feature: Ceres CLONE 2023087
  misc_feature: Encodes the peptide sequence at SEQ ID NO. 45026
atcatcagtcatcttccttgataccggccgttgcctatagctactactatactcccaaagttagagttagagacgatggcaaccacactagccacactacgtgagatccggcgtgcgcagcgtgctgatggcccagcagccatgctcgctattggcaccgcaaatccaacaaactgcgtgcttcaggaggagtttcccgactactattttcgtgtcacaaacaaggagcacctcaccgacctcaaagaaacattcaagaaactatgtcggatcacggggctggagaaacgtttctttcaccacacggaggaagtgctcaacgcccacccgggcttgcttgacgggacgtcctcggccttggacgcgcggctcgacatcgtcgccaaggctgctccagagctcgccgcgtcggccgccgccaaggccatcacgagatggggccgcccggccaccgacatcacccacctcatcgtcagcaccaactccgaagcccgctcaccaggcgcggacctcgggctggccacactcctcggcctccgccccgatgtctgccggaccgtgctccagctcaacggctgcgcggccggctgcaccgcccttcgtctggccaaggacctcgccgagaacaaccgcggcgcacgtgtgctcgtggtctgcgtcgagctcaccatcaccacctttcggcccccccacgaaggggacagctttggcaccctcatcccgc

SEQ ID NO: 45026 - protein, 216 aa, Panicum virgatum
  misc_feature: Ceres CLONE 2023087
  misc_feature (6)..(216): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MATTLATLREIRRAQRADGPAAMLAIGTANPTNCVLQEEFPDYYFRVTNKEHLTDLKETFKKLCRITGLEKRFFHHTEEVLNAHPGLLDGTSSALDARLDIVAKAAPELAASAAAKAITRWGRPATDITHLIVSTNSEARSPGADLGLATLLGLRPDVCRTVLQLNGCAAGCTALRLAKDLAENNRGARVLVVCVELTITTFRPPHEGDSFGTLIP

SEQ ID NO: 45027 - DNA, 664 bp, Panicum virgatum
  misc_feature: Ceres CLONE 2023088
  misc_feature: Encodes the peptide sequence at SEQ ID NO. 45028
ccctgagagaactccaggctttgtgctagatgttctggcacgctcatctctatggaagattggactcgattatagacatggtacaggccatggagttggagcagcactaaatgtacatgagggccctcagagcataagctatcgatacggaaatttgacagccttacagaagagcatgattgtcagcaatgaacctggctattatgaagataattcgtttggcattcgtatcgagaatttacttctaataaaggagcttaatctggcgaattcatttggtggaatttcgtaccttggttttgagagactaacctttgttccaattcagagcaagcttattgatgtgtccttgctttcaccttcggagatcaactgggtcaatgattaccatgaagaagtctgggataaggtttcccctctgctgagtggcgatactcgcgactggctatggaagaacactagacctcttttagatgtaactcatcgatactcccacgcacaggatatagcatgaaaacacagcatggtggggcgcaggagcagcaacagaaagtaagaagtccatagaaattgctggccgcaacatcctttgcggattctatcccctgttatgaaatgcatctcagtagactacatggcagtaacagaggcaatagatatatgc

SEQ ID NO: 45028 - protein, 170 aa, Panicum virgatum
  misc_feature: Ceres CLONE 2023088
PERTPGFVLDVLARSSLWKIGLDYRHGTGHGVGAALNVHEGPQSISYRYGNLTALQKSMIVSNEPGYYEDNSFGIRIENLLLIKELNLANSFGGISYLGFERLTFVPIQSKLIDVSLLSPSEINWVNDYHEEVWDKVSPLLSGDTRDWLWKNTRPLLDVTHRYSHAQDIA

SEQ ID NO: 45029 - DNA, 356 bp, Panicum virgatum
  misc_feature: Ceres CLONE 2023094
  misc_feature: Encodes the peptide sequence at SEQ ID NO. 45030
ctatcagtccacctccgccaccacacgtctcaccacagtcaacatgctccgcttccgagccaccgcttcggccatggcgcggcgggtgtcgtacctgctgctgctgctgctgctgggcgcgctggcatgcggcggcggcggcagcgaccaactcaaaccaggagttcgacatcacctggggcgacggccgcaaaaagatccacgacagaggccgcctcgtcacgctcacccgcgaccgcacctccggctcccgcttccagtccaggcccgaggaccacatcggcaagatcaagaggcaacatcaagttcgtccccggcaactccgccggcacctccaccgcctactacctctcgtc

SEQ ID NO: 45030 - protein, 117 aa, Panicum virgatum
  misc_feature: Ceres CLONE 2023094
  misc_feature: SWISSPROT Homolog: EC 2.4.1.207 Xyloglucan:xyloglucosyl transferase
ISPPPPPHVSPQSTCSASEPPLRPWRGGCRTCCCCCCWARWHAAAAAATNSNQEFDITWGDGRKKIHDRGRLVTLTRDRTSGSRFQSRPEDHIGKIKRQHQVRPRQLRRHLHRLLPL

SEQ ID NO: 45031 - DNA, 475 bp, Panicum virgatum
  misc_feature: Ceres CLONE 2023104
  misc_feature: Encodes the peptide sequence at SEQ ID NO. 45032
atccccatccgcaccagcagcatcgcagcccgcggaccagcacgcgaccctcatgtcccgcttgggggctaaagtagaggcaccatcttctggagagattaaaaattaccgttttagatctgatgtgccatccccaccttctcatactgctgttggaggtccagcttcactccttcctaagcgcaaaccattgactgaacaagagattgaggccatcatgcttggtggctccatctgatatggcctcgcatggattggaaacgtaggaggtatcaataagatcatatacccaaacttgccttgactggaaggggtgttattcaagccatgttgatatggaatttgtttttttttttttgtttctatgtctgggagtcagctgctgtgccattcgtttctaatattctccggtcttcacatgtgacttgaccaaatcgtgagcaggcatgttgatatggagtccggtttttgtttc

SEQ ID NO: 45032 - protein, 78 aa, Panicum virgatum
  misc_feature: Ceres CLONE 2023104
  misc_feature: Functional homolog of the protein sequence given in SEQ ID NO 50812
  misc_feature: Useful for making plants with modulated heat sensitivity
SPSAPAASQPADQHATLMSRLGAKVEAPSSGEIKNYRFRSDVPSPPSHTAVGGPASLLPKRKPLTEQEIEAIMLGGSI

SEQ ID NO: 45033 - DNA, 1032 bp, Panicum virgatum
  misc_feature: Ceres CLONE 2023131
  misc_feature: Encodes the peptide sequence at SEQ ID NO. 45034
gtttccgccgccccagcctctcgtctccggctactcttcccgtgttcccctcctcatctcctccgccccttggcccaccaaggttctcagattcgacgcgacgtctattggcttggctcagctcggtccgcctcggctgtcgacttggatctcggcggcgctcaatccgtctgcactagctactgagccatggcggccgcggactccgaccccgccatcacctcctccacctgcgcgcactgtcagcgggaaattccatctccaaacatcgcattgcacagcgcgcactgtgctcggaaccttcagaagtgcgagcattgcggagatatggttccaaggaagctcatggatgaacactacgatgagagccatgctccaatgaattgttcactgtgcaaatgcacaatagaacgtgagctatgggatcttcatacaagcatacaatgcccgcaaaggatgctcgcatgccaatattgtcagtttgaactacctgcggttgatcttcttgagcatcaggatgtatgtgggaatcggacagaatattgtcaaccttgcaggaagtacatcagacttcgtgaatggattggacatgaactccagttccatacgagctcaaatactgctgcagaactttcaagtgtcggagctcctgaagcagcagagcagccagtaccaaagccagcgcgaccggctgctcatggttcacatcgcaaacatctgctcttgacaattgcaatagctggactagcagttttgattggatcaatactgtaccaaaggaagggacagtagtgctagggaggtacagtcatttgacgtaccttgatgtataaataccctcgtaatcaataatacagtttagaccccagttggggggaacgaaaatggaaagaaaagaaagggacatctgaacttagttgtgaatggaccagatcagacaatgttttgtgctcattgttctcgtagatggtaattttttccatcaaacttgctggcatttggtaatctacaaaaagctatggtctaatttac

SEQ ID NO: 45034 - protein, 200 aa, Panicum virgatum
  misc_feature: Ceres CLONE 2023131
  misc_feature: Functional homolog of the protein sequence given in SEQ ID NO 51700
  misc_feature: Useful for making plants with altered terpenoid content
MAAADSDPAITSSTCAHCQREIPSPNIALHSAHCARNLQKCEHCGDMVPRKLMDEHYDESHAPMNCSLCKCTIERELWDLHTSIQCPQRMLACQYCQFELPAVDLLEHQDVCGNRTEYCQPCRKYIRLREWIGHELQFHTSSNTAAELSSVGAPEAAEQPVPKPARPAAHGSHRKHLLLTIAIAGLAVLIGSILYQRKGQ

SEQ ID NO: 45035 - DNA, 710 bp, Panicum virgatum
  misc_feature: Ceres CLONE 2023138
  misc_feature: Encodes the peptide sequence at SEQ ID NO. 45036
aaatcagcagcgcttccgtttctcctgcaggcggatagcctcagccgggggagccgacggcgatcaccgatggcggtggcggggggcgtggacctccccgtggtggacctcgcgtccccggacccccgcgccgccgccgcctccgtccgccaggcgtgcgtggagcacgggttcttctacgtgaccaaccacggcgtggacggcgccctgatcgaggcggtgttcgcggagagcaaggggttcttcgacctgcccatggaggagaagatgaagctgcagaggcgcaaccaccgggggtacacgccgccctacgccgagaagctcgatgcctcttccgagttcgtaggagacctcaaggagagtttctacattgggcctattggggacagtgatttgcagaatgatctaaaccaatggccttgtgaagagtgttttccatcttggaaggagacaatgaagttgtacattgcaacggttctggataccggcaaaaggatactctctctaattgctttgggtttggatttggatgctgaattttttcacaaaattggtgcattggactgcccgtcaacatttcttcggttactgcattacccaggtgaagtaaacgagtctgatagtggaaactatggtgcatcagcccactcagactatggtgcactaacccttttagtaacggatggcactccctggcctgcagatatgca

SEQ ID NO: 45036 - protein, 213 aa, Panicum virgatum
  misc_feature: Ceres CLONE 2023138
  misc_feature: SWISSPROT Homolog: EC 1.14.11.19 Leucocyanidin oxygenase
MAVAGGVDLPVVDLASPDPRAAAASVRQACVEHGFFYVTNHGVDGALIEAVFAESKGFFDLPMEEKMKLQRRNHRGYTPPYAEKLDASSEFVGDLKESFYIGPIGDSDLQNDLNQWPCEECFPSWKETMKLYIATVLDTGKRILSLIALGLDLDAEFFHKIGALDCPSTFLRLLHYPGEVNESDSGNYGASAHSDYGALTLLVTDGTPWPADM

SEQ ID NO: 45037 - DNA, 1018 bp, Panicum virgatum
  misc_feature: Ceres CLONE 2023143
  misc_feature: Encodes the peptide sequence at SEQ ID NO. 45038
acacttctctgccccgcttcagttcagacttgagacgacacgctatagtcacgcacacgcacatggaaccggatccgctgcagttacctcccctgcagttgggtcactgccatgtgggccccacacgcagtgactcaactgcacggcggccaactgcagcggagcctcgtcccacgcacatacccaccaccaccgtaccgtaccagccatggcaaagtttgctctcggccaccaccgcgaggccgctgacaccggctgcgtccgcgcggtgctcgccgagctcatcctcaccttcctcttcgtcttcgccggcgtaggatcagccatggccacggggaagctggccggcagcgctgactccgtcgtgggccttacggcggtggcgctggcgcacacgctggtggtggccgtcatggtgtccgcggggctccacgtctccggcggccacatcaacccggccgtcacgctgggcctggccgtcacggggcgcatcaccctcttccgctccgcgctctacaccgccgcccagctcctgggctccgccctcgcctgcctcctcctcgccttcctcaccggcggcgcgcccacgcccgtgcacgcgctggcgccgggcgtcggcgcgctccagggcgtgctcatggaggtggtgctcaccttctcgctgctcttcgccgtgtacgccaccgtcgtcgacccgcgccgcgccgtcggaggcatgggcccgctgctggtggggctggtcgtcggagccaacgtgctcgccggcgggcccttctccggcgcgtccatgaaccccgcgcgctccttcgggccggcgctcgcggccggggtctgggccgaccactgggtctactgggtcgggccgctgattggcgggccgctcgctgggctggtctacgacggcctgttcatggcccagggaggccacgagccgcttccaccaagggacgacgacttgtaattcctgtctctgttggtttggtggtgtcccggctgactcctgaataaaataagagtt

SEQ ID NO: 45038 - protein, 250 aa, Panicum virgatum
  misc_feature: Ceres CLONE 2023143
  misc_feature (11)..(230): Pfam Name: MIP Pfam Description: Major intrinsic protein
MAKFALGHHREAADTGCVRAVLAELILTFLFVFAGVGSAMATGKLAGSADSVVGLTAVALAHTLVVAVMVSAGLHVSGGHINPAVTLGLAVTGRITLFRSALYTAAQLLGSALACLLLAFLTGGAPTPVHALAPGVGALQGVLMEVVLTFSLLFAVYATVVDPRRAVGGMGPLLVGLVVGANVLAGGPFSGASMNPARSFGPALAAGVWADHWVYWVGPLIGGPLAGLVYDGLFMAQGGHEPLPPRDDDL

SEQ ID NO: 45039 - DNA, 894 bp, Panicum virgatum
  misc_feature: Ceres CLONE 2023144
  misc_feature: Encodes the peptide sequence at SEQ ID NO. 45040
actagcctgctgtccattactactagtcttcgctcactgctgctgctagagctcagcttagctcgagtgccgcctgctcccattgctgggctgtgcaagcttaactaggctcgctctgctctagattctgctctagattcgacgacaatggccggggtcgggaggaacatggtggcgccgctcatggtgctcaacctcatcatgtacctcatcgtcatcggcttcgcgagctggaacctcaaccacttcatcaacggccagacaaactaccctggtgtggccggcaacggcgcgacgttctacttcctggtgttcgcgatcctcgccggcgtggtgggcgcggcgtcgaagctggccggcgtgcaccacgtccgcgcgtggcgccacgacagcctcgccacgagcgcggcgtcgtcgctcatcgcctgggccgtcaccgcgctcgccttcgggctggcgtgcaaggagatccacatcggcggccaccgcgggtggcgcctccgcgtgctcgaggccttcgtcatcatcctcgccttcacgcagctgctctacgtgatgatgctccacgcgggcctcttcggcggcagcgacggctaccgggaccacgactacggcgtcggcggcgccgccggcgagcccaagggccccagggtctgatctgatcgcctctctgaagcgctcgatcatgcacgcgcgctgcaggcgcgcgcggcgttaacgtaatagtagtaatgggatgtgtgtgtgggtgttgatggtgtgtacatcgttgctatctgctcatctcctgtttctagtcaggtcagctcagctctggcttgtacatgtaccctgtcaaatgtattttgtgtgccgttggtttcagtcagtgacgacacttgcgggagatgattc

SEQ ID NO: 45040 - protein, 169 aa, Panicum virgatum
  misc_feature: Ceres CLONE 2023144
  misc_feature (14)..(143): Pfam Name: AWPM-19 Pfam Description: AWPM-19-like family
MAGVGRNMVAPLMVLNLIMYLIVIGFASWNLNHFINGQTNYPGVAGNGATFYFLVFAILAGVVGAASKLAGVHHVRAWRHDSLATSAASSLIAWAVTALAFGLACKEIHIGGHRGWRLRVLEAFVIILAFTQLLYVMMLHAGLFGGSDGYRDHDYGVGGAAGEPKGPRV

SEQ ID NO: 45041 - DNA, 711 bp, Panicum virgatum
  misc_feature: Ceres CLONE 2023150
  misc_feature: Encodes the peptide sequence at SEQ ID NO. 45042
ccacaagatgacgctcaagggcaagcttctaggtactcgaagcgtgatcatagtacttctctgcgtcacagtgaaagtggcatggtagatcaggttctgttgacaacaaatgctgatggtctaagatttgtcaaggttagaatgcgatcagttcgcataccacaaattggagacaagtttagcagtaggcatggacaaaaaggaactgttgggatgacttacacacaagaggacatgccgtggacaattgaaggcatcacacctgatattattgtgaatccgcatgctattccatcccgtatgactattggacagctgattgagtgtattatgggtaaagttgcagctcacatggggaaggaaggagatgcaactccatttactgatgttactgtggataacatcagcaaagctcttcataaatgtggttatcaaatgcgtggatttgagaccatgtacaatggtcacactggaaggaaactgacagctatgatatttctgggtccaacatattaccaaagactcaagcacatggtggatgacaagatacattcaagaggtcgtggccctgttcagatactcacccggcaaccagcagaggggcgttcacgtgatggtggtctccgcttcggagaaatggaaagggattgcatgattgcgcatggagcagctttctttctgaaggaaagctgtttgaccagagtgatgcat

SEQ ID NO: 45042 - protein, 236 aa, Panicum virgatum
  misc_feature: Ceres CLONE 2023150
  misc_feature (2)..(204): Pfam Name: RNA_pol_Rpb2_6 Pfam Description: RNA polymerase Rpb2, domain 6
  misc_feature: SWISSPROT Homolog: EC 2.7.7.6 DNA-directed RNA polymerase
PQDDAQGQASRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAHMGKEGDATPFTDVTVDNISKALHKCGYQMRGFETMYNGHTGRKLTAMIFLGPTYYQRLKHMVDDKIHSRGRGPVQILTRQPAEGRSRDGGLRFGEMERDCMIAHGAAFFLKESCLTRVM

SEQ ID NO: 45043 - DNA, 1218 bp, Panicum virgatum
  misc_feature: Ceres CLONE 2023154
  misc_feature: Encodes the peptide sequence at SEQ ID NO. 45044
agaagcaacgaggcccatcgtcaggcgcaagaggagcggccgcgcgcggcgcgcttgacttctccggaaacccccaaaccccaccgagtctcccaccgaccgccggcgtctcgccttcccctccccttccccgcgcccgcggagacacgatggtggtgaccgacgcggcggcgatggccgtcgtgagggcggcgcgcccggccctccgcggcgcccacgacggcgtcgctttcgccgcccacgccgccttcctcgccgccggctactcgctctgcgccgtcggccccgccgcgctcgccgaccccccgccctcaggcgaagaggaggtggggatggatggttggaacagtatggaaaactgctacgcctttttgtatagcaaggaggagaagggcaagaagaaacgggtgctaatgaaatgtctggtgatcggtgaattacttgccatcgatgtcctcgatcttgaggcacaagataagggcccatataatatccagatcaacgtgaaagatttcttctccgaagagcagcccaagaattatggggatatgtacaagaactttgcaggcctcattgagaatgtgaattcaaatgtgttgggcaaattggatggggaggatgatcgtgcagtagctgataagaaccctgatgctactgccaagaatcctaatgctgaaagcagttcatcaatacacagctccgagaatccaggtcctagaaccgctgacccttccagcctaatatatcctccaatagctccgcttggtattgatgacctgttcccagggcctggtgcaggcttctaccctcacagtggtattggtggtggtggtggcatgcatgttggtccaaatgatccacgtttcttcccttcaaatcccttcccttccccatttggtggccctgggagtgttccaccgggtggtcgctatgatccaattggcccgcctggtgtaccagggtttgaaccatcaaacgttaggcgtccaaggcggcctcctggggggagcactcacccagacctcgagttcttccagcaaggcccagacttctgagacaacctcctccctactcccacgaaataacatggctctgtttgccacccaagctagagagcgctttgtgtgacttcgagttctatatggcagatagttgtgttccagacttcgcctgtaaagatggatgtgaacctttctgtatctacccttggttctgagc

SEQ ID NO: 45044 - protein, 301 aa, Panicum virgatum
  misc_feature: Ceres CLONE 2023154
  misc_feature (204)..(266): Pfam Name: PI31_Prot_Reg Pfam Description: PI31 proteasome regulator
MVVTDAAAMAVVRAARPALRGAHDGVAFAAHAAFLAAGYSLCAVGPAALADPPPSGEEEVGMDGWNSMENCYAFLYSKEEKGKKKRVLMKCLVIGELLAIDVLDLEAQDKGPYNIQINVKDFFSEEQPKNYGDMYKNFAGLIENVNSNVLGKLDGEDDRAVADKNPDATAKNPNAESSSSIHSSENPGPRTADPSSLIYPPIAPLGIDDLFPGPGAGFYPHSGIGGGGGMHVGPNDPRFFPSNPFPSPFGGPGSVPPGGRYDPIGPPGVPGFEPSNVRRPRRPPGGSTHPDLEFFQQGPDF

SEQ ID NO: 45045 - DNA, 565 bp, Panicum virgatum
  misc_feature: Ceres CLONE 2023155
  misc_feature: Encodes the peptide sequence at SEQ ID NO. 45046
gcctacccaccactcactgagctctcttcgtacctctctgctatgtctctcgggacgcgggcgagctctccttcctcatccaggtgcattgatggcgaccgaagtggctgaggctccggtgccgctggccgaggcggcccccgacgccgcagcggccgcggccgacggcgacacgaatccggccaggccaagatgcccgccgcgccgcagaggcgcgcgaacccgacccccccaccctacgctgagatgatctcggaggcgatcacgtcgatcaaggagatgacgggggcgagcggccaccccatcgccctgttcgtggaggacaagcacaaggccaagctgcctccgaacttccggaggctgctgctagggcagctgaagaatctcgtcgccgccggccatctcaccatggtcaagaactcgtacgagctgccggcggggcgcgccccggccggcgaccagcccaaagccgaacccaaggatagacgtgctgccgcccagcctcagtcgaatccgatgcctgccgcgaagatgcccacggactccgccaagcgcactgccaagg

SEQ ID NO: 45046 - protein, 124 aa, Panicum virgatum
  misc_feature: Ceres CLONE 2023155
  misc_feature (12)..(82): Pfam Name: Linker_histone Pfam Description: linker histone H1 and H5 family
MPAAPQRRANPTPPPYAEMISEAITSIKEMTGASGHPIALFVEDKHKAKLPPNFRRLLLGQLKNLVAAGHLTMVKNSYELPAGRAPAGDQPKAEPKDRRAAAQPQSNPMPAAKMPTDSAKRTAK

SEQ ID NO: 45047 - DNA, 668 bp, Panicum virgatum
  misc_feature: Ceres CLONE 2023172
  misc_feature: Encodes the peptide sequence at SEQ ID NO. 45048
aataaaataatctaattttaaagagaaatttctttttcaaagagatgttgagcagatttactcaaactttcaagactctcgtccccgttatgagagcctcttaccacgaaaacgtcatcaatcgctttgaaaaccccaaaaatgtcggatcccttgatgctaagaagaaaaatgtcggcacaggcttggctggacaccccgcttgcggtgatattatgaagctccaaatcgaagttggagaagacggaaaaactattgaaaaagctgtctttaaaacttacggatgcggatccgctattgccagtagtgaatatgccactgaactccttcaaggaatgagtgtcgaagatgctttgaacattaaaaacggagaaattgctggttacctcaagctccctcccgttaaattgcattgcagtttacttgctgaagacgccatcaagaaggctatccacaactctccaagaaaagaatgccgaacaaaaggaataaattacttgaaaatgagaatattcatccacttttaatgtatcttatattgttgttgtagtaagattgttttcacttattacgcaaaatatgcgagtctcaattttatatgagtatatcttgaataagggtacataatctataatcttatcacttattcacaaagatatatttttatt

SEQ ID NO: 45048 - protein, 160 aa, Panicum virgatum
  misc_feature: Ceres CLONE 2023172
  misc_feature (19)..(146): Pfam Name: NifU_N Pfam Description: NifU-like N terminal domain
MLSRFTQTFKTLVPVMRASYHENVINRFENPKNVGSLDAKKKNVGTGLAGHPACGDIMKLQIEVGEDGKTIEKAVFKTYGCGSAIASSEYATELLQGMSVEDALNIKNGEIAGYLKLPPVKLHCSLLAEDAIKKAIHNSPRKECRTKGINYLKMRIFIHF

SEQ ID NO: 45049 - DNA, 1216 bp, Panicum virgatum
  misc_feature: Ceres CLONE 2023181
  misc_feature: Encodes the peptide sequence at SEQ ID NO. 45050
tccttcattacaacatattcttcctactattctcaaggaatctattctgagaacctcttccctcactttccccttcacccttgagaggcaatctccaattcatcgccctactattctttcataagacacaggccatcatcatacgagattgacaataagcaaggactagcaagaagatgctgaagaaattgttgccaaagactaagagcaagaagaagaaggaggcagcctcctctgcgatacccacgttggatcggctccatgagactctagagatgctggagaagaaagagcgtttccttcagaagaagtgttttgctgaaatcgaaaaggctaaggattatacaaaatcgaagaacaagaatgctgcaattcagtgtctaaagaaaaagaagctgtacgagacacaaattaaacagctatcaaattttcaattgcgagttcatgaccagattataatgcttgaaagtgcaaaggcaactaccgatactgttgatgctttgcgctctggatcatctgctgtcaaagctattcagcaatcactgtacatcgatgacattgagaacgccattgatgcggcaaacgaacagacagaaaatatgaggcagatacaagaggcacttgcaacaccagttggcgcttctgctgattttgacgaggatgagctagaagcagagctggaagatctggaggaggaagagctcgaggaagaggagttgcctgcacctccagcgaggatatctgcgcatgtggaaccattagcaaagcaaacatcatcttctatgcagagcagtgatttgagtgaactgaccaaacttcaggcagagatggcactttagctgtagcttctagcttggccgacattgggagggattggcctgacattgcgatccctctgttgctgatacgaacatgtggtggtctgaatagtccgtccttggcatcatctggtgagtggtgacgcgtatccaagattcaagacgcagtcaatcttgccgagccgttaaatgctgtggacatctgtccgtcaagctttgaccacaacgttcaactcttatttcatcggatatactagtatataccatggatgatggcacgtgtacatttggtttttcttttttcttttttgaagaaatgtgtacatttgatttgagccttggacttggaccatgtgaaaccaaacaaatagggtacaaatactcaatttcttttcagc

SEQ ID NO: 45050 - protein, 220 aa, Panicum virgatum
  misc_feature: Ceres CLONE 2023181
  misc_feature (23)..(189): Pfam Name: Snf7 Pfam Description: Snf7
MLKKLLPKTKSKKKKEAASSAIPTLDRLHETLEMLEKKERFLQKKCFAEIEKAKDYTKSKNKNAAIQCLKKKKLYETQIKQLSNFQLRVHDQIIMLESAKATTDTVDALRSGSSAVKAIQQSLYIDDIENAIDAANEQTENMRQIQEALATPVGASADFDEDELEAELEDLEEEELEEEELPAPPARISAHVEPLAKQTSSSMQSSDLSELTKLQAEMAL

SEQ ID NO: 45051 - DNA, 737 bp, Panicum virgatum
  misc_feature: Ceres CLONE 2023182
  misc_feature: Encodes the peptide sequence at SEQ ID NO. 45052
atgtggtgtgtatagagtgcaatcgaggtggcgatgatagtctcatgctactatgtgatatttgtgattcctcagcacatacttattgtgttggcttgggaagggaagtgccggaaggaaattggtactgtggaggatgtagacttggtgatgaaggaccatcctatactggaattcagcgcaccgtggctaatgaaagacaaaattacagaactcaggttgataatagttctgtaagttttggaccggctgcaccaagtggcacattcgagagatcgccgtcaatcaaccctcgtggttcttttcaagggattgatctaaatctatccccaagagattttcctggggacacccatcctgctgaatcacaagtttcaactgatagcgtatcaactccaactggaaggcgtgcaaccctttcaggaaggcgtcaaatacatcgctatattcggattttgctaaatagaccaagacaacctagcagacaagacacataccataatgttgcacagcacagtggtgttgtaccaagaactgaaccaaattggcttaactttccttcatcagaaccaaacacatcgcacagtctgcctgatggcattcagaaccatcacaatggacttccatttgttcaagctcacagcagttttgctccatgcatgtccctcgatggggatgatttccagcaaattgaaggtgtcaaaagcaaccttaggaatgtgtagtagaatcccttg

SEQ ID NO: 45052 - protein, 240 aa, Panicum virgatum
  misc_feature: Ceres CLONE 2023182
  misc_feature (2)..(49): Pfam Name: PHD Pfam Description: PHD-finger
  misc_feature: SWISSPROT Homolog: EC 2.1.1.43 Histone-lysine N-methyltransferase
VVCIECNRGGDDSLMLLCDICDSSAHTYCVGLGREVPEGNWYCGGCRLGDEGPSYTGIQRTVANERQNYRTQVDNSSVSFGPAAPSGTFERSPSINPRGSFQGIDLNLSPRDFPGDTHPAESQVSTDSVSTPTGRRATLSGRRQIHRYIRILLNRPRQPSRQDTYHNVAQHSGVVPRTEPNWLNFPSSEPNTSHSLPDGIQNHHNGLPFVQAHSSFAPCMSLDGDDFQQIEGVKSNLRNV

SEQ ID NO: 45053 - DNA, 686 bp, Panicum virgatum
  misc_feature: Ceres CLONE 2023187
  misc_feature: Encodes the peptide sequence at SEQ ID NO. 45054
attgttaccggtcgccagtgaatcaatcgtctgctcctcacatctcagcgcgcccctgtttctttcttcgtgtcgcctgttcttccccgttccagccttccagaatgagggcggccatcgcgctcgcgatctgcgctctgtccgcgctgctggtcgcggcgcgcggatcggagaagccggcgaccgcgccggtggcggccgtcgacgtggcggcggccggcgacctcctccgctcgggcggccaccgctacctggacgtcagaacagaggaggaattcaggatcggacatgtgaaggattcccttaacgtgccatacgttttcttcacttcacaaggaagggagaagaacccccagttcattgagcaggtcgcggcacatttcgacaagcaggacaacatagttgtgggctgcaaaagtggagtaagatctgagctagcgtgttttgatcttatggcagctggatttggaaatgtgaagaatatggaaggtggttacgacgcatgggtggaaaatgaccttgctgtgaagaaacctcaagcacaagacgaactatagctgcttctattctccagttattcttttgcttgatgtgtattgttagtttgttgctattgtatggtggataagttgaatgtaggattcaatgaacaaaacatatagtctgctgtgaacatttaaattatg

SEQ ID NO: 45054 - protein, 150 aa, Panicum virgatum
  misc_feature: Ceres CLONE 2023187
  misc_feature (34)..(137): Pfam Name: Rhodanese Pfam Description: Rhodanese-like domain
  misc_feature: SWISSPROT Homolog: EC 2.8.1.1 Thiosulfate sulfurtransferase
MRAAIALAICALSALLVAARGSEKPATAPVAAVDVAAAGDLLRSGGHRYLDVRTEEEFRIGHVKDSLNVPYVFFTSQGREKNPQFIEQVAAHFDKQDNIVVGCKSGVRSELACFDLMAAGFGNVKNMEGGYDAWVENDLAVKKPQAQDEL

SEQ ID NO: 45055 - DNA, 1134 bp, Panicum virgatum
  misc_feature: Ceres CLONE 2023192
  misc_feature: Encodes the peptide sequence at SEQ ID NO. 45056
atatccgtccagtagttagtacctgttctgtttgataatcaagtgcaacaatttttcattctacgcttgatgggccgttcactgggcctcatgggctgtcagattgggcagactcaagacacatgacggccgcggaggagcgccccaagtaaaaccctagctcctcgcgagccgccttcggttctttccccaaccgccagccacgctcacgcaacggcgcagccatggcggacggagccgccgctacgcccgccgacgccgcctccagctgcgaggtggacctcggcaaccttatggcgtacgacccgtcgcaccacgtcgccgccgccgccgcctccaggttcaccaacggccaggaggagctgaggcaggagtgcctgctaaaggcgacggagctggcgcaagcggtggccaactcccttttcgcgctgccgcccagcgaggaccgcgacggcccaatcgtccacctcccgccgccaaccatccgacttccgcgcgagaagcatctaccgaagccaaagccacccaccaagtgggagctctttgcaaaggcgaaagggattaccaagcgcaagaagaacaagcgcgaatgggacgagcaaactcaatcctggaaacggacttacggctatgaccgtgttaatgatgacaaagatgttccgatcattgatgccaaatccactgacgagcctggtgtcgatccttttgcacaaagaaggcaagagaagaagaagcgtgtagaaaagcaagaaaagaacagactggagaacttaaagaaagctgcaaaagttggcgctttgccaagtcatatacaacttgctgcaaaggctttgcccatcacaggaactaaagctgatcttccgaaaaaatctagaaaagaggatcttgagaatgttgctggcatggcttcatcagcaacagcaagtggtgggaagtttgatgagaagttgcctggcgaaaaacctccaaagcatcctggcaaacatagaaagttcctcccagttgctgaagggaagggaatgggcaacctggagaaacagcagaacgacaagatcctgaactctctacttgctagaaactctgacgagcagcttgatgttggcaaggcaattacaatgtacaaggtgaagatgg

SEQ ID NO: 45056 - protein, 303 aa, Panicum virgatum
  misc_feature: Ceres CLONE 2023192
  misc_feature (6)..(187): Pfam Name: RRS1 Pfam Description: Ribosome biogenesis regulatory protein (RRS1)
MADGAAATPADAASSCEVDLGNLMAYDPSHHVAAAAASRFTNGQEELRQECLLKATELAQAVANSLFALPPSEDRDGPIVHLPPPTIRLPREKHLPKPKPPTKWELFAKAKGITKRKKNKREWDEQTQSWKRTYGYDRVNDDKDVPIIDAKSTDEPGVDPFAQRRQEKKKRVEKQEKNRLENLKKAAKVGALPSHIQLAAKALPITGTKADLPKKSRKEDLENVAGMASSATASGGKFDEKLPGEKPPKHPGKHRKFLPVAEGKGMGNLEKQQNDKILNSLLARNSDEQLDVGKAITMYKVKM

SEQ ID NO: 45057 - DNA, 699 bp, Panicum virgatum
  misc_feature: Ceres CLONE 2023193
  misc_feature: Encodes the peptide sequence at SEQ ID NO. 45058
aactctccccgcctcgcacccatggcgacggccctgatggctgcggccaccacctcatgctccccgcgccgctcccggcgctggcggagcagatggagaaggcggcgctcttcgacttcaacctgacgctcccggcgatcgcgatcgagttcctgctgctcatggtcgcgctggacaagctctacttcacgccgctcggcaagttcatggacgagcgggacgccaagatccgcggcgagctaggagacgtcaaggacgcctccgaggaggtgaagcagctggaggagcaggccgccgccatcctgaaggccgcgcgcgccgagatcgccgcggcgctcaacaagatgaagaaggagaccaccgcggagctggaggccaagctggacgagggccgccgccgcgtggaggccgagctcgtcgaggcgctcgccaacctcgagtcccagaaggaggaggccgtcaaggcgctcgacgcgcagatcgcctcgctcagcgacgagatcgtcaagaaggtgctcccatccgcgtgagcgaatcaaaacagcgagccggccggccggccttcttccttgcttagcttctgatctgtgtgtatacgcttgttgggctgccgtccattgccggccctgctttatcctatgatgtgtgtaattgcatcaacattttgtggcaagtataaatgaatcaatcatatttctg

SEQ ID NO: 45058 - protein, 157 aa, Panicum virgatum
  misc_feature: Ceres CLONE 2023193
  misc_feature (24)..(155): Pfam Name: ATP-synt_B Pfam Description: ATP synthase B/B' CF(0)
  misc_feature: SWISSPROT Homolog: EC 3.6.3.14 H(+)-transporting two-sector ATPase
MLPAPLPALAEQMEKAALFDFNLTLPAIAIEFLLLMVALDKLYFTPLGKFMDERDAKIRGELGDVKDASEEVKQLEEQAAAILKAARAEIAAALNKMKKETTAELEAKLDEGRRRVEAELVEALANLESQKEEAVKALDAQIASLSDEIVKKVLPSA

SEQ ID NO: 45059 - DNA, 636 bp, Panicum virgatum
  misc_feature: Ceres CLONE 2023197
  misc_feature: Encodes the peptide sequence at SEQ ID NO. 45060
aggagtcactatttatcatcagcagttaatccttccataaagggtgataggttgctcattccccatgaaagtctggacctagcaattaggaggttgaaggagcaggaggcttccaataagaagccatctgaaaacatgaagttgttggcgaaagatgagtacgagtgcaatttcatttcagcagttgtgccttccaatgaaattggagttaagtttgatgatattggtgctcttgaggatgtcaaaaagacacttgatgaacttgttactcttccaatgaggaggccagagcttttttctcacggcaacttgttaaggccctgcaaaggtatattgctttttgggcctcctggaacaggaaaaacacttttggcaaaggcacttgcaacagaagctggagcaaattttataagcataactggttctactctcacatcaaagtggtttggagatgctgagaagctcaccaaggcccttttctccttcgctagtcgactggctcctgtaataatatttgtggacgaggtcgacagcttacttggtgcaagaggtggtgcacatgagcatgaggcaacgagaaggatgagaaatgaatttatggcagcttgggatggtctaaggtccaaagaggaccag

SEQ ID NO: 45060 - protein, 211 aa, Panicum virgatum
  misc_feature: Ceres CLONE 2023197
  misc_feature (110)..(211): Pfam Name: AAA Pfam Description: ATPase family associated with various cellular activities (AAA)
  misc_feature: SWISSPROT Homolog: EC 3.6.4.3 Microtubule-severing ATPase
RSHYLSSAVNPSIKGDRLLIPHESLDLAIRRLKEQEASNKKPSENMKLLAKDEYECNFISAVVPSNEIGVKFDDIGALEDVKKTLDELVTLPMRRPELFSHGNLLRPCKGILLFGPPGTGKTLLAKALATEAGANFISITGSTLTSKWFGDAEKLTKALFSFASRLAPVIIFVDEVDSLLGARGGAHEHEATRRMRNEFMAAWDGLRSKED

SEQ ID NO: 45061 - DNA, 872 bp, Panicum virgatum
  misc_feature: Ceres CLONE 2023207
  misc_feature: Encodes the peptide sequence at SEQ ID NO. 45062
ctttaaacatccatccatccatcttgttctaatgcctccatccaccaagaagtccactggtaagaaggtcgccccttctccttacgccgtcaagggtaagcaatccaccaaggccgctgccaaccctttgcttgaaaagactcccaagaactttggtgttggtcaagatgttcaacccaagcgtgatgtctctcgtttcgtcaagtggcctcaatatgttaagcttcaacgtcaaaagaagatcatctaccaacgtcttaaggtccctcctgctcttaaccaattcacccacgttttggataagaacactgctactcaagtgttcaagttgatgcacaagtacagacccgagtccaagaacgagaagcgtgatcgtctccgtgctgctgctcttgccaagtccgagaagaaggaagttgccaagaccgacaagcccgttgtcatcaagtacggtatcaaccacatcactgctttggttgaagctaagaaggcccaattagtcgtcattgctgatgatgttgaccccattgagctggttctctggctccccgctctttgccgtaagatgggtgtcccttactgtattgtcaagggtaaggctcgtctcggtacactcgtccacaagaagactgccactgctctcgctttgactgaagtctctgaggctgataaggctgagttggctaccattgtctctgctgtcaacaccaacttcaccgagaagtgggaagatgttcgtcgtcactggggtggtggtattatgggccccaagtccaacgcaaagatggccaagcgtgctgccatcgctgctaaggaaattgctgctcgtcagtaaatactttcacaataaattaccaacgactaatttgtta

SEQ ID NO: 45062 - protein, 267 aa, Panicum virgatum
  misc_feature: Ceres CLONE 2023207
  misc_feature (122)..(218): Pfam Name: Ribosomal_L7Ae Pfam Description: Ribosomal protein L7Ae/L30e/S12e/Gadd45 family
MPPSTKKSTGKKVAPSPYAVKGKQSTKAAANPLLEKTPKNFGVGQDVQPKRDVSRFVKWPQYVKLQRQKKIIYQRLKVPPALNQFTHVLDKNTATQVFKLMHKYRPESKNEKRDRLRAAALAKSEKKEVAKTDKPVVIKYGINHITALVEAKKAQLVVIADDVDPIELVLWLPALCRKMGVPYCIVKGKARLGTLVHKKTATALALTEVSEADKAELATIVSAVNTNFTEKWEDVRRHWGGGIMGPKSNAKMAKRAAIAAKEIAARQ

SEQ ID NO: 45063 - DNA, 695 bp, Panicum virgatum
  misc_feature: Ceres CLONE 2023220
  misc_feature: Encodes the peptide sequence at SEQ ID NO. 45064
atcagcaggctataagcaatagctccatcttgtcagtgatcagcaatcggtgatggcgtcggagaagagcaagatcctggtggtcggcgccacggggtacctgggccggcacgtcgtcgcggcgagcgcgcggctgggccacccgaccttggcgctcgtcagggacacggcgccgtccgacccggccaaggcggcgctgctcaagagcttccaggacgccggcaacgtcaagaggttcttcccgtcggagttcgggctggacgtggaccacacgggcatcgtggagccgggcaagtccgtcctgtccgccaaggtggccatccggcgcgccgtcgaggccgccggcatcccgtacacgtacgtggtggccggcttcttcgcgggctacgcgctgcccggcatcgggcaggccctcgcccaggggccccccgccgacaaggccgtcgtgctcggcgacggcaacgccaaggccgtgtacgtggaggagggcgacatcgggacgtacacggtgctcgccgccgacgacccgcgcgccgagaacaagacgctgtacgtgcggccgccggccaacacgctgtcgcacaacgagctgctggcgctatgggagaagaagtctggcagggggttcgagcgggagtacgtcccggaggagaccgtcctgaagcagatccaagagtcgccggtgccggcgaaca

SEQ ID NO: 45064 - protein, 214 aa, Panicum virgatum
  misc_feature: Ceres CLONE 2023220
  misc_feature (8)..(214): Pfam Name: NmrA Pfam Description: NmrA-like family
  misc_feature: SWISSPROT Homolog: EC 1.3.1.45 2'-hydroxyisoflavone reductase
MASEKSKILVVGATGYLGRHVVAASARLGHPTLALVRDTAPSDPAKAALLKSFQDAGNVKRFFPSEFGLDVDHTGIVEPGKSVLSAKVAIRRAVEAAGIPYTYVVAGFFAGYALPGIGQALAQGPPADKAVVLGDGNAKAVYVEEGDIGTYTVLAADDPRAENKTLYVRPPANTLSHNELLALWEKKSGRGFEREYVPEETVLKQIQESPVPAN

SEQ ID NO: 45065 - DNA, 613 bp, Panicum virgatum
  misc_feature: Ceres CLONE 2023223
  misc_feature: Encodes the peptide sequence at SEQ ID NO. 45066
ccagggcaccttcgccaaggtctactacgcgcgggacctcaagcccgagaacctgctcctcgacgaggaggggcgcctcaaggtcaccgacttcggcctcgccgcgctgcccgagcagctgcgccgcgacggcctgctccacacgcagtgcggcacccccgcgtacgtcgcgcccgaggtgctccgcaagcgcggctacgacggcgcccgcgccgacctctggtcctgcggcgtcgtcctctacgtcctgctctgcggtttcctccccttccagcacgacaactatgccaagatgtaccagaagatcttcaaggccgactaccaggtgccgccctgggtctccggcgacgcgcgccgcctcatcgcgcgcctgctcgtcgtcgaccccgccaagcgcgcctccgtcgaggagataatgctcacgccctggttcaggaagggcttcgtcccgcccgtcctctcgccccaggtgtcgcccaagaagcggctgcacgacgaagccgatgtcggtgccctcctcgagggcggcggcggcgccgacgacgacagcagcagctccgcctccgtctctccccggtcctgcaacgctttccagctcatctcctccatgtcc

SEQ ID NO: 45066 - protein, 203 aa, Panicum virgatum
  misc_feature: Ceres CLONE 2023223
  misc_feature (1)..(144): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
QGTFAKVYYARDLKPENLLLDEEGRLKVTDFGLAALPEQLRRDGLLHTQCGTPAYVAPEVLRKRGYDGARADLWSCGVVLYVLLCGFLPFQHDNYAKMYQKIFKADYQVPPWVSGDARRLIARLLVVDPAKRASVEEIMLTPWFRKGFVPPVLSPQVSPKKRLHDEADVGALLEGGGGADDDSSSSASVSPRSCNAFQLISSM

SEQ ID NO: 45067 - DNA, 907 bp, Panicum virgatum
  misc_feature: Ceres CLONE 2023236
  misc_feature: Encodes the peptide sequence at SEQ ID NO. 45068
agtcttacgcagtaacaatcactacattcgcaatggcaactctcgctggaaaggtggtcgtggtgacgggtgcggcgtctggcattggccgagccaccgctgttcttctcgcggaacgctctgcactgctatcactcagcgacgtcaacgaggcagcgctagccactgtcaaatccgagctcgagaagagcacgaacgcgaaggtctttacctcggccttcgacgtccggaaccaggaggcaacccatgcgtggatccgcgacacggtggcacactacggacagccgatctatggcgcggccaatgtggcgggcgtcgtcgggccgagcctggcgatggagaagggcacgattcgcaacatcaccgaccaggagttcgactgggtcagcgacatcaacatgaagggcgtgctcaactgcctgcgcgccgagctgccgcacatgcaggagggcaaggacgggcgcaacggcgggtccatcgtcaacgtggccagtctggccggtctgctcggtgtcccgtacgatgttccgtacgtcgccagcaagcacgctgttgttggcatgactcgggcggcggccaaggaggagggcgccaaagcaattcgggtcaatgctgtctgtccgggtatcattgatacaccccaggttgttggaatcgaggaaaagttgggcgaagcttccgccaccctcttcggcggcgtggctccggggcctttggcacgccgtggcgatgcctcggaggtggcagaagccattgttttcctactgagcccacaaagcagcttcatcaacggcgtggctcttcccatcgagggcgggtggtcgtgctcggtttgagcagtggaagctagctgctgcatgggtctacgccaacatgcttcaaattcaggggtcaatattccaccacc

SEQ ID NO: 45068 - protein, 267 aa, Panicum virgatum
  misc_feature: Ceres CLONE 2023236
  misc_feature (7)..(186): Pfam Name: adh_short Pfam Description: short chain dehydrogenase
  misc_feature: SWISSPROT Homolog: EC 1.1.1.100 3-oxoacyl-[acyl-carrier-protein] reductase
MATLAGKVVVVTGAASGIGRATAVLLAERSALLSLSDVNEAALATVKSELEKSTNAKVFTSAFDVRNQEATHAWIRDTVAHYGQPIYGAANVAGVVGPSLAMEKGTIRNITDQEFDWVSDINMKGVLNCLRAELPHMQEGKDGRNGGSIVNVASLAGLLGVPYDVPYVASKHAVVGMTRAAAKEEGAKAIRVNAVCPGIIDTPQVVGIEEKLGEASATLFGGVAPGPLARRGDASEVAEAIVFLLSPQSSFINGVALPIEGGWSCSV

SEQ ID NO: 45069 - DNA, 600 bp, Panicum virgatum
  misc_feature: Ceres CLONE 2023238
  misc_feature: Encodes the peptide sequence at SEQ ID NO. 45070
gggctccgcgtaaccgggcaccgccatctccaggaacagggagtaaaacgcttagcttccggggcctggatccaataacggaagccaaaatggggaaactcccgttccggaacctccgccactccctccgccccccctccctccagggctacctgggccaattcctcccccccttgctcttcctcttccccggggtccggtcccccctcccctaccggcaactgacccctggcggccccctccaccctgccgggctggtggccatccccatccccccccccctggccctcttcctccgcgtctccctccccccccacctctcccggggccacctgaaccccgccgtgaccttccgcctccccgtccgcgggcacctccccctcctccccggcctcttctactgggtcgccccgctgctccgcgcctccgtggcctgcctgctcctccagttcctcacccaccgcaaggccctcccgacccacggcgtcccccggatcagcgcgctggaaggcgtggtggtccagatcatcatcaccttcccgcttgtccacaccgtggacgccaccggcgcccacccccagaagggcttccttcgcacca

SEQ ID NO: 45070 - protein, 170 aa, Panicum virgatum
  misc_feature: Ceres CLONE 2023238
  misc_feature (11)..(170): Pfam Name: MIP Pfam Description: Major intrinsic protein
MGKLPFRNLRHSLRPPSLQGYLGQFLPPLLFLFPGVRSPLPYRQLTPGGPLHPAGLVAIPIPPPLALFLRVSLPPHLSRGHLNPAVTFRLPVRGHLPLLPGLFYWVAPLLRASVACLLLQFLTHRKALPTHGVPRISALEGVVVQIIITFPLVHTVDATGAHPQKGFLRT

SEQ ID NO: 45071 - DNA, 681 bp, Panicum virgatum
  misc_feature: Ceres CLONE 2023240
  misc_feature: Encodes the peptide sequence at SEQ ID NO. 45072
ctgatttggaagacacagaatccatggactggactaagagggcagttctatgatcatctccacgaccaaactgctgggttttatggttgccgatgtgctgctgaacctattcatgtccaactgaatttggccagctactttatagaggtggtaaacactacagctgatgaactcgcagatgtggctgttgaaatttcagtatgggatttggacggtacatccccctattataaagttaccgagaaaattgttataccaccaaagaaagtgaagcagatcatggagatgaaatacccgaagatgaaggatgccaagcctgtgtattttctgttactcaaacttttcaggctttcagacaatagaatactctccagaaacttctactggttgcatcttcccgggaaagactacaagttgttagagcagtaccagcagaaaaagattccactaaaaatttattccgagattttggtctcaggcaccaagcaccaattaagaatgatagtagagaacaagtcgacgaagtcaatcgcagaaagcatacacccagcatcaggaattgatctaggtgatgtaagtggttcccacagcactggcaaagaaactactcatgatggaaatgagagtggaagcctgtggcgggaaatacacagcagcctcggcgtcgcaagaacaagtgac

SEQ ID NO: 45072 - protein, 226 aa, Panicum virgatum
  misc_feature: Ceres CLONE 2023240
  misc_feature: SWISSPROT Homolog: EC 3.2.1.152 Mannosylglycoprotein endo-beta-mannosidase
LIWKTQNPWTGLRGQFYDHLHDQTAGFYGCRCAAEPIHVQLNLASYFIEVVNTTADELADVAVEISVWDLDGTSPYYKVTEKIVIPPKKVKQIMEMKYPKMKDAKPVYFLLLKLFRLSDNRILSRNFYWLHLPGKDYKLLEQYQQKKIPLKIYSEILVSGTKHQLRMIVENKSTKSIAESIHPASGIDLGDVSGSHSTGKETTHDGNESGSLWREIHSSLGVARTS

SEQ ID NO: 45073 - DNA, 648 bp, Panicum virgatum
  misc_feature: Ceres CLONE 2023261
  misc_feature: Encodes the peptide sequence at SEQ ID NO. 45074
acaggcacaaatggaactcgtttggctgaggctgctacttccggtcttgctctgtgtttccctcgtcgcctacctttacagcatcctatggctgagaccagagaggctcaggcagaaactgaggagccagggagtgaagggccccaagccgtctttcctcttcgggaacatacaggagatgaggagaattcagcagcagctgaccgagtctcatcaagaacaagaagcagggattactgatcgcttctcctcaaattatgtggccactctgttcccttacttcctccactggagcagggtctacggctccatctacctgtattctactggaagcatacatgctttatttgtgacagacccagacatagtaaaggagctggcaaactgcaagtctttggaacttggaaaacctatctacctgcaaaaagagcttggagctcttcttggtatgggaattttgacatcaaacggtgacctatgggcacatcaacgaaaggtgattgcaccagaattcttcatggacaaggttaaggtaaaattcagccttaacaatagaattcttcgttgctgattgaatgactcacagacctagtaccagaaacttcctacaatatgattttttttttgttattgcttactaaatgcatc

SEQ ID NO: 45074 - protein, 186 aa, Panicum virgatum
  misc_feature: Ceres CLONE 2023261
  misc_feature: SWISSPROT Homolog: EC 1.3.3.9 Secologanin synthase
MELVWLRLLLPVLLCVSLVAYLYSILWLRPERLRQKLRSQGVKGPKPSFLFGNIQEMRRIQQQLTESHQEQEAGITDRFSSNYVATLFPYFLHWSRVYGSIYLYSTGSIHALFVTDPDIVKELANCKSLELGKPIYLQKELGALLGMGILTSNGDLWAHQRKVIAPEFFMDKVKVKFSLNNRILRC

SEQ ID NO: 45075 - DNA, 657 bp, Panicum virgatum
  misc_feature: Ceres CLONE 2023280
  misc_feature: Encodes the peptide sequence at SEQ ID NO. 45076
ctccgtgatcaaggcaatgttgaacaaagtcgacaaacttgtccttggaggtggaatggttttcactttcttgaaggctcgtggcgtgaatgtgggtaaatccttagtcgaggatgaccagttagagttagcaaagaagcttgagaagatcgccaaggataagggtgtgcaactcttcctcgcctccgatgtcgtggttgccgataaattcgctgccgatgctacagctaagattgtggatgttaacgctattcctgatggttggatgggtcttgatattggaccaaagtcaatcgatgctattaaaactgctctctctgactgcaagacagttatttggaatggtcctatgggtgtgtttgagttcgatgccttcgccaaaggaacaaatgccattgcaaccattttggctgacttaactggtaaaggcacagtgaccatcattggcggtggtgactctgtcgctgctgttgagaaagctgggcttgcggagaaaatgtctcacatttcaactggtggtggagcttcattggaactcttggaaggaaaggttcttcctggagtcgcagctcttgacgaggcttaagcagatatgttgacttgatcttttgccttctcaagtctgtagagctattcaattgttagtattacccccta

SEQ ID NO: 45076 - protein, 194 aa, Panicum virgatum
  misc_feature: Ceres CLONE 2023280
  misc_feature (1)..(191): Pfam Name: PGK Pfam Description: Phosphoglycerate kinase
  misc_feature: SWISSPROT Homolog: EC 2.7.2.3 Phosphoglycerate kinase
SVIKAMLNKVDKLVLGGGMVFTFLKARGVNVGKSLVEDDQLELAKKLEKIAKDKGVQLFLASDVVVADKFAADATAKIVDVNAIPDGWMGLDIGPKSIDAIKTALSDCKTVIWNGPMGVFEFDAFAKGTNAIATILADLTGKGTVTIIGGGDSVAAVEKAGLAEKMSHISTGGGASLELLEGKVLPGVAALDEA

SEQ ID NO: 45077 - DNA, 593 bp, Panicum virgatum
  misc_feature: Ceres CLONE 2023281
  misc_feature: Encodes the peptide sequence at SEQ ID NO. 45078
cttggggtctacagtacttaatatgaaggcaatgggtataaatgacctattatcctttgattttatggaccccccagcacctcaagcactgatttctgccatggaacagttgtatagccttgacgctcttgatgaagagggccttctaaccaaactggggaggaaaatggcagaattcccattggacccaccactttcaaagatgctactagccagtgttgaccttgggtgcagtgatgagatactgactatcatagcaatgattcaaacagggaacatattctacaggccacgagaaaaacaggctcaagctgatcaaaaaagggctaaatttttccagccagagggggatcatcttactctgcttgctgtatacgaggcttggaaggcaaagaacttttctggtccctggtgttttgagaactttgttcaatcaagatcattgaggagagcacaggatgtgaggaagcaacttctcactatcatggacagatataaacttgatattgtctctgctgggaaaaacttcacaaagataaggaaagcaattaccgctggcttctttttccatgctgcaaggaaggatccccaag

SEQ ID NO: 45078 - protein, 197 aa, Panicum virgatum
  misc_feature: Ceres CLONE 2023281
  misc_feature (32)..(122): Pfam Name: HA2 Pfam Description: Helicase associated domain (HA2)
LGSTVLNMKAMGINDLLSFDFMDPPAPQALISAMEQLYSLDALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDRYKLDIVSAGKNFTKIRKAITAGFFFHAARKDPQ

SEQ ID NO: 45079 - DNA, 684 bp, Panicum virgatum
  misc_feature: Ceres CLONE 2023310
  misc_feature: Encodes the peptide sequence at SEQ ID NO. 45080
atcgtgccaaatgtatatacctacactgctgtgattgatgcaatgtatcgtgcagggcaggttccccgtgcacaagagctcttgtgccagatgatcgattctggttgcccgccaaacacggcaacgttcaatgcaatcatgcgagcgcatgtcaaggccggccgttctgagcaggtgctgcaggtgcataaccagatgcagcagcttggatgtaaaccagatatcatcacttacaatttcttgatggagacacattgtgggaaagggcagggcaaccttgatgcagcactgaaggttcttgcgaaaatgacagcaaaagggtgtgttcctgactgccacacgttcaatcccatgttcaagctggtgcttgtgctcggcaacattgatgctgcgcgaaagttgtatgaaaagatgagggagctacaatgcaagccaaatgttgtgacatacaattgccttctaaggttgttcaataaggagaagtcaatggatatggttctgaggatgaaaaggaccatggatgcagaaggaatagagccaaatattcacacctatgcgattctgattgaggcattctgtgggagagggaactggaagcgtgcacatgcaacactaagggaaatgatcgaggagaagtcctttaaaccctcaaagcaggtgcgagatatggtactgacccttttg

SEQ ID NO: 45080 - protein, 227 aa, Panicum virgatum
  misc_feature: Ceres CLONE 2023310
  misc_feature (6)..(40): Pfam Name: PPR Pfam Description: PPR repeat
  misc_feature (41)..(75): Pfam Name: PPR Pfam Description: PPR repeat
  misc_feature (148)..(182): Pfam Name: PPR Pfam Description: PPR repeat
  misc_feature (113)..(147): Pfam Name: PPR Pfam Description: PPR repeat
IVPNVYTYTAVIDAMYRAGQVPRAQELLCQMIDSGCPPNTATFNAIMRAHVKAGRSEQVLQVHNQMQQLGCKPDIITYNFLMETHCGKGQGNLDAALKVLAKMTAKGCVPDCHTFNPMFKLVLVLGNIDAARKLYEKMRELQCKPNVVTYNCLLRLFNKEKSMDMVLRMKRTMDAEGIEPNIHTYAILIEAFCGRGNWKRAHATLREMIEEKSFKPSKQVRDMVLTL

SEQ ID NO: 45081 - DNA, 756 bp, Panicum virgatum
  misc_feature: Ceres CLONE 2023312
  misc_feature: Encodes the peptide sequence at SEQ ID NO. 45082
aggcagcatccactctcagtctcaggccgtctccctccccctaggccctagctcctccagtctccacctcggtgctccggcctcgaccacccggcaatgggctcagcctcaggtgatgatgctctcggggagcacctgctgctggacgtggacggccccgccagcggcggcggcggcgcggcggcgcccaagatacgggtgcgcgggctgcgccgcctggcggacggggcggcgggcgacgagatcctgcggggcgtcgacctggacgtcccgcgcggcgtggtgatgggcgtcatcgggcccagcggcagcggcaagtccacgctgctccgcgcgctcaaccgcctctgggagcccgcccccggcgccgtgctcctcgacggcgccgacatccgcggcatcgacgtcctcgcgctccgccgcagggtcggcatgctcttccagctccccgccatgttcgaaggaaccgtggcggacaacgtgcgctacgggccgcagctgcgcggcaagaagctcacagaagccgaagtgaagaatctgctgagcctggcggacctggaccctgctctgtcctccaagccggcctccgagctgtccgtcggccaggcgcagcgcgtcgccttggcgcgcaccctcgccaacgaccccgaggtgctcctgctggacgagccgacgagcgcactggaccccatctccacgcaaaacatcgaggaggccctcgtgcgactgaagaaggcgaggggggctcacacggtg

SEQ ID NO: 45082 - protein, 219 aa, Panicum virgatum
  misc_feature: Ceres CLONE 2023312
  misc_feature (61)..(219): Pfam Name: ABC_tran Pfam Description: ABC transporter
  misc_feature: SWISSPROT Homolog: EC 3.6.3.27 Phosphate-transporting ATPase
MGSASGDDALGEHLLLDVDGPASGGGGAAAPKIRVRGLRRLADGAAGDEILRGVDLDVPRGVVMGVIGPSGSGKSTLLRALNRLWEPAPGAVLLDGADIRGIDVLALRRRVGMLFQLPAMFEGTVADNVRYGPQLRGKKLTEAEVKNLLSLADLDPALSSKPASELSVGQAQRVALARTLANDPEVLLLDEPTSALDPISTQNIEEALVRLKKARGAHT

SEQ ID NO: 45083 - DNA, 420 bp, Panicum virgatum
  misc_feature: Ceres CLONE 2023320-R
  misc_feature: Encodes the peptide sequence at SEQ ID NO. 45084
ggccatacagtaaagtggttcaagcgtttgttgatgcattagaagcaaggaagataactgtcagtgttagactgacccgggggctagatgctaacgcagcctgtggtcagctgagaaatgaattccagaagaatccgcttcttggtcttcaacctcggagcccaatctcgcacctttatttgaagggctggagtgcgcgtagattataacattttaaagccttttcgggcatcattttcaggcatgactgcatgaggtttttgttttactgagaaaataggtgtggtcactagaaaagtcaagcaaattatgtagacataaagctaaggaattttggaacattggttatgccccaccaaatcatgtaaaccgagctttcatttgattccatgaatacaattcagtagtcatgcttgtctc

SEQ ID NO: 45084 - protein, 68 aa, Panicum virgatum
  misc_feature: Ceres CLONE 2023320-R
  misc_feature: SWISSPROT Homolog: EC 2.1.2.11 3-methyl-2-oxobutanoate hydroxymethyltransferase
PYSKVVQAFVDALEARKITVSVRLTRGLDANAACGQLRNEFQKNPLLGLQPRSPISHLYLKGWSARRL

SEQ ID NO: 45085 - DNA, 715 bp, Panicum virgatum
  misc_feature: Ceres CLONE 2023320
agagagagagagagagagggactatagccgtgagccgtcgtgagcagacagagcagcgtcgtaacaaagcagggaatggccgccgcgccgccgcacgtccgcgcagcccctctcgcgcgcgccctctgcgcgcgcgcctccgccaccgccgccgccgccgtgccgcccaagcctcagtctcaggcgaattcttgccgcgcgctgctcggcctctccgagactgacctccgccagctcgccctcgacctcggccagcaaagctacagggggaagcagctgcacgacctcctctacaagtccagggccaagcaaatccaagaattcaaccacgtgcccaaggcgttccgggaggcgttgctcggcgctggctggactgtcggccgctcgccagtgcaccatgccgtgaccgcctcggatggcacggccaagatacttctcaagttggaggataaccggttgatcgagacagtagggattcctgtcaatgatgacaacaaaggatcttctaggctcactgcctgtgtttcatcgcaggtcggctgccccttgcgttgctcattttgtgccacgggcaagggagggttcgctaggaaccttcgaccacatgagattgttgaacaggtgttggccatcgaggagatgttcaaacacagggtcacaaatgttgtgttcatggggatgggtgagcccatgttgaaactcaagtcagttctag

SEQ ID NO: 45086 - DNA, 613 bp, Panicum virgatum
  misc_feature: Ceres CLONE 2023325
  misc_feature: Encodes the peptide sequence at SEQ ID NO. 45087
gaggccaagccagtcccgcggtgcgtccggtccgggggagtagagccgaccggctccggcagcggggatggcggtggagatcccgttgatcgacctgcgcctggccggcgcggcgccggaggagtccgcgcgcctgcgggccgcgtgcgagcggctgggctgcttccgcgtgaccggccacggcgtgcccggggggctcctggccgagatgaaggccgccgtgcgcgcgctcttcgacctccccgacgacgccaagcgccgcaacgccgacgtcatccccgggagcggctacgtcgcgcccagcgccgccaacccgctctacgaggccttcgggctcctcgacgccgccgcgcccgccgacgtcgacgccttctgcgcgcgcctcgacgcgccgccgcacctcagggagaccgtcaaggcctacgcggagaagatgcacgacgtgatcgtcgacgtcgccggcaagctggcctccagccttgggctggcggagcactcgttcgaggactggccgtgccagttccgcatcaaccggtacaactacacgcaggacacggtgggctcctccggcgtgcagacccacacggactcgggcttcctcaccgtgctccag

SEQ ID NO: 45087 - protein, 181 aa, Panicum virgatum
  misc_feature: Ceres CLONE 2023325
  misc_feature: SWISSPROT Homolog: EC 1.14.11.15 Gibberellin 3-beta-dioxygenase
MAVEIPLIDLRLAGAAPEESARLRAACERLGCFRVTGHGVPGGLLAEMKAAVRALFDLPDDAKRRNADVIPGSGYVAPSAANPLYEAFGLLDAAAPADVDAFCARLDAPPHLRETVKAYAEKMHDVIVDVAGKLASSLGLAEHSFEDWPCQFRINRYNYTQDTVGSSGVQTHTDSGFLTVL

SEQ ID NO: 45088 - DNA, 676 bp, Panicum virgatum
  misc_feature: Ceres CLONE 2023328
  misc_feature: Encodes the peptide sequence at SEQ ID NO. 45089
aacacagactcgaatggggatcgcaacgacttctatttgagccaagcggcaccggctcgcccgcgcgcgcgctcccgtctcgtcacccccgaccagcgaccacgatgaagccgcccacgcccacctcctacctcctcctcgccccgctcgcgatcatcctcctcgtcttcgtggtccgccctccgtcccgcgccggctccgacggcctcggcgccctctgcgcgccgcgccggcttcgccgccgccggagcccgacttcagcctgctgatcggcgtcctcaccatgccgaaccggcgtgagcgacgggacatcgtgcggatggcctacgcgctgcagccgccggcggcgcgcgcgcgcgcggacgtccgcttcgtgttctgcagcgtgaccgaccccgtggacgcggcgctggtggcggtggaggcccggcggcacggcgacgtcgtggtgctggactgcgccgagaacatgaacgacggcaagacgtacgcgtacctctcctcggcgccgcggctcttcgcggcggcgccctacgactacgtgatgaagaccgacgatgacacgtacctgcgggtggcggcgctcgccgacgagctccggggccagccccgcgaggacgtgtacctgggctacggctacgccatgggcgggcagctgatgccgttcatgcacggc

SEQ ID NO: 45089 - protein, 130 aa, Panicum virgatum
  misc_feature: Ceres CLONE 2023328
  misc_feature: SWISSPROT Homolog: EC 2.4.1.134 Galactosylxylosylprotein 3-beta-galactosyltransferase
MPNRRERRDIVRMAYALQPPAARARADVRFVFCSVTDPVDAALVAVEARRHGDVVVLDCAENMNDGKTYAYLSSAPRLFAAAPYDYVMKTDDDTYLRVAALADELRGQPREDVYLGYGYAMGGQLMPFMH

SEQ ID NO: 45090 - DNA, 673 bp, Panicum virgatum
  misc_feature: Ceres CLONE 2023345
  misc_feature: Encodes the peptide sequence at SEQ ID NO. 45091
cagcccaagaagggaatctatccctctccatccagtccagactccagagaggcggagagagagagagacgagaggagtcgagagagattccgccgccgccaacctccgatgccgccgccgccgccgggcatgaccctctgccgcctccccacggccgccctcggcctccccctttctctcccttgtttgctatctcgtccccagctctccctcgccgcacgtcgcgccagggccgtcgccgccagggcctcctcctcctcctcctcctcaccggactcctccttcggctcgcggatggaggaatccgtcaagaagacagtggccgacaaccccgtagtcatctactccaagtcgtggtgctcatattccatggaggtgaaggcgctcttcaagcggattggcgtgcagccgcacgtcatcgagctcgaccatctcggcgctcaaggaccgcaactacagaaggtgttagagaggctgactgggcagtctactgttcctaatgttttcatcggtggaaagcatgttggtggctgtacagacactgtgaagctgcatcgcaagggtgagctagctagcatgctgtcggacctggatatcgacattaacaactcatgacaagatggagtgtggctcgcggagttgaggcttgagaaacttgggcagtcctgtattg

SEQ ID NO: 45091 - protein, 168 aa, Panicum virgatum
  misc_feature: Ceres CLONE 2023345
  misc_feature (76)..(139): Pfam Name: Glutaredoxin Pfam Description: Glutaredoxin
  misc_feature: SWISSPROT Homolog: EC 1.11.1.15 Peroxiredoxin
MPPPPPGMTLCRLPTAALGLPLSLPCLLSRPQLSLAARRARAVAARASSSSSSSPDSSFGSRMEESVKKTVADNPVVIYSKSWCSYSMEVKALFKRIGVQPHVIELDHLGAQGPQLQKVLERLTGQSTVPNVFIGGKHVGGCTDTVKLHRKGELASMLSDLDIDINNS

SEQ ID NO: 45092 - DNA, 745 bp, Panicum virgatum
  misc_feature: Ceres CLONE 2023357
  misc_feature: Encodes the peptide sequence at SEQ ID NO. 45093
ctctctccgcctcccccattcctcttcccctgcgatccgaggccgcacccgcagccgcagggaggagaagcgatcacctgatcaggcgaggcctcgcgatctcgcgcaggagcggagatggggctcacgttcacgaagctgttcagccgcctcttcgccaagaaggagatgaggatcctcatggttggtctcgacgcggctggtaagaccaccatcctctacaagctcaagctcggcgagatcgtcaccaccatccccaccataggatttaatgttgaaactgttgagtacaagaacattagcttcactgtttgggatgttggtggtcaggacaagatccgtcccctgtggaggcactacttccagaacatccagggcctcatttttgttgtggacagcaacgacagagagcgtgttattgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggtacatccagagcacatgtgctacctctggtgagggtttgtatgaggggcttgattggctttccaacaacattgccaacaaggcttgaggcatcttggcaggcctccaatgaatgaaatcgtttaatttctctacaggcttgaggcatcttggcagggctccaatggatg

SEQ ID NO: 45093 - protein, 181 aa, Panicum virgatum
  misc_feature: Ceres CLONE 2023357
  misc_feature (5)..(177): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLFSRLFAKKEMRILMVGLDAAGKTTILYKLKLGEIVTTIPTIGFNVETVEYKNISFTVWDVGGQDKIRPLWRHYFQNIQGLIFVVDSNDRERVIEARDELHRMLNEDELRDAVLLVFANKQDLPNAMNAAEITDKLGLHSLRQRHWYIQSTCATSGEGLYEGLDWLSNNIANKA

SEQ ID NO: 45094 - DNA, 1403 bp, Panicum virgatum
  misc_feature: Ceres CLONE 2023373
  misc_feature: Encodes the peptide sequence at SEQ ID NO. 45095
aagaaatctcagctctcaaggcccagaagaatggcggcatatgcgtctcgccgtgaccaacttcggttcacaacagacttcccaatcctacagtcctatctcaatcccgatgcaaacttgccaccaccacccgctcaccttgcacactcccttggcaaccttcagcagctcatggacgcgactgcacagctcctcgaggttgccttcgaaaacaaccagcaagagcgaatcacgattcttctcgagtttcagaaccagctcgagcagatccccgaccgagtcttccaagctcttggtcgtgaagtcccgtactcggagatcgagcttcaaattccccgctccagcgttgaggtcattcgcgagagtgccgagcctttaacgtccgacgcctcctcgacggagccattgagcgattccagcgatgacgactcgaccgagcttgaggaatcgtgtccgatctgtttcgacgactatccggtcaacgagatgcgttccctgctcggttgcggtgagcacaagtactgccacgagtgcatgagtcggcatctgtccacccttatcaacgactccgagctgaagaccctcacctgtccttatcccggttgtccagttgtgcctgccgagtatgaaattgagaacctggttgccgccgacacctacgaaaggtatttgcagtttgcagcggccgcgactttgcaaacagaacagggtacaaagtggtgtccagcctgcaaggaagccattatctgggatcccaatcagaagaaagtcgcgtgtccaggatgcaagcacgagttctgcttcgattgttcgaaaccctaccacgagggtcgacagtgcaacgaagctgttgtcgaagggactgatgatcctgatgctgcttttcaacaatggctcagggagaagggcgtcaaggttaaaccttgtccaaagtgccgagaaggcatcgagaaaaacgatggctgtaatcatatgacttgtcgtcagtgctcgcatcaatggtgctggctgtgcttgggcgattatcaaggcggtcatttcaacacaggaacctgtgatggcatgcagttcgctgcctatgactcgctcgaacaagcactcgaagctcaaggcttaacccgacaagaagctgaagatcgagctgaggcagagcgcatacgaagggaagcacaaaggctggctcgtgaagagtatgaacgctcacctgcaggtattcaggctcgtgaacgccgtgaaaagaatgccaagaagcgccgccgcaggaagaggatgaagaagatcgccaagtacacagcacttgcgcctctcattgttgttggtggtgcagtttgtctcggagcagttgttgtaattgcgcccatcgctattgttggaggggctctcagctcgtaaatttgaatcac

SEQ ID NO: 45095 - protein, 406 aa, Panicum virgatum
  misc_feature: Ceres CLONE 2023373
  misc_feature (164)..(223): Pfam Name: IBR Pfam Description: IBR domain
MDATAQLLEVAFENNQQERITILLEFQNQLEQIPDRVFQALGREVPYSEIELQIPRSSVEVIRESAEPLTSDASSTEPLSDSSDDDSTELEESCPICFDDYPVNEMRSLLGCGEHKYCHECMSRHLSTLINDSELKTLTCPYPGCPVVPAEYEIENLVAADTYERYLQFAAAATLQTEQGTKWCPACKEAIIWDPNQKKVACPGCKHEFCFDCSKPYHEGRQCNEAVVEGTDDPDAAFQQWLREKGVKVKPCPKCREGIEKNDGCNHMTCRQCSHQWCWLCLGDYQGGHFNTGTCDGMQFAAYDSLEQALEAQGLTRQEAEDRAEAERIRREAQRLAREEYERSPAGIQARERREKNAKKRRRRKRMKKIAKYTALAPLIVVGGAVCLGAVVVIAPIAIVGGALSS

SEQ ID NO: 45096 - DNA, 665 bp, Panicum virgatum
  misc_feature: Ceres CLONE 2023380
  misc_feature: Encodes the peptide sequence at SEQ ID NO. 45097
tataagggctaagtatgagactcaagattttttgaagccaagtttgcgcatttcttcaagatcatcgtttaaatccaccacttctacaaagagtgtggatagcagtttctctagcacttcaagaaaggatgtctctgaagatacgagagaatttgttggtgagctgaacattaccgtggtgaaaggtactaacttggccgtccgagatatgctaacaagtgatccatatgttgttttatcacttggagcgcagagagaacaaacgacggttaaaccgagtgatctgaatccagtatggaatgaggtgcttaagatatctgtacctcgaaatcatggacctctaaaactcgaagtgtatgatcatgatacattctctgccgatgatatcatgggtgaagcagagatagatctccagccaatgatcacagctgtcatggcctttggagatacttcacgccttggcgatatgcagattggaaggtggttcatgaccaaagacaacgccctggttaaagatagcactgtcaatgttgtggggggcaaggtaaaacaggaggtgcacctaaagctgcagaacgtagaatcaggtgagttggagttagaactggaatgggtcccgatctagactaccaatgataccttacctgatcgttgtctaatagcct

SEQ ID NO: 45097 - protein, 207 aa, Panicum virgatum
  misc_feature: Ceres CLONE 2023380
  misc_feature (55)..(134): Pfam Name: C2 Pfam Description: C2 domain
  misc_feature: SWISSPROT Homolog: EC 3.1.1.4 Phospholipase A(2)
IRAKYETQDFLKPSLRISSRSSFKSTTSTKSVDSSFSSTSRKDVSEDTREFVGELNITVVKGTNLAVRDMLTSDPYVVLSLGAQREQTTVKPSDLNPVWNEVLKISVPRNHGPLKLEVYDHDTFSADDIMGEAEIDLQPMITAVMAFGDTSRLGDMQIGRWFMTKDNALVKDSTVNVVGGKVKQEVHLKLQNVESGELELELEWVPI

SEQ ID NO: 45098 - DNA, 706 bp, Panicum virgatum
  misc_feature: Ceres CLONE 2023396
  misc_feature: Encodes the peptide sequence at SEQ ID NO. 45099
atcggtagtgttgaggttccaggcttttcagctgagcgttcgtcagtagccaagtgtgttcatcgctgctttcagttttcgcgagcgatttgatttgagcgatcgatttcgttctgctcgatcgtgtgttttagctcgagggtgagagatcgtcgtcatggcttcccaccaggacaaggctagctaccaggccggcgagaccaaggcccgcaccgaggagaaggctgggcaggcgatgggggcgaccaaagacacggcgcagcacgccaaggaccgggcgtcggacgcggcggggcacgcggcgggcaagggccacgacgccaaggaggcgaccaagcagaaggcgtccgacaccggcagctacctgggccagaagaccgacgaggccaagcacaaggccggcgagaccaccgaggccaagcacaaggccggggagaccaccgaggccaccaagcagaagaccgccgaggccaccgaggccgccaagcagaagaccgccgaggccctcgaggccgccaagcacaaggccggcgaggccggcgagtacgccaaggagagcgccgtcgccggcaaggacaaggacaagaccggcagcgtcatccagcaggccactgagcaggtgaagagcgcggcggtgggcgccaaggacgcggtgatgagcacgctggggatgagcggggacaacaaggagggcggcgccggcaac

SEQ ID NO: 45099 - protein, 182 aa, Panicum virgatum
  misc_feature: Ceres CLONE 2023396
  misc_feature: Functional homolog of the protein sequence given in SEQ ID NO 51080
  misc_feature: Useful for making plants with modulated water use efficiency
MASHQDKASYQAGETKARTEEKAGQAMGATKDTAQHAKDRASDAAGHAAGKGHDAKEATKQKASDTGSYLGQKTDEAKHKAGETTEAKHKAGETTEATKQKTAEATEAAKQKTAEALEAAKHKAGEAGEYAKESAVAGKDKDKTGSVIQQATEQVKSAAVGAKDAVMSTLGMSGDNKEGGAG

SEQ ID NO: 45100 - DNA, 1048 bp, Panicum virgatum
  misc_feature: Ceres CLONE 2023397
  misc_feature: Encodes the peptide sequence at SEQ ID NO. 45101
ggtacaacagcttgaaaccctcgcatctgttcgatttcctacttctactccatcggtctgctcttgcattcctgtgccctatcgttccccttcatctttccaaaaccacctccgaaccttgtcaaatcttgaccaactgatcaatccttccctcagatccacgtcttacccttcatctttcccacaaaagatcgattcagtcaagatgtctaaatcaaaccttaccctacagagctccgatggagaggatatcgttgttgagcgcgaagtcgcagagcgatcaattctcatcaagaacatggtcagcgatcttggagaagaagccatggacgaggccattccaattcccaacgtcaacgccgcagtcctcaagaaagtgatcgaatggtgcacccatcacaagcacgatccaccttcgaccaacgaggatgactccgactctcgcaagaagaccacagacatcgaagagtgggatcagaaattcatgcaagtcgaccaagaaatgctcttcgagatcatcctggctgccaactatcttgatatcaaggctctcctcgatgttggctgcaagaccgtcgcaaacatgatcaagggcaagtcacccgaggaaatccgcaagacattcaacattcagaatgatttcacccccgaggaggaagatcaaattcgtcgtgagaacgagtgggctgaggaccgatgagtacacgcacactatcacagtctacacttgcacagatcatcgggaggcgttgttgggtggctatgatgactgtttatgtattgaggtctaacgcgatggcgatatttgcttcctttccagaacttgcttctcgctgagtttcgagaccagcaaaacatgcctcatccgtgatgacgaacatggtaacgaagggaatgatatgatcgcgccggcaccgggtcactcttgatagccagtggcccaaggtgtcacatcctatggagcaatactgcttcaggaattaacttccatagacaatagcaccaaaatggagaaatagttgagaagcaccaatcagttcattgcatc

SEQ ID NO: 45101 - protein, 164 aa, Panicum virgatum
  misc_feature: Ceres CLONE 2023397
  misc_feature (86)..(163): Pfam Name: Skp1 Pfam Description: Skp1 family, dimerisation domain
  misc_feature (4)..(67): Pfam Name: Skp1_POZ Pfam Description: Skp1 family, tetramerisation domain
MSKSNLTLQSSDGEDIVVEREVAERSILIKNMVSDLGEEAMDEAIPIPNVNAAVLKKVIEWCTHHKHDPPSTNEDDSDSRKKTTDIEEWDQKFMQVDQEMLFEIILAANYLDIKALLDVGCKTVANMIKGKSPEEIRKTFNIQNDFTPEEEDQIRRENEWAEDR

SEQ ID NO: 45102 - DNA, 705 bp, Panicum virgatum
  misc_feature: Ceres CLONE 2023412
  misc_feature: Encodes the peptide sequence at SEQ ID NO. 45103
gattcagttccttccaccgttccacgcaaagaaacgccgccgccgccgccgccgccgccgccgtttgctagcctataaacccagcgttggcgatgtacggtgagatcccggactaccgctaccgcctcatcgactacgtgggcgacggcatcgtgatcggctcgtcgatcggaaccccctaccacttcaccaaggggttcctcaactctcccaatggcggacgcctcgccggcggcgtccgcgccgtccgcacggacgtgcctcgcttcgccggcaggctcgcgggtctcctggccgtgttctgggccctcgagagcggcatgtccctagcgggccgccgtttggaggatcactggaaccacctcgtcgccggcgccggcacctacgccctggccaacattcaccgcggcgtccccgccgccgcgcgctccgcgctcctcgccgccacggcgattgcggggttgtcggtcgccgatctgagctttgatttttggcatagccgactccttatgtccggccgtgaggtgggggagaagaacggcttgccagcgctggtacccagcaagcgcgtcgccccgtgccgggcggctctcagggatgcaccgggcggctccatcgaaaacaggtcagaaaatgatgcgatactggacctttttggcatggagcaggagtctgaaatgactcctaataaggatgtttaaagta

SEQ ID NO: 45103 - protein, 202 aa, Panicum virgatum
  misc_feature: Ceres CLONE 2023412
  misc_feature (3)..(131): Pfam Name: Tim17 Pfam Description: Tim17/Tim22/Tim23 family
MYGEIPDYRYRLIDYVGDGIVIGSSIGTPYHFTKGFLNSPNGGRLAGGVRAVRTDVPRFAGRLAGLLAVFWALESGMSLAGRRLEDHWNHLVAGAGTYALANIHRGVPAAARSALLAATAIAGLSVADLSFDFWHSRLLMSGREVGEKNGLPALVPSKRVAPCRAALRDAPGGSIENRSENDAILDLFGMEQESEMTPNKDV

SEQ ID NO: 45104 - DNA, 855 bp, Panicum virgatum
  misc_feature: Ceres CLONE 2023427
  misc_feature: Encodes the peptide sequence at SEQ ID NO. 45105
ctttttaatccatagtacatcatggctgttggcaagaacaagcgtcttagtaaaggaaagaagggtttgaagaagaaggtcgttgaccccttcacccgtaaggattggtacgatatcaaggctccttccatgttcgacgtccgtcaagtcggtaagactctcgtcaaccgtactcaaggtctccgtaacgccaacgactccctccaaggtcgtgtcgtcgagatgtctctcggtgatctctccaaggatgagtctcgttctttccgtaagatccaattgaaggttgatgaaatccaaggcaagaactgtcttaccaacttctaccgcatggatatgaccaccgacaagctccgttccatggtcaagaagtggcaatctttgattgaggctttcgttgatgtcaagactaccgatggttatcttgttcgtctcttcactgtctccttcacttctcgtcgtcgtaaccaaatcaagaagaccacttatgctcaagctgctcaaatccgtcaaatccgtaagaagatgtttgaaatcatgactgaggaagctgttgcttgtgatctcaaggaattggttgccaaggttacctcttctgcttctcaatctgctcaagatgctattgctgtccgtattgagaaggcctgtcaaggtatctaccctcttcaaaacacctacacccgtaaggtcaagatcctcaaggcacccaagtttgatgtctctgctctcttggcccttcacggtggtgctgctgctgctggtgatgacactggtgctaaggcctccaaggactttgttgaacccgctatccaagcctctgtttaaataacaatttaataaatttatagtacaacattt

SEQ ID NO: 45105 - protein, 266 aa, Panicum virgatum
  misc_feature: Ceres CLONE 2023427
  misc_feature (11)..(229): Pfam Name: Ribosomal_S3Ae Pfam Description: Ribosomal S3Ae family
MAVGKNKRLSKGKKGLKKKVVDPFTRKDWYDIKAPSMFDVRQVGKTLVNRTQGLRNANDSLQGRVVEMSLGDLSKDESRSFRKIQLKVDEIQGKNCLTNFYRMDMTTDKLRSMVKKWQSLIEAFVDVKTTDGYLVRLFTVSFTSRRRNQIKKTTYAQAAQIRQIRKKMFEIMTEEAVACDLKELVAKVTSSASQSAQDAIAVRIEKACQGIYPLQNTYTRKVKILKAPKFDVSALLALHGGAAAAGDDTGAKASKDFVEPAIQASV

SEQ ID NO: 45106 - DNA, 697 bp, Panicum virgatum
  misc_feature: Ceres CLONE 2023432
  misc_feature: Encodes the peptide sequence at SEQ ID NO. 45107
aagcgagcacaaccacaagagctactgtatctgagagcagagagcagagagcaggagctagcttctttaatttgtgcaaattaaaggagattcttcattagctactagctagtaccaataatggcggcgaccaagatctacatcgtgtactactcgacctggggccacgtcacggctctggcggaggagctcaagaagggcgccgagtccgtggacggcgttgaggtgaccgtgtggcgcgtcccggagaccctgccggaggaggtgctggggaagatgtacgcggcgcccaagcgcgaggaccacccggtgatcacggcgcggcagctggcggaggccgacggcctgctgctgggcttccccacgcggttcggcatgatggccgcgcagatgaaggcgttcctcgactccacgggcgggctgtggcaggagcaggccctggccgggaagcccgccggcttcttcttcgccaccggcacccagggcggcggccaggagtccaccgcgctcaccgccgtcacgcagctggcgcaccacggcatggtctacgtcccgatcggtggaaccttcggcgcgcgcatgttcggcatggacgaggtcaggggcgggagcgcctacggggccggcaccttcgccggcgccgacggcagcaggacgcccagcgagatcgagctcgccatggccaccaccaggggaa

SEQ ID NO: 45107 - protein, 192 aa, Panicum virgatum
  misc_feature: Ceres CLONE 2023432
  misc_feature (8)..(140): Pfam Name: Flavodoxin_1 Pfam Description: Flavodoxin
MAATKIYIVYYSTWGHVTALAEELKKGAESVDGVEVTVWRVPETLPEEVLGKMYAAPKREDHPVITARQLAEADGLLLGFPTRFGMMAAQMKAFLDSTGGLWQEQALAGKPAGFFFATGTQGGGQESTALTAVTQLAHHGMVYVPIGGTFGARMFGMDEVRGGSAYGAGTFAGADGSRTPSEIELAMATTRG

SEQ ID NO: 45108 - DNA, 601 bp, Panicum virgatum
  misc_feature: Ceres CLONE 2023437
  misc_feature: Encodes the peptide sequence at SEQ ID NO. 45109
gaggaaccaccagccatgtggcgccgcgcctcccagctcctcctcctccgcaccggcgccgccgccgcccggcgcctcccgcttccgcccccaccccggtcgctccccctcgcgcccacatgggtagcctcctacgccacccagtccgcggcggcgccggcgccggcgccggcgcggaggccgctgcggacggtgggatccctgctgcggctgaacgacctccgtgacaacccgggcgcgcggaagcagaagacgcgcaaggggcgcgggatcggctccgggaagggcaagaccgccggccgcgggcacaagggacagaaggcgcgcggcaccgccaggttcggcttcgagggcggccagaccccgctccgccgccgcctgccccggcgtggcttcaagaaccgcttctccctcacattccagccctgtggactggggaaaattgcaaagctcatcaatgctggaaaaattgattcctctgaactgatcacaatgaagacactgaaggaaacaggtgccattgggaagcaaataaaggacggaattcgcttaatgggtcgtggaacagaagaaatcaaatggccaattcaccttgaggtat

SEQ ID NO: 45109 - protein, 195 aa, Panicum virgatum
  misc_feature: Ceres CLONE 2023437
  misc_feature (64)..(163): Pfam Name: Ribosomal_L15 Pfam Description: Ribosomal protein L15 amino terminal region
MWRRASQLLLLRTGAAAARRLPLPPPPRSLPLAPTWVASYATQSAAAPAPAPARRPLRTVGSLLRLNDLRDNPGARKQKTRKGRGIGSGKGKTAGRGHKGQKARGTARFGFEGGQTPLRRRLPRRGFKNRFSLTFQPCGLGKIAKLINAGKIDSSELITMKTLKETGAIGKQIKDGIRLMGRGTEEIKWPIHLEV

SEQ ID NO: 45110 - DNA, 1444 bp, Panicum virgatum
  misc_feature: Ceres CLONE 2023439
  misc_feature: Encodes the peptide sequence at SEQ ID NO. 45111
tggcctgcaggcagaagagaagcagctgctactaacagagaggcaggaggagccatggggttcggcgtggtgtccctgctcaacgcggtgttccggcacaccaccatccacttctggacccacccctccctcctccagccctcctcggagcagcagcagccgctgccgccgcggccggtggttgtgctgatccacgggttcggcccggacccgacgtggcagtgggcggcgcaggcgggcccgctgtcccgccacttcgacctggtggtgcccacgctgctcttcttcggcgcctcctccacgcgcgcgcccgcccgctccgacgccttccaggccgccgccctcgccgcgctcctcgacggcggcggcggccacctcccgggcctcggcgccggccgcgccgtgcacgtggtgggcaccagctacggcgggctcgtggcgtaccacctggcccgggagctgcaccgccgcggcggcggcgcccgtgccgggaaggtggcgctgtgcgactcggacgcgtgcaagggcacggaggacgaccgcgcgctggcggcgaggaccggcgtggccgaggtgacggagctgctggcgccggccgacacccgggcgctgcggcggctgatggccgtctgcgcccaccgccccgtcaagtacatccccgagtgcctcctccgcgacatgctccggaagtacttcggggacaagagggaggataagatagcgctcatcaaagggatcaccaccggggaaggcttccagctcgctcctctgcctcaggaggttttgatcatctggggcgagttcgaccagatcttccctgtggagaaagcgcacaagatgaaagagaagctcgggaagaaggcgacggtgaaggtgatcccgaacacggggcacctgccgcagcaggaggatcccaagctcttcaaccaaatcctcctcgacttcctgctgcacccggccacatccaacggcagtgccgccgccgccgccaaatagcgcctagtattcgcgccgccttgatgttgtgtgcatccggtgatcgttcgtggagattctgtcttctccttttgttttcccagcctgttttgaaatgcagaggcaatgcagattgctgtgtgcctgtgttttaccaaggtgtagggagagagtttgcagccttgctttttttcagtttttttttctttttctttgcgagcaattgatattttggatcgatgtcacaaagaagctgcacataagaagcgtccataactccgctaccaatggggcgatttttctaaagaacacttttgggccctcttaggtgaaagccagcgagcccaccatgcattgatctatcgttgagccattcagtttgaatttttcttttaagtactaaacaaaaatcaagcgatttctttggaaatatatatgaagaacgaggagccagctcctttcgtctgtc

SEQ ID NO: 45111 - protein, 313 aa, Panicum virgatum
  misc_feature: Ceres CLONE 2023439
  misc_feature (68)..(296): Pfam Name: Abhydrolase_1 Pfam Description: alpha/beta hydrolase fold
  misc_feature: SWISSPROT Homolog: EC 2.3.1.12 Dihydrolipoyllysine-residue acetyltransferase
MGFGVVSLLNAVFRHTTIHFWTHPSLLQPSSEQQQPLPPRPVVVLIHGFGPDPTWQWAAQAGPLSRHFDLVVPTLLFFGASSTRAPARSDAFQAAALAALLDGGGGHLPGLGAGRAVHVVGTSYGGLVAYHLARELHRRGGGARAGKVALCDSDACKGTEDDRALAARTGVAEVTELLAPADTRALRRLMAVCAHRPVKYIPECLLRDMLRKYFGDKREDKIALIKGITTGEGFQLAPLPQEVLIIWGEFDQIFPVEKAHKMKEKLGKKATVKVIPNTGHLPQQEDPKLFNQILLDFLLHPATSNGSAAAAAK

SEQ ID NO: 45112 - DNA, 715 bp, Panicum virgatum
  misc_feature: Ceres CLONE 2023453
  misc_feature: Encodes the peptide sequence at SEQ ID NO. 45113
aaaaaaacaggccccctttgagccaaaccccggagaaaccctaggaaagctctcaggggcggcgcagcatccgcgacgaacgatggctggctaccgcagccggagtccgagccggagctatagccctcggaggcgatacagccggagccctcctaggcgcaagcgctacgacgacccccgcgaccgctaccgcgggggtgggggcggcggaggcggagcccggcgtgggtacggtcggccgtcggcgcagtccggtctcctcatccgcaacatctccatcacagccaggccagaagatattcgtgttccctttgagcaattcggccctgtaaaggatgtctatcttccaagaaacttccacaccagggaacttcgtggtttcggatttgtgaaattccgctaccccgaggatgctgcggtggccaagcaagagatgaatcatcaagttattggtggccgagagatttcaatagtttatgctgaagagaatagaaagacaccccaagaaatgcgcatgagaacaagaataaggtatatggacagaaggtacacaaggcgatcagtatctagatctccaagatctcattcccactgggcagggacagccgtgacaattactcccctggggggtcatactctccgcgtcctcagaaatacaggcactacaggtcaggtagtcgatctcccaagccagatgggtgcaaacctcaggtgt

SEQ ID NO: 45113 - protein, 210 aa, Panicum virgatum
  misc_feature: Ceres CLONE 2023453
  misc_feature (59)..(130): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAGYRSRSPSRSYSPRRRYSRSPPRRKRYDDPRDRYRGGGGGGGGARRGYGRPSAQSGLLIRNISITARPEDIRVPFEQFGPVKDVYLPRNFHTRELRGFGFVKFRYPEDAAVAKQEMNHQVIGGREISIVYAEENRKTPQEMRMRTRIRYMDRRYTRRSVSRSPRSHSHWAGTAVTITPLGGHTLRVLRNTGTTGQVVDLPSQMGANLR

SEQ ID NO: 45114 - DNA, 1174 bp, Panicum virgatum
  misc_feature: Ceres CLONE 2023459
  misc_feature: Encodes the peptide sequence at SEQ ID NO. 45115
ggttagaatgtaggagcagcgcgacgagctcgtctctatctaacgcgagattccaccagtgggaggctcacacttgcagctgcttgccgcggtaggtgcttctgcttagctgctcggggtcgccccaatggcgtccaaggcgtcgctcttccttgccctcaacctcgtgctcttcgtggtcaccaacgcctgcccttactgcggctcgggcaacaatggcggcggccacggcggcggccacgggggcagcgggagtcacggcggcagcgggagtcatgccggaggtggaggctacgggccgggtggcggcagtagcggcggcagctggggaggcaacaatggcggtggaggcaacggcggtgggtacggccccatcggtggcggcggtagtggtggcaacaacggcggcgggtacggccccatcggcggcggcggtggcgggataggccctattggtggaggaggcggagggatcggacccatcggaggtggcggtggcggtggtggtggtggcggcggcggcggcggcatcggaggaggcagcggcggcggcaacgacggcacgagcgggtggtacgggcactgcccgacgaacgcactgaagctgggcgtgtgcgccaacgtcctggacctaatcaaggcgaaggccggcgtccccgttgacgagaagtgctgcccgctgctgaacgggctggtggagctggacgccgccgtgtgcctgtgcacggccatcaaggccagcgtgctggggctcaacctcaacatccccgtcaacctcagcctcgtcctcaacttctgcggcaagggcgtccccacgggcttcaagtgcgcctaattaatcatgcaccctcatgcgcgggcgcacgcagcacgcgtccaagtgcgcggcaaagcacgtgacaaatttgcgcgcgtgccgacgtagtacgtgcatgatggggcgatattggtaataagcaagcttgtcatcatcgtttagttgcgattgcattattgttagtttcgtttttcagctagagactagagttaatcaagtcgtcagtgtagcatgtgtagctgcctttgcatttatgaggggtacgtgtggtgtccaggttcaagttcttgggtacttgtacttctgcatatttgaattcacattcagatttgattttataaaaatggtgcacagctc

SEQ ID NO: 45115 - protein, 235 aa, Panicum virgatum
  misc_feature: Ceres CLONE 2023459
  misc_feature (153)..(234): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 50702
  misc_feature: Useful for making plants with altered lignin content
MASKASLFLALNLVLFVVTNACPYCGSGNNGGGHGGGHGGSGSHGGSGSHAGGGGYGPGGGSSGGSWGGNNGGGGNGGGYGPIGGGGSGGNNGGGYGPIGGGGGGIGPIGGGGGGIGPIGGGGGGGGGGGGGGGIGGGSGGGNDGTSGWYGHCPTNALKLGVCANVLDLIKAKAGVPVDEKCCPLLNGLVELDAAVCLCTAIKASVLGLNLNIPVNLSLVLNFCGKGVPTGFKCA

SEQ ID NO: 45116 - DNA, 682 bp, Panicum virgatum
  misc_feature: Ceres CLONE 2023471
  misc_feature: Encodes the peptide sequence at SEQ ID NO. 45117
gcacagcactgcacaaccatctcacctccctcgccgtcgcctcccagatcttcacatggcgtcggagaagaagcagtcgaacccgatgcgggagatcaaggtccagaagctcgtgctcaacatctccgtcggcgagagcggtgatcgcctcacccgtgccgccaaggtgctcgagcagctgagtgggcagtcaccggtgttctccaaggcgaggtacactgtgaggtcgttcggcattaggcgtaatgagaagattgcgtgctacgtgacggtgaggggagagaaggcgatgcagctgctggagagtggcctgaaggtcaaggagtatgagctgctgaggaggaacttcagtgagaccggctgttttgggttcggtatccaggagcacattgatcttggcatcaagtatgacccatctactggtatctacggcatggacttctatgttgtccttgagcgtgctgggtaccgcgtggcgcgccgccgcaggtgcaagtcccgtgttggtattcagcacagggtcaccaaggaggacgccatgaagtggttccaggtcaagtacgagggtgtgatcctcaacaaggcccaagcctcctaggcatcacaagaagagcttttccaggcattagagcttgtgttacttaagtttatctggtggttgggtttttactagaagaaacag

SEQ ID NO: 45117 - protein, 180 aa, Panicum virgatum
  misc_feature: Ceres CLONE 2023471
  misc_feature (66)..(165): Pfam Name: Ribosomal_L5_C Pfam Description: ribosomal L5P family C-terminus
  misc_feature (9)..(62): Pfam Name: Ribosomal_L5 Pfam Description: Ribosomal protein L5
MASEKKQSNPMREIKVQKLVLNISVGESGDRLTRAAKVLEQLSGQSPVFSKARYTVRSFGIRRNEKIACYVTVRGEKAMQLLESGLKVKEYELLRRNFSETGCFGFGIQEHIDLGIKYDPSTGIYGMDFYVVLERAGYRVARRRRCKSRVGIQHRVTKEDAMKWFQVKYEGVILNKAQAS

SEQ ID NO: 45118 - DNA, 704 bp, Panicum virgatum
  misc_feature: Ceres CLONE 2023476
  misc_feature: Encodes the peptide sequence at SEQ ID NO. 45119
ccaaatccatctgataggggagctaatcacatcacagcgatgccgctctgcagcttctacgcctccacctccctccccgtcgccaagccgcagcagtccgtcgcgtcctctaagccccactccaccgccgcggcctccgtggcgacaaccgtgccgacgcgcggcgcgacgacgacaacggcgacgactgtgtccacggccacggcggcgctgtcgctgcaccttcccgagctgtcgtcgcaggtgaaggacaagatcctgagcctggagctgatgggcgtggactacgggcgcgcgctggagctgaaccctgcgctccgcgacgcggcgccggagtccatccacgcggtggtgtccttcctccagtcccgcgggctccacttcaaggacctcggccgcgtcttcggcatgagcccgtccgtgctcaccgccagcgtccgcggcgacctccgccccgtcttcgccttcctcgccgaggacctcggcgtcccggagtccgcgcaccgccgcgtcgtcgtcaagtgcccgcgcgtgctcgcctgcagcgtccgcgaccagctccgccccgcgctcatctacctccgccgcctgggcttccgggacacccgcgcgctggcgctgcaggacccgatcctcctcgtctccagcgtggagcgcaccctggcgccgaagctcgagttcctggccgggctcggcatgtcccg

SEQ ID NO: 45119 - protein, 221 aa, Panicum virgatum
  misc_feature: Ceres CLONE 2023476
  misc_feature: Functional homolog of the protein sequence given in SEQ ID NO 51701
  misc_feature: Useful for making plants with altered terpenoid content
MPLCSFYASTSLPVAKPQQSVASSKPHSTAAASVATTVPTRGATTTTATTVSTATAALSLHLPELSSQVKDKILSLELMGVDYGRALELNPALRDAAPESIHAVVSFLQSRGLHFKDLGRVFGMSPSVLTASVRGDLRPVFAFLAEDLGVPESAHRRVVVKCPRVLACSVRDQLRPALIYLRRLGFRDTRALALQDPILLVSSVERTLAPKLEFLAGLGMS

SEQ ID NO: 45120 - DNA, 696 bp, Panicum virgatum
  misc_feature: Ceres CLONE 2023495
  misc_feature: Encodes the peptide sequence at SEQ ID NO. 45121
ggtgcgagacccggaggagttcctgaacaagaagaaggacaagcacaagggcaagagcaaggacaagaagtccaagagcaaggcgttcaacttctactccggcaagcccgacgtccacaactgctacgggtggagccggacgatgaccaacaaggacctcgacgccctgcacggctccgacattggcatgttcatggtgaacctcaccacgggttcgatggtggggcctcactggaaccccaaggcgacggagatcgccatcgtgacggacggcacggggatcgtgcagacggtgtgcccgagcagcagcggcagcagcagcccgcagtcggacgagagcaggagaggccaccgcggcgacgagcgcggcgggccgggcgggcgcggcgacgagggaggcgaaggcggcggcgcgcggtgcaggagctcggtgttccgggtgaaggaaggcgacgtgttcgtggtgccgcggttccacccgatggcgcacatgtcgttcaacaacgactcgttcgtgttcgtggggttcagcacccacatgggcgagaaccacccgcagttcctggccgggaaggggtcggtgctgcaggccatcggcaaggaggggctggcgttgtcgctggggcagccgaactcgacggccgtggagaaactgctgtccgcgcagcgggactcgaccaacctgtcgtgcatctc

SEQ ID NO: 45121 - protein, 231 aa, Panicum virgatum
  misc_feature: Ceres CLONE 2023495
  misc_feature (29)..(215): Pfam Name: Cupin_1 Pfam Description: Cupin
VRDPEEFLNKKKDKHKGKSKDKKSKSKAFNFYSGKPDVHNCYGWSRTMTNKDLDALHGSDIGMFMVNLTTGSMVGPHWNPKATEIAIVTDGTGIVQTVCPSSSGSSSPQSDESRRGHRGDERGGPGGRGDEGGEGGGARCRSSVFRVKEGDVFVVPRFHPMAHMSFNNDSFVFVGFSTHMGENHPQFLAGKGSVLQAIGKEGLALSLGQPNSTAVEKLLSAQRDSTNLSCI

SEQ ID NO: 45122 - DNA, 742 bp, Panicum virgatum
  misc_feature: Ceres CLONE 2023496
  misc_feature: Encodes the peptide sequence at SEQ ID NO. 45123
aagggcttcgatccgatccgagctctcgacgagttcaacttcttcaccgcgcctcctgatcgatcgtctcctcatctccacgacaagccatcgaaacccttcttgccctaacttcagatcagctacctagctagctacctgctgctttgatcctttcagcaccttattagcttcgtcctcccatcgagccgccgatgactcctgccgtcccccaagagccatgagcaacgccagcaacagcaagaagcatagcctcctcgcgccaaaggccaccatggacatgtctcgcctgcaccaggcctacgaccgcggctagcttagctcgctcgctccaccatctctagctagctataggttctgctttgtcctttgctgaacgtcgatcgctggtctagtgccttagcgtgagaaattcgtagctattagcaacgatgaaggaagggggcgagaagaagaacatcctggccaagacgctccagcggtgccggacctcgctggcccaccggaggcgcccgccggcgccccccgacagggcggcggcgtcgtcgtggggcgccgtgccggcggccggctacttcaccgtgctggtgggcccggagaaggagcggttcggcgtgcgcgcgcgctgcgccaaccacccgctgtttcgggcgctgctggacgaggccgagaccgagtacggcttcgccggctgcgacgggccgctcgagctgccctgcgccgtcgacgacttcatggaggt

SEQ ID NO: 45123 - protein, 103 aa, Panicum virgatum
  misc_feature: Ceres CLONE 2023496
  misc_feature (4)..(103): Pfam Name: Auxin_inducible Pfam Description: Auxin responsive protein
MKEGGEKKNILAKTLQRCRTSLAHRRRPPAPPDRAAASSWGAVPAAGYFTVLVGPEKERFGVRARCANHPLFRALLDEAETEYGFAGCDGPLELPCAVDDFME

SEQ ID NO: 45124 - DNA, 681 bp, Panicum virgatum
  misc_feature: Ceres CLONE 2023522
  misc_feature: Encodes the peptide sequence at SEQ ID NO. 45125
  misc_feature (588)..(588): n is a, c, t, g, unknown, or other
agggcagctagatcaagcctttcatcactcctcccagagctcgcccaaactaaccccatggccaatctcgaaatcatccgatcccctttgcctgaggagaacaacaacttcaacttcagcaacctctacctgttccacacccctctgggtccaaacaggaaccaatttggagtgacaagctcggattccgctaccggtctgggttcgatcatcgtcaacaactggcccatatacgatggagctggcccaaacgccgccattgttgcccgtgcacaaggcatgcatgtctatgctggtaactggaacaatgttttcagcatagtcttcgagattcagaggtttaaggggtcaacgcttcaggtgatgggtatctcggttgaaaatggtgagtttgcaatcgttggtgggacgggtcagtttgccatggcaagcggtgtcatctacaagaactttcatgagcaaaggagcgatggcaacatcatacgactgaccatccagggatcctcccccctgctgaaagggtggtcgccaccgccgagccaggtcacaaagattgggccattgggtggagatggtggggtggctcangacataacagacacaccagggcgtccagaaagtatcactgtgcagagtggtgtggttgttgatgcgatctcattctcatatgctgaccaagct

SEQ ID NO: 45125 - protein, 207 aa, Panicum virgatum
  misc_feature: Ceres CLONE 2023522
  misc_feature (2)..(152): Pfam Name: Dirigent Pfam Description: Dirigent-like protein
  misc_feature (177)..(177): Xaa is any aa, unknown, or other
MANLEIIRSPLPEENNNFNFSNLYLFHTPLGPNRNQFGVTSSDSATGLGSIIVNNWPIYDGAGPNAAIVARAQGMHVYAGNWNNVFSIVFEIQRFKGSTLQVMGISVENGEFAIVGGTGQFAMASGVIYKNFHEQRSDGNIIRLTIQGSSPLLKGWSPPPSQVTKIGPLGGDGGVAXDITDTPGRPESITVQSGVVVDAISFSYADQ

SEQ ID NO: 45126 - DNA, 847 bp, Panicum virgatum
  misc_feature: Ceres CLONE 2023527
  misc_feature: Encodes the peptide sequence at SEQ ID NO. 45127
ctttcatagaaccaaattcgttcgttgacgaaaaaaaaaaaaaaaaccgataagttccgcaacaccgctaaatcgcccaccaacaaactactgctcatacccgcgcaccttcgctctcctgcggcttccttcatttcatcagcccgtttgcatcacaaaaaccccgcgcccatcatgtcctggcaagcctacgttgacacgagcctggttgccaccggccacgtccagaaagcctgcatcgctagcatcgccggcgacggcatctgggcaaattcgcctggtttcgcgatcagccccgatgagctcaagaccatcagccaaattatcaaggagctcggcgcggactcgaccccgatgctagaccatgcccgagctgaaggcatctacgtcgctggtgtgcgctacgtggtcgcgggaggcgcagaacagggcatctatgcccgcaagggcaaggagggtgtctacatcgcaaagtcgaatcaggccatcatcattacctggcacgacgagaacacttttgccggcaacgcgtcatcggtgaccgtgaacctcgttaaatatctaaccggcgtgggttactaaggttggtcggcctttttttaggcggatggtggtcgaggggcggtcgagtgggagttttctaggatggatggatatatgagaattcatacaaggccagccttctttcatccatgactcggaggagcaactgttaggacataacatatccgaccagcggtgtagagggagacagacggtgtgtcgtcatggccaaagggaaggccagaaggcttgatttactgatgccgcggggatgctttcatagaaccaaattcgttcgttgacg

SEQ ID NO: 45127 - protein, 135 aa, Panicum virgatum
  misc_feature: Ceres CLONE 2023527
  misc_feature (2)..(130): Pfam Name: Profilin Pfam Description: Profilin
MSWQAYVDTSLVATGHVQKACIASIAGDGIWANSPGFAISPDELKTISQIIKELGADSTPMLDHARAEGIYVAGVRYVVAGGAEQGIYARKGKEGVYIAKSNQAIIITWHDENTFAGNASSVTVNLVKYLTGVGY

SEQ ID NO: 45128 - DNA, 711 bp, Panicum virgatum
  misc_feature: Ceres CLONE 2023540
  misc_feature: Encodes the peptide sequence at SEQ ID NO. 45129
tggcagtgatctttgttatccatcttcaagctctgaagacatgcttagccctgctgagctcccattcatgattgatcttgattatcacactcaaattgaatatcgttggggtggagaaggtttaaggaagacactaattcgttgggcagctgaaaaaaacagtgaaagtggacaaaatgtaattgttgaggatgaggaaagttcatccacttattgcatttcatttaaagtgacgaatactgaggctgcatcacctgtgaaagagattaggcggacaatgagaattcaagccctgcgctgtcatgttttgtacagccatgatggcagcaagctgaatgttattcctgttttagcttctcgctcgcaggctttaaggtatctgtatataagatggggtgtcgagctgtcaaacatgacagtggttgttggtgaaagtggtgacacagattatgaaagtttacttggaggtgtgcacaagaccatcatactcaaaggctcgttcaatgctgttccaaaccaagttcatgctgctaggagttattccttgcaagatgttgtatcctttgagaaaccaggacttgcttcagttgagggatatggtccagacaacctaaaatcatctctacagcaatttggtatattgaaagactaaaatttttgatttgtcggtcagcagaggaatcaaactaattaggatcggcgagaggactg

SEQ ID NO: 45129 - protein, 216 aa, Panicum virgatum
  misc_feature: Ceres CLONE 2023540
  misc_feature: SWISSPROT Homolog: EC 2.4.1.14 Sucrose-phosphate synthase
  misc_feature: Functional homolog of the protein sequence given in SEQ ID NO 51702
  misc_feature: Useful for making plants with altered cell wall content and/or composition
  misc_feature: Functional homolog of the protein sequence given in SEQ ID NO 50680
  misc_feature: Useful for making plants with modulated biomass
  misc_feature: Useful for making plants with modulated carbohydrate content
GSDLCYPSSSSEDMLSPAELPFMIDLDYHTQIEYRWGGEGLRKTLIRWAAEKNSESGQNVIVEDEESSSTYCISFKVTNTEAASPVKEIRRTMRIQALRCHVLYSHDGSKLNVIPVLASRSQALRYLYIRWGVELSNMTVVVGESGDTDYESLLGGVHKTIILKGSFNAVPNQVHAARSYSLQDVVSFEKPGLASVEGYGPDNLKSSLQQFGILKD

SEQ ID NO: 45130 - DNA, 704 bp, Panicum virgatum
  misc_feature: Ceres CLONE 2023558
  misc_feature: Encodes the peptide sequence at SEQ ID NO. 45131
atctggcccgtgagaggctacgacgctccaccgcgctgtagcagatggaaccatcgcgcccccgcgtgttcctgcacagcctctggctctgatcaccagtaaaggcattctcaacgcgtcgagaaagtggcttagcttgcagttgggtcctgttctaggccgtgctaatcagctctcaccttaagcatcagctaaaacctctagctcgatgcggacgctctatataaaccctccctctctgctcccatccatcccattccatcccttgctacctgcatccatcgaccttagcgagctcacagttcaatcaggtccggttcggcttcaggctgggctcgtcaccgaggagatggcgctctctcgccgcatggccgcgccggtcctcgtcttcctgctcctcctcgtcgccacagcagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcct

SEQ ID NO: 45131 - protein, 81 aa, Panicum virgatum; identical to SEQ ID NO: 14095
  misc_feature: Ceres CLONE 2023558
  misc_feature (33)..(81): Pfam Name: Gamma-thionin Pfam Description: Gamma-thionin family

SEQ ID NO: 45132 - DNA, 680 bp, Panicum virgatum
  misc_feature: Ceres CLONE 2023561
  misc_feature: Encodes the peptide sequence at SEQ ID NO. 45133
tcacttgcttcgcttctcatttccatggcctccgacgctgccaacgccgcgattccttcgggtcccgtcccgttcaaggacgtcgacgacggcacggtcccagagcacacacccaaggaggagttcggcgacctcgtggcggcgctgccgcggcggcagcagtccatccttgagctgcgcctgtaccagggcttctggctgccggagcattgggtgccgggcaccatcgtgttccagcgccgcttcgcgccgcgccccgacgacgtggtcctcgccagctaccccaagtgcggcaccacgtggctcaaggcgctggccttcgccgccgcggcgcgcggcgcgcacccgcccgccggcgccgggcacccgctccgccggctcaacccgcacgactgcgtcccgttcgtcgacgagatcttcgcgtccggggaggaggccaagctggacgcgctcccgtcgccgcggctcatgaacacgcacctgccctacacgctgctgccggccccggtcaccggcggcgggtgccgggtcgtgtacgtgtgcagggaccccaaggacatggtggtctcgctgtggcacttcctccggcgcgccaagccggacctctcgttcgacgagacgttcgagtccgtctgcgacggcacggtggcggccggcccggtctggggacacgtcctctc

SEQ ID NO: 45133 - protein, 218 aa, Panicum virgatum
  misc_feature: Ceres CLONE 2023561
  misc_feature (78)..(218): Pfam Name: Sulfotransfer_1 Pfam Description: Sulfotransferase domain
  misc_feature: SWISSPROT Homolog: EC 2.8.2.1 Aryl sulfotransferase
MASDAANAAIPSGPVPFKDVDDGTVPEHTPKEEFGDLVAALPRRQQSILELRLYQGFWLPEHWVPGTIVFQRRFAPRPDDVVLASYPKCGTTWLKALAFAAAARGAHPPAGAGHPLRRLNPHDCVPFVDEIFASGEEAKLDALPSPRLMNTHLPYTLLPAPVTGGGCRVVYVCRDPKDMVVSLWHFLRRAKPDLSFDETFESVCDGTVAAGPVWGHVL

SEQ ID NO: 45134 - DNA, 643 bp, Panicum virgatum
  misc_feature: Ceres CLONE 2023562
  misc_feature: Encodes the peptide sequence at SEQ ID NO. 45135
ggcctcccactgcccacatgcgcgcacactccacactcctccctagctgcatttccggcgagcagagctgagctccgatccgtcaccagtagtctcagaccagctccgaacccaactagccaccaccagtaggtgtagtgtaggtcgccatgagcaaggagaagcaccaccgcgactggatcctccggcgctgctgcgccgccgtctgcgcctgcgtcctcacgctcgccgccgtcgtgggcttcatcgtgctcgtcatctacctggcgctccgcccctccaagccctccttctacctccaggacgtgcagctccgctccatcgacctcagcgaccccgcgctctccctcaacctccaggtgacggtcgcgtcgcgcaacccgaacgagcgcgtgggcgtctactacaagaccctggacgcgttcgcgacgtaccgggacgagccggtgacggtgccggtggcgctgccggccatctaccagggccacaaggacgcgtcggtgtggtcaccggtgctgtcgggggagtcggtgcccgtggcggcgtacgcggcggacgccatgcggcaggacatcgcgggcgggtacgtgctgctccacgtcccgggtggacggccgcgtcaagtggaaagtcggaagctggg

SEQ ID NO: 45135 - protein, 164 aa, Panicum virgatum
  misc_feature: Ceres CLONE 2023562
  misc_feature (38)..(163): Pfam Name: Hin1 Pfam Description: Harpin-induced protein 1 (Hin1)
MSKEKHHRDWILRRCCAAVCACVLTLAAVVGFIVLVIYLALRPSKPSFYLQDVQLRSIDLSDPALSLNLQVTVASRNPNERVGVYYKTLDAFATYRDEPVTVPVALPAIYQGHKDASVWSPVLSGESVPVAAYAADAMRQDIAGGYVLLHVPGGRPRQVESRKL

SEQ ID NO: 45136 - DNA, 1472 bp, Panicum virgatum
  misc_feature: Ceres CLONE 2023587
  misc_feature: Encodes the peptide sequence at SEQ ID NO. 45137
cttgtcgacaaccacagacactttgttcaccaagtagcaaagatgtctcaccgaaagttcgaagcaccgcgacacggttcgcttgctttcctcccccgaaagagagcagcaagacaccgaggaaaggtcaagagctttcctaaggatgacccaaagaaacctgtccatcttaccgcatccctgggctacaaggccggtatgaccaccatcgtccgagacctcgatagaccgggtgcgaagatgcacaagaaagaagtcgtcgaagccgtcactgtcattgagactcctccattgatcgttgtcggtctcgttggctatatcgagactccccgcggtctccgatccctcaccaccgtctgggccgagcatcttagcgacgaagtgaagcgtagattctacaagaactggtaccgatccaagaagaaggctttcaccaagtacgcaaagaagcactccgagaacaagggctcctccgtcacccgcgagcttgagcgcatcaagaagtacgctactgtcgttcgtgttctcgcccatacccagatccgtcaaacccctctcaagcaaaagaaggcacacttgatggagattcagatcaacggtggcagcgttgcagacaaggtcgccttcggccatggtctgttcgagaaacccgttgagatcgataccatcttcgagcaagacgaggttattgatgccattgctgtgaccaagggtcatggtttccagggtgtcaccagcagatggggaacgaagaagttgccgagaaagacacacaagggtctccgaaaggtcgcttgtatcggtgcttggcatccttctcacgtccaatggactgtcgctcgtgctggtcaagatggttaccatcatcgtacctcagtcaaccacaagatctaccgtatcggtaagggcagtgacgagaagaacgccgccacagagttcgatgttgtcaacaagcaaatcacacctctgggaggattcgtccactatggtgaggtcaagaacgacttcgtcttgctcaagggctccgttcctggtgtcaagaagcgagtcatcactctccgtaaatctctctacacccacacttctcgcaaggcccttgagaaggtcgacctcaaatggatcgacacctcgtccaaattcggtcacggtgcctaccagactccacaagagaagagacaattcttgggtacgctcaagaaggatctcgctcctgcttcttagagtttgttttatcttgcgtgagggttgccgggggggttgcagagaacgaaagtggatatgatgctaggatgatgtgttccgttaactggcacagcatctacaatagcaatgacaacaaaagctcaagagataccaaaggtgtttcaattgttcgctcttaagatttgttttcttccgtgagcggactgctactactcctagcatagcaatggtagctaaagggaaatgaatcaaaacgaaattccaaagtt

SEQ ID NO: 45137 - protein, 392 aa, Panicum virgatum
  misc_feature: Ceres CLONE 2023587
  misc_feature (50)..(340): Pfam Name: Ribosomal_L3 Pfam Description: Ribosomal protein L3
MSHRKFEAPRHGSLAFLPRKRAARHRGKVKSFPKDDPKKPVHLTASLGYKAGMTTIVRDLDRPGAKMHKKEVVEAVTVIETPPLIVVGLVGYIETPRGLRSLTTVWAEHLSDEVKRRFYKNWYRSKKKAFTKYAKKHSENKGSSVTRELERIKKYATVVRVLAHTQIRQTPLKQKKAHLMEIQINGGSVADKVAFGHGLFEKPVEIDTIFEQDEVIDAIAVTKGHGFQGVTSRWGTKKLPRKTHKGLRKVACIGAWHPSHVQWTVARAGQDGYHHRTSVNHKIYRIGKGSDEKNAATEFDVVNKQITPLGGFVHYGEVKNDFVLLKGSVPGVKKRVITLRKSLYTHTSRKALEKVDLKWIDTSSKFGHGAYQTPQEKRQFLGTLKKDLAPAS

SEQ ID NO: 45138 - DNA, 702 bp, Panicum virgatum
  misc_feature: Ceres CLONE 2023591
  misc_feature: Encodes the peptide sequence at SEQ ID NO. 45139
actccccgccccggcaccgtcactccaaccacagcagcagctagcgaccggtctcactctcagcaatcgcctcacgcaatggccgcctccaccatggcgatctcctccccggcgatggccggcacccccatcaaggtgggctccttcggcgagggccgcatcaccatgcgcaagaccgcggccaagcccaaggtggcggcgtccggcagcccatggtacggtcccgaccgcgtcaagtacctcggccccttctccggcgagcccccgagctacctcaccggcgagttccccggcgactacggctgggacaccgcggggctgtccgctgaccccgagaccttcgccaagaaccgcgagctggaggtcatccactcccggtgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctcatccacgcccagagcatcctcgccatctgggccgtccaggtcgtgctcatgggcgccgtcgagggctaccgcattgccggcggcccgctcggcgaggtcgtcgacccgctctaccccggcggcagcttcgaccccctcggcctggctgacgaccccgaggccttcgccgagctcaaggtc

SEQ ID NO: 45139 - protein, 207 aa, Panicum virgatum
  misc_feature: Ceres CLONE 2023591
  misc_feature (61)..(207): Pfam Name: Chloroa_b-bind Pfam Description: Chlorophyll A-B binding protein
MAASTMAISSPAMAGTPIKVGSFGEGRITMRKTAAKPKVAASGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELK

SEQ ID NO: 45140 - DNA, 1072 bp, Panicum virgatum
  misc_feature: Ceres CLONE 2023594
  misc_feature: Encodes the peptide sequence at SEQ ID NO. 45141
cacttcgccgtccaaccggcggcggccgcaccaccgctccggaaagggacgctctcgtagctcggcggcgaggtcggccggcggaggaggaaccccgaagatgtggtgccagtcgtgcaaggaggagtacgaggtggaggacgcgggcacctgcaaggagtgctacgaggaggccagcgagacggaggaggagctcaagcgcgagatcgacgacctccgagcccgcctcctcttcctccgcctcccctcccccaccctcgacgccgcgtccgccccgcactccgacctcctcctccacgccatcccctcctgctcctcctccggcgcgggaggcgacggcggcgacgccgcgcgcgcaccatacacacccgccgtccccgcccaccgcgtcatcctcgtaagcagatctcctgttttcagagcgatgcttgagaatgagatggaagagagcaggagtggcatcatcaaaatctttgatgtgtcctatgacgtgcttcgtgcttttgtccattacatgtacacagcagaagctcttctagatgagcaaatggcatctgacctcttggtgttggctgagaagtatgaagtaaagcacctgaagacctactgtgagaagttcataacatccaaagtgaacaatgaaaatgccattgcccactacgcatttgcacatcgccacagtgcaaaacagctgctggaggcctccctttctgtgctcatggacaatatgtccacactagcagatcgggaagaatacaaggagcttgttgagaaggacccgaggcttgtcgtggagatctatgaagcctatctcaaccgacaagtcaacactgcggctgggaaggacacagattgctgtagcaggaaatgatgattacgagcagaactattgtagtattagtattctaacaatgcgtatgtgtattcatggaagcaaaacttaaacatcaaattctactgcttgcttagatgcacactgctatctttttagatgataatcaattagacatgttgctggtgacagcatgcccaactgctcataatgaaatgtgatgtaatggcatcttgacgt

SEQ ID NO: 45141 - protein, 256 aa, Panicum virgatum
  misc_feature: Ceres CLONE 2023594
  misc_feature (53)..(178): Pfam Name: BTB Pfam Description: BTB/POZ domain
MWCQSCKEEYEVEDAGTCKECYEEASETEEELKREIDDLRARLLFLRLPSPTLDAASAPHSDLLLHAIPSCSSSGAGGDGGDAARAPYTPAVPAHRVILVSRSPVFRAMLENEMEESRSGIIKIFDVSYDVLRAFVHYMYTAEALLDEQMASDLLVLAEKYEVKHLKTYCEKFITSKVNNENAIAHYAFAHRHSAKQLLEASLSVLMDNMSTLADREEYKELVEKDPRLVVEIYEAYLNRQVNTAAGKDTDCCSRK

SEQ ID NO: 45142 - DNA, 1125 bp, Panicum virgatum
  misc_feature: Ceres CLONE 2023596
  misc_feature: Encodes the peptide sequence at SEQ ID NO. 45143
aaacccaccacctctccggcgctcgccttacccgtcaccgtgcgcctcggccgccgccgccgccgccgccgcactgttgttcgcgcgcaaacagctgtcataccgtccacggccatccgcttcctctccaagcggtggggtcccgctgtactcgcctctcaccggcacccagggttcgatcaggtgcggagactgtgaaggaggaggcggagcgcaaatatggcggatttccggacctcctcgcaccgggaaaggtggatcttccagccacacgatctgacggagaggtgggcggcggcgaaccagcgggccacggagaccctcgcgcagtatgggacgacgcggctgaaggtccttgatggcttggtccattcaccggatcatgttgaggttagttcggatgtaaagcctctgtcttacgaagaggagcaattgacacgagtattttacgagcagaagattcaagaagtatgtgcagcattcaaattccctcacaaaatccaggctacagctataacatatttcaagagattctatctacagtggtctgttatggagcatcacccaaagcatattatgttaacatgtgtatacacttcttgcaaagtagaagaaaaccatgtttctgctgaggaacttggtaaagggattcagcaggaccaccagatcattctagataatgagatgatccttcttaagactttagattttgatctcattgtttatgcaccatatcgatctattgaaggatttgttgatgacttggaaggtttcttcagggaagataatagtgcattacagcgtttgaaggagttacatcacaccgccatatcctatgctgacaaaatgatgttgactgatgctcctcttctgtatactccagggcagttggcactggctgctttgcacaagtccaatgatattctcaaggtcttcaattttgaaagatacttggaaactatcttctcaaggcaaaattctgattgtaccgtcgaacagtttgttcagtcaatcaatgcaagtcattacttggttgaccagcttaaaatacctactgttaaggatatgaggcacgttgaccgcaagctgaaacattgttgggatcgaagctctcatgatgagcat

SEQ ID NO: 45143 - protein, 301 aa, Panicum virgatum
  misc_feature: Ceres CLONE 2023596
  misc_feature (61)..(167): Pfam Name: Cyclin_N Pfam Description: Cyclin, N-terminal domain
MADFRTSSHRERWIFQPHDLTERWAAANQRATETLAQYGTTRLKVLDGLVHSPDHVEVSSDVKPLSYEEEQLTRVFYEQKIQEVCAAFKFPHKIQATAITYFKRFYLQWSVMEHHPKHIMLTCVYTSCKVEENHVSAEELGKGIQQDHQIILDNEMILLKTLDFDLIVYAPYRSIEGFVDDLEGFFREDNSALQRLKELHHTAISYADKMMLTDAPLLYTPGQLALAALHKSNDILKVFNFERYLETIFSRQNSDCTVEQFVQSINASHYLVDQLKIPTVKDMRHVDRKLKHCWDRSSHDE

SEQ ID NO: 45144 - DNA, 1491 bp, Panicum virgatum
  misc_feature: Ceres CLONE 2023607
  misc_feature: Encodes the peptide sequence at SEQ ID NO. 45145
tggcagaaacggtgggcccagctttcagtcaccgcgtagaaatttcccctttccatccgccggccggcctacgagcggacacctctctcgtctccccgacctccggaagtgaatccgccgctccctcgccgccggcgacgaaaccgcaggcgcgggaagaaccgcgaatggagggtgcggtgacggagaatgcggaggcgcccgtgggcgcggctgccccggaaacggctgtccacgcggatccgcgcggggagggtggcgcggtggtggaggactcggcggcgcccacggcggcgatagaggaaacttctgacgcggatcagattatcgaggatgcaggcccggaggacgggaggcacggggagacagtgacaaatgtagatgtcagtcctgaggaaatgagaagcatcattgaagtcatagctgagacaggaaaattctggcatgactgggatttcctcaagagcttactgtctctccaattgaagcaggtcttggatgaatattctgaggctcaaatggtgagccaagatgatgtacagcaacagaggtctttttcaggggagacatactctgagcttgttagccgacttagtgatgccctctgcaggtttgaagagggccctccattcacactgcaaaggctttgtgagattttgttgaatccaaaaggaacttatacaaaattgtcaaagcttgctttggccttggagaagaatctcctagtcacatctacaatagccaagtccaccgacccatatccagctgctcatgggccaccaagttcggattgcacacaaattacagataattctggccctgttgatgaagagcctgagagcacacctgagcatactacagcagtaccaaatggaacggagcatttagcaggagatggtgatgaagagatggctgatgcagaagctgaggaagtgtctggtagccgcgatgtagagatgcaggaggacaagcctgatcaggttgaaaatgttagctccaatgctaaccctgctgccgcagctgacactgaagcagctaatgtcagtgaacccttatcagagccacaaagctgagtttgagcttgcatgacaagaaagcaatggaaccaagttccactgcagctgccatttggcaatccacctgttgctcactaactcctgggattcagtctggttggataaccaaaatgaaaggtggattcaagtttactgggtttagatgattatactattgatgtaagctgtagtgggcattgtataagcatgtagatcttgatatgcccaaatcagtttacattcttttagtagatgtcttgttctaaatagccatggtacattttcatcaattttaccatgggtgctatgatgcaccatccaggctagaagtatgttctggtttaccttttggggttggcaatatccatgatgtatccaatggatatctggcttcacttattgcatcttcaatatagtgaacctatgttaatttgcg

SEQ ID NO: 45145 - protein, 301 aa, Panicum virgatum
  misc_feature: Ceres CLONE 2023607
  misc_feature (67)..(300): Pfam Name: PPP4R2 Pfam Description: PPP4R2
MEGAVTENAEAPVGAAAPETAVHADPRGEGGAVVEDSAAPTAAIEETSDADQIIEDAGPEDGRHGETVTNVDVSPEEMRSIIEVIAETGKFWHDWDFLKSLLSLQLKQVLDEYSEAQMVSQDDVQQQRSFSGETYSELVSRLSDALCRFEEGPPFTLQRLCEILLNPKGTYTKLSKLALALEKNLLVTSTIAKSTDPYPAAHGPPSSDCTQITDNSGPVDEEPESTPEHTTAVPNGTEHLAGDGDEEMADAEAEEVSGSRDVEMQEDKPDQVENVSSNANPAAAADTEAANVSEPLSEPQS

SEQ ID NO: 45146 - DNA, 705 bp, Panicum virgatum
  misc_feature: Ceres CLONE 2023610
  misc_feature: Encodes the peptide sequence at SEQ ID NO. 45147
  misc_feature (641)..(641): n is a, c, t, g, unknown, or other
gtctccaagctctctccactccccagcacaagtgcggagtgcccaacaacaactccaccgccgctccgcaccgcatatagcagcagccagcagccatggacacggacgacactcacgagcccgcctccccgacctccgcgtcctcgacgtcgtcgtcgtcgtctggctcgtcgtcctcccaggccccgaagaagcgggcgcgccaggacgggacccggcacccgacgtaccgcggcgtgcgcatgcggagctggggcaagtgggtgtccgagatcagggagccccgcaagaagtcgcgcatctggctgggcacgttcgccaccgcggagatggcggcgcgcgcgcacgacgtggccgcgctcgccatcaagggccgcgccgcgcacctcaacttcccggagcaggcgcacctgctcccgcgcccggccaccgcgtcccccaaggacgtgcaggccgccgccacgctcgccgcggccaccgacttccccgctccgccgccgccgccgccgttctccccctcccccggcggcgccaatgccaagagccccgagagcagcagctccgacggcgccagcgccgccgcctcgccgccccacgaggcgcccccgcaggacgccgagccggaccccgacgaggcgctngtcgacctcccggacctgctcctggacctgagatgctgcggcccgtcctcgtgggccgtcgacg

SEQ ID NO: 45147 - protein, 203 aa, Panicum virgatum
  misc_feature: Ceres CLONE 2023610
  misc_feature (43)..(94): Pfam Name: AP2 Pfam Description: AP2 domain
  misc_feature: The sequence is a functional homolog of SEQ ID NO 1234 in the 10/374,780 US patent application
  misc_feature: The sequence is a functional homolog of SEQ ID NO 2596 in the 10/374,780 US patent application
  misc_feature: The sequence is a functional homolog of SEQ ID NO 644 in the 10/225,066 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 610 in the 11/435,388 US patent application
  misc_feature: The sequence is a functional homolog of SEQ ID NO 628 in the 11/479,226 US patent application
  misc_feature: The sequence is a functional homolog of SEQ ID NO 242 in the 10/225,066 US patent application
  misc_feature: The sequence is a functional homolog of SEQ ID NO 2494 in the 10/374,780 US patent application
  misc_feature: Functional homolog of the protein sequence given in SEQ ID NO 51610
  misc_feature: Useful for making plants with altered lignin content
  misc_feature: Useful for making plants with modulated flowering time
MDTDDTHEPASPTSASSTSSSSSGSSSSQAPKKRARQDGTRHPTYRGVRMRSWGKWVSEIREPRKKSRIWLGTFATAEMAARAHDVAALAIKGRAAHLNFPEQAHLLPRPATASPKDVQAAATLAAATDFPAPPPPPPFSPSPGGANAKSPESSSSDGASAAASPPHEAPPQDAEPDPDEALVDLPDLLLDLRCCGPSSWAVD

SEQ ID NO: 45148 - DNA, 688 bp, Panicum virgatum
  misc_feature: Ceres CLONE 2023614
  misc_feature: Encodes the peptide sequence at SEQ ID NO. 45149
ccatttcaatggcagctgcagttcaacctctgacagatgcagccaaggatttccttgccgtaaaatacaaggatttgactaagttccaagatgaagtgatgaacatccctcttgctgggatcgaagccatcttgtcaagtaatgaccttcaggtggcatctgaagataccatctatgacttcttgctcagatgggcccgtgcgcaatacccgaagccagaggagaggcgtgagatattgagctctcgtctgctccctcttgtgcgattcagtcacatgacctgtaggaagctgcggaaggtcctaacatgcactgatatcgaccatgagcaagcaaccaagtgtgtcactgaggcacttctatacaaggctgatgcaccgcacaggcaacgcgctcttgcagcggatgcagtaacatgtcggaaattcgcagagcgggcttacaagtacagacctctgaaagtcgttgagtttgatcggccctacccacagtgcatagcatacttggatctcaagcgtgaggagtgctctcgactcttcccttcaggccggatatactctcaagcattccatctcgcagggcaaggcttcttcctctcagcccactgtaacatggagcagcagagcacgttctactgctttggcctcttcctagggatgcaagagaagggctcaatgagcgtgacagt

SEQ ID NO: 45149 - protein, 228 aa, Panicum virgatum
  misc_feature: Ceres CLONE 2023614
  misc_feature (1)..(102): Pfam Name: BACK Pfam Description: BTB And C-terminal Kelch
ISMAAAVQPLTDAAKDFLAVKYKDLTKFQDEVMNIPLAGIEAILSSNDLQVASEDTIYDFLLRWARAQYPKPEERREILSSRLLPLVRFSHMTCRKLRKVLTCTDIDHEQATKCVTEALLYKADAPHRQRALAADAVTCRKFAERAYKYRPLKVVEFDRPYPQCIAYLDLKREECSRLFPSGRIYSQAFHLAGQGFFLSAHCNMEQQSTFYCFGLFLGMQEKGSMSVT

SEQ ID NO: 45150 - DNA, 671 bp, Panicum virgatum
  misc_feature: Ceres CLONE 2023618
  misc_feature: Encodes the peptide sequence at SEQ ID NO. 45151
gaagaggttgtagctgctgaatccaaataaagagctgggccgccggttacgtacgctgaccgcgtgtctgcaaatgagatgaacatagcaataaaaaaaactgagaagagctacagtttcttcatgttcagagatgccctgaagtccgggttctatgacctccagttggctagagattagtacaggctctcttgtggcgccgcgggcatgaaccgtgatctgctgtggcggttcatggacgtccagaccaggctcatcacccccatttgcccacactacgctgagcatgtgtggcggaagatattgaagaaagaaggatttgcaataaaagctggctggccagttgcagacacctcggatcctactctgagaattgcaaataaatacctgcaggattccatagtctcgatgaggaagctgcttcagaagcaagagtctggttccaagaagcccaagaagggagttgcgcctgcacctctatcagaggcaaagaaaatgagcgtcggccttatatatgtcaacgagcactactctggctggaaagaacagtgcctgagggtgttgcagtctaagtttgacagccaaacacgctccttcccacccgatcaggaaataactgaagctctgatgaactgtccccttggacaggagatgaacttgaagcaagttca

SEQ ID NO: 45151 - protein, 154 aa, Panicum virgatum
  misc_feature: Ceres CLONE 2023618
  misc_feature: SWISSPROT Homolog: EC 6.1.1.4 Leucine--tRNA ligase
MNRDLLWRFMDVQTRLITPICPHYAEHVWRKILKKEGFAIKAGWPVADTSDPTLRIANKYLQDSIVSMRKLLQKQESGSKKPKKGVAPAPLSEAKKMSVGLIYVNEHYSGWKEQCLRVLQSKFDSQTRSFPPDQEITEALMNCPLGQEMNLKQV

SEQ ID NO: 45152 - DNA, 952 bp, Panicum virgatum
  misc_feature: Ceres CLONE 2023620
  misc_feature: Encodes the peptide sequence at SEQ ID NO. 45153
acatctagctcgtagagaaacaaaatggcctcctttagcagctccctgtttctcctcacttcccttcttgcgatggccttatggcaggccatcgcctatgatcctagccctctccaagacttctgtgtagctgacatgaattcccctgtgcgtgtaaatggatttccttgcaaggatccgatggccgtcaccccggatgacttcttcaatgatgccaggataattggccagcctagggacactatgaacaaggttggatccaatgtcaccaacgtcaatgtcattaacttcccaggccttaacacccttggcatctcactggcacggatcgactacgggcccttgggtgtgaacacgcctcacatccacccccgtgccactgagctcctcaccgtgcttgagggaacactctacctaggctttgtcacctccaaccccaacaaactcttctctaaggtggtcaagaaaggtgacgtgttcgtgttccctaaggcgatgatccacttccagatgaacctagcacatgacaagccagcagctgcgttgtcatcactcagcagtcaaaaccctggagtcattactatcgccaatgcggtgtttggatcagacccaccgatctcggatgatgttttggcgagggcatttcaggtggaaaagaagctcatagattggctccaatctcagttctgggagaacaataactactgatgattctccactcctagttccaccaaaaagctacacgtacctatgttataaataatatgataaatggcatgtaatagttctggttgctttcatgtgtcgagggtgtttgtcttcctttagaatcctgacaaagatatgattttttgtcgggtcgatgtaataatatgatgatgtgacatgatcacttttctctgtttaaaaattgaataaatgaaatgcggtggtgtgttttccctttttactg

SEQ ID NO: 45153 - protein, 211 aa, Panicum virgatum
  misc_feature: Ceres CLONE 2023620
  misc_feature (49)..(199): Pfam Name: Cupin_1 Pfam Description: Cupin
  misc_feature: SWISSPROT Homolog: EC 1.15.1.1 Superoxide dismutase
  misc_feature: Functional homolog of the protein sequence given in SEQ ID NO 50204
  misc_feature: Useful for making plants with modulated nitrogen use efficiency
MALWQAIAYDPSPLQDFCVADMNSPVRVNGFPCKDPMAVTPDDFFNDARIIGQPRDTMNKVGSNVTNVNVINFPGLNTLGISLARIDYGPLGVNTPHIHPRATELLTVLEGTLYLGFVTSNPNKLFSKVVKKGDVFVFPKAMIHFQMNLAHDKPAAALSSLSSQNPGVITIANAVFGSDPPISDDVLARAFQVEKKLIDWLQSQFWENNNY

SEQ ID NO: 45154 - DNA, 1088 bp, Panicum virgatum
  misc_feature: Ceres CLONE 2023629
  misc_feature: Encodes the peptide sequence at SEQ ID NO. 45155
gggcagcagtggggaatcttggacaatgggcgaaagcccgatccagcaatatcgcgtgagtgaagaagggcaatgccgcttgtaaagctctttcgtcgagtgcgcgatcatgacaggactcgaggaagaagccccggctaactccgtgccagcagccgcggtaagacggggggggcaagtgttcttcggaatgactgggcgtaaagggcacgtaggcggtgaatcgggttgaaagtgaaagtcgccaaaaagtggcggaatgctctcgaaaccaattcacttgagtgagacagaggagagtggaatttcgtgtgtcactccgccactcgacccaatcgccatctcctctcctccctcccctcccacctgctcgtctcgtgccggcgccaagggcgatggcttccctccgtgcgtccctcctcctcgccgcggcgctttgcgcgctcgcggcttcgggcgccgctgcgtcccgcgacctccgcccgctccgggccggctttgtcgtgcgcggccgcgtctggtgcgacacctgccgcgccgggttcgagacccccgcctccacctacattgccggagcaaaggtaaaagttgactgcagatcgaaaaccactggagtgaagacatgcagcttcgaggggcacactgatcgcactggcacttacaacatccttgttgccgatgagcatgagcatgagctctgtgagtctgtccttgtcagcagccccgacatgaggtgtgctacgaccgtgcctggtcgggagagggcccctgtcttcctcaccagcaagaatggtgtggcctctaatgttcgtatggcgaatgctctgggattccagaaggacgttgctctacccagatgtgcgcagatcctcaagatgtatgagaatgaggatgaccgtgtgtaatgatgcagagtgtggcactgctcagcgagctatatatttaccttgtgtctgaagtgttcttgaacctctatatatctgttacgagggccatcaacattattgcctgttagattagcactttgattatgtgtgtttatctgcagttgaactgcgaatgttatcaataactaaatctacatggcc

SEQ ID NO: 45155 - protein, 169 aa, Panicum virgatum
  misc_feature: Ceres CLONE 2023629
  misc_feature (37)..(157): Pfam Name: Pollen_Ole_e_I Pfam Description: Pollen proteins Ole e I family
MASLRASLLLAAALCALAASGAAASRDLRPLRAGFVVRGRVWCDTCRAGFETPASTYIAGAKVKVDCRSKTTGVKTCSFEGHTDRTGTYNILVADEHEHELCESVLVSSPDMRCATTVPGRERAPVFLTSKNGVASNVRMANALGFQKDVALPRCAQILKMYENEDDRV

SEQ ID NO: 45156 - DNA, 293 bp, Panicum virgatum
  misc_feature: Ceres CLONE 2023635
  misc_feature: Encodes the peptide sequence at SEQ ID NO. 45157
aaccgaccgtccccctcgcgttcgtgtgctttcagttcccactccctcctccctcctcgccgcccccgccctcctccctctccgccgcggacgggcgcgggcccaggcaggcacgcgacggcgccgtcccgcatgcaggaggcggtggccgcggacgcggacgagccgggccgccggccggcgcaacagcatgatctcgcgggcgtccaccgacgccggcccaacggctaagccgggccggcggagggacagcctgcggagggggatccctgcccgcggtgcgcgtagcgcga

SEQ ID NO: 45157 - protein, 32 aa, Panicum virgatum
  misc_feature: Ceres CLONE 2023635
  misc_feature: Functional homolog of the protein sequence given in SEQ ID NO 51337
  misc_feature: Useful for making plants with modulated nitrogen use efficiency
MQEAVAADADEPGRRPAQQHDLAGVHRRRPNG

SEQ ID NO: 45158 - DNA, 682 bp, Panicum virgatum
  misc_feature: Ceres CLONE 2023649
  misc_feature: Encodes the peptide sequence at SEQ ID NO. 45159
gaaacgatgtgggaaggcttagacagctaggaggttggttcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatcgtcatgcagtgcctgggcgccatctgcggcgccggcgtcgtcaagggcttccagaagggactgtacatgggcaacggcggcggcgccaacgtcgtcgcccccggctacaccaagggcgacggcctcggcgctgagatcgtcggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatctacaacagggaccatgcctggaatgaccactggatcttctgggtcggccccttcatcggcgctgccctggccgccatctaccaccaggtgatcatcagggcgatcccgttcaagagcagggcctaagctgctgctgctg

SEQ ID NO: 45159 - protein, 190 aa, Panicum virgatum
  misc_feature: Ceres CLONE 2023649
  misc_feature (1)..(177): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
MIFALVYCTAGISGGHINPAVTFGLFLARKLSLTRAIFYIVMQCLGAICGAGVVKGFQKGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRA

SEQ ID NO: 45160 - DNA, 674 bp, Panicum virgatum
  misc_feature: Ceres CLONE 2023667
  misc_feature: Encodes the peptide sequence at SEQ ID NO. 45161
tatcgcttatcatctgcgcctccccatctctcccctgctcctccacctccttgtgatccatccaaaccaggggtagccatgtcggactccgaggagcaccacttcgagtcgaaggccgacgctggggcgtccaagacctacccgcagcaggccggtaccatccgcaagaacggattcatcgtcatcaagggccgcccctgcaaggtggtggaggtttctacctcaaagactggtaagcacggtcatgctaaatgccactttgttgccatcgacatattcaatgggaaaaagcttgaagatattgtcccatcttcccataattgtgatgtgccacatgtgaaccgcactgagtatcagctgattgacatatctgaggatggatttgtgagccttcttacttctgatggcaacaccaaggatgatcttagacttccaactgtatctcaaaacttaaatcgaaaaaggcgtgtatcgcaacaaaggattggtaccaagacattcaccctagcttgagctggcttttgctgtagtaaactcaagtgcagtgattgctgggtgtggcatcgtatctgactatctttatctgtggttacatttgggatcctgtattttctatggttttatgccctctgcgtagtatcaataatgaattggtttggaacggttaaaagtgc

SEQ ID NO: 45161 - protein, 144 aa, Panicum virgatum
  misc_feature: Ceres CLONE 2023667
  misc_feature (86)..(139): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGFIVIKGRPCKVVEVSTSKTGKHGHAKCHFVAIDIFNGKKLEDIVPSSHNCDVPHVNRTEYQLIDISEDGFVSLLTSDGNTKDDLRLPTVSQNLNRKRRVSQQRIGTKTFTLA

SEQ ID NO: 45162 - DNA, 1508 bp, Panicum virgatum
  misc_feature: Ceres CLONE 2023682
  misc_feature: Encodes the peptide sequence at SEQ ID NO. 45163
agcagttgctgtcccttccggcagcctcgagaacctccccattccccttccccggttgccgcggcgaccggcgaggcgaccgaccgagacgccccctccgccttggcgacggagcctccctccgctcctcccctcccctcccctcccgccgaggcacgcacccgcgcggcgccgcggctacttcccgtcgactcggatcgaggcgtagagagggatggcgagtctgaccggcttcaccgcgaaccctaacccgaacaagtcattcgagatcctgcccaacccgggtgactccgtctcgagcctcagcttcagccccaagagcaatctgctggtggcaacctcctgggataaccaggtgaggtgctgggagattgttggcgggaacagtcagcccaaggtgtccatgtcgcatgatcagccggtcctctgctcagcttggaaggatgatggaacaactgtcttctctggaggctgtgacaagcaggtcaaaatgtggcctctactgtcaggtgggcagcctcagacggttgcgatgcatgatacgcctgtcaaggagatcgcgtggattcctcaaatgaatcttcttgtctctggaagctgggataagactctgaggtactgggacacaaggcaagcaaatcctgtgcatatccagcaacttccagaacgttgctatgctcttacagtgaattacccccttatgattgtgggaactgctgatcgtaatcttgtagtcttcaacttgcagaatcctcagacggagttcaagcgtattcaatcaccactaaaataccagacacggtgccttgctgcattccctgatcaacaaggatttctggttggctcgatagaaggaagagttggtgttcaccatatcgatgattcacaacaaagcaagaatttcactttcaaatgtcacagggaaggaaatgatatattctctgtcaattcactgaacttccaccctgtccatcacacatttgcaactgctggatctgatggtgctttcaacttctgggataaggacagcaagcagaggctgaaggcttttagtagatgccctcttcccattccttgcagcacctttaacagtgatggttccatatttgcttatgcggtctgctatgattggagccgtggggctgaaaagcacaaccctgcagctgcaaagacatccatctacctccacagtccacatgaatctgaggtcaaaggaaagccgcggattgcaacaggcaggaagtgatttggttctaacttgcgggatctgttcgtctttaggccagtcaccagttttgttatgcccccctcctgtattggaagtctggtagatgtaaatttcagggtacctgtagtgtctaagcactgaatatagggtttccgttgcaagattaacatgtagttatacctgatgtttgctatgtcttagcccttttaaggaattgtgtatcgaggtggtcttcagtgatgtaaatttccgtgcatatgggtcgatattggtgattgtc

SEQ ID NO: 45163 - protein, 343 aa, Panicum virgatum
  misc_feature: Ceres CLONE 2023682
  misc_feature (99)..(137): Pfam Name: WD40 Pfam Description: WD domain, G-beta repeat
  misc_feature (14)..(52): Pfam Name: WD40 Pfam Description: WD domain, G-beta repeat
  misc_feature (57)..(95): Pfam Name: WD40 Pfam Description: WD domain, G-beta repeat
  misc_feature: SWISSPROT Homolog: EC 2.3.1.48 Histone acetyltransferase
MASLTGFTANPNPNKSFEILPNPGDSVSSLSFSPKSNLLVATSWDNQVRCWEIVGGNSQPKVSMSHDQPVLCSAWKDDGTTVFSGGCDKQVKMWPLLSGGQPQTVAMHDTPVKEIAWIPQMNLLVSGSWDKTLRYWDTRQANPVHIQQLPERCYALTVNYPLMIVGTADRNLVVFNLQNPQTEFKRIQSPLKYQTRCLAAFPDQQGFLVGSIEGRVGVHHIDDSQQSKNFTFKCHREGNDIFSVNSLNFHPVHHTFATAGSDGAFNFWDKDSKQRLKAFSRCPLPIPCSTFNSDGSIFAYAVCYDWSRGAEKHNPAAAKTSIYLHSPHESEVKGKPRIATGRK

SEQ ID NO: 45164 - DNA, 510 bp, Panicum virgatum
  misc_feature: Ceres CLONE 2023687
  misc_feature: Encodes the peptide sequence at SEQ ID NO. 45165
cccctcggagggggaacagtaagcacgtgagaacgcaacctcgagccctactaccgccgccgccggcgtctaaggccataggataacccgcttaccgttacctggccgattattatgaggatgccgcggcgtccggcgaggacgaggcaccccggcgcccaggtcgcgcccttcgtcctcgcttgctgaggggccgtcacgcaacggtgaggaggacgaggacctcctactctaccttaatgccaaactgctatctattcgataaggtatggcaacctatggaaggagctggggacggccttccatcctgctgttgtattatacggagacctccaaggtccgcctcgtcatgcgctaggcgaagacactcgagatctgctccaatctccttgtggtggcgacaacaaagatgcatgaccacgccgggagcgacgagtcttgcctgtggcactggttggacttcgccgatggcgagtttaaggaggaaatgttcgcaatccgctttggttc

SEQ ID NO: 45165 - protein, 33 aa, Panicum virgatum
  misc_feature: Ceres CLONE 2023687
  misc_feature: Functional homolog of the protein sequence given in SEQ ID NO 51603
  misc_feature: Useful for biocontainment applications
  misc_feature: Useful for making plants with modulated flowering time
MHDHAGSDESCLWHWLDFADGEFKEEMFAIRFG

SEQ ID NO: 45166 - DNA, 704 bp, Panicum virgatum
  misc_feature: Ceres CLONE 2023698
  misc_feature: Encodes the peptide sequence at SEQ ID NO. 45167
gtcggccgccatctcccctctcttaggttttaggtcccctcgccgccgccgccgccgccggcctcgcgagcttgccgaaatggtcgcccacaggttccatcagtaccaggtggtgggccgcgcgctgccgacccccggcgatgagcaccccaagatctaccgaatgaagctctgggccaccaacgaggtccgcgccaagtccaagttctggtacttcctgaggaagctcaagaaggtgaagaagagcaacggacaggttctcgccatcaacgagatctttgagcgcaaccctaccacaatcaagaactacggcatctggctgcgttaccagagcaggacaggttaccacaacatgtacaaggagtaccgtgacaccaccttgaatggtgctgtggagcagatgtacaacgagatggcctcccgtcaccgtgtgaggtccccctgcatccaaatcattaagacagcaacagtccacttcaagctctgcaagagggacaacaccaagcagttccacaatgccaagattaagtttcctcttgtctcccgtgtgatcagaccaccaaccaggaaactgaaaacgaccttcaaggcttcaaggcccaacttgttcatgtgatccaactcaccatgactcccttcctaatctgtaattgcagacagtttggagggttgctagttgaggttaatcgtatctactgcaactt

SEQ ID NO: 45167 - protein, 178 aa, Panicum virgatum
  misc_feature: Ceres CLONE 2023698
  misc_feature (5)..(178): Pfam Name: Ribosomal_L18ae Pfam Description: Ribosomal L18ae protein family
MVAHRFHQYQVVGRALPTPGDEHPKIYRMKLWATNEVRAKSKFWYFLRKLKKVKKSNGQVLAINEIFERNPTTIKNYGIWLRYQSRTGYHNMYKEYRDTTLNGAVEQMYNEMASRHRVRSPCIQIIKTATVHFKLCKRDNTKQFHNAKIKFPLVSRVIRPPTRKLKTTFKASRPNLFM

SEQ ID NO: 45168 - DNA, 554 bp, Panicum virgatum
  misc_feature: Ceres CLONE 2023710
  misc_feature: Encodes the peptide sequence at SEQ ID NO. 45169
accataccaagcacccgccaccagcagctagcaccggctagacctcgggcaggaagcaagccgcccgcggccaccccagaaaagaagaaagggatggggggccggggccacccccttggccgggtccacccccggatccaccgcagcaaccagacgctgctcaagaacgaagccctctaccagtacctgctggacacctccgggctgccccaccaaccggaatgcctgccccagctgcggctggggaccgacaagcaccaatgggggctgatgccgtcctcccccgaccaagcgcagctgctgccgaagctcctcaagctgatgggcgccccccacaccctccaggggggcgtggtcacgggctaattggtccttggcaccgggcttggccttcccggcgaagggcgggtcatccccatcgacgtccaccgcgagtactaccagatccgccgccccttcatccagaaaggcggcgtcgcgggcaagggggacttccgcgaaggccccgcgctggaacacctccacgcgctcctcgccgaccaacgccacctggg

SEQ ID NO: 45169 - protein, 90 aa, Panicum virgatum
  misc_feature: Ceres CLONE 2023710
  misc_feature: SWISSPROT Homolog: EC 2.1.1.104 Caffeoyl-CoA O-methyltransferase
  misc_feature: Functional homolog of the protein sequence given in SEQ ID NO 51474
  misc_feature: Useful for making plants with altered carbohydrate content
MGGRGHPLGRVHPRIHRSNQTLLKNEALYQYLLDTSGLPHQPECLPQLRLGTDKHQWGLMPSSPDQAQLLPKLLKLMGAPHTLQGGVVTG

SEQ ID NO: 45170 - DNA, 602 bp, Panicum virgatum
  misc_feature: Ceres CLONE 2023715
  misc_feature: Encodes the peptide sequence at SEQ ID NO. 45171
acgtcatcactaacctacgtgcaccggagcgaagccgctgatccgacgcgccgccgctctgcatctgtcgtcgccggtgactcggatggtttcccagcttcggtcaacatgtactacactggatatcccaaggacctagggccatcaagaattataccattcacatctgagcgtcagtttgtacagctattgcatgaaggaaggcctgtagttgttgcctttactattaagtgcacttatacacagcatcttgataaagtactggaagaggctgctgccacattttatccacatatcaagtttgtcagagttgaatgcccaaagtatcctgggttttgcctcacgaggcaaaggaatgaatatccatttgttgaagtattttacaatccagaacaggctgcaagccaaggaaagagtgtggatcctaacatcaccaagtattctgtaaaagtgctacctttcaactatgatcagagcttgtatggatttcgggaatatttcaagaagcatggtttcaagtattctgaaacaaactaattctgtcaatagaaatatgcgatgtgagaacttctagggacttaacatggaggcattcattgtcg

SEQ ID NO: 45171 - protein, 142 aa, Panicum virgatum
  misc_feature: Ceres CLONE 2023715
  misc_feature: SWISSPROT Homolog: EC 5.3.4.1 Protein disulfide-isomerase
MYYTGYPKDLGPSRIIPFTSERQFVQLLHEGRPVVVAFTIKCTYTQHLDKVLEEAAATFYPHIKFVRVECPKYPGFCLTRQRNEYPFVEVFYNPEQAASQGKSVDPNITKYSVKVLPFNYDQSLYGFREYFKKHGFKYSETN

SEQ ID NO: 45172 - DNA, 692 bp, Panicum virgatum
  misc_feature: Ceres CLONE 2023718
  misc_feature: Encodes the peptide sequence at SEQ ID NO. 45173
ccccactcacacaccaccagagcacagccaagagcgagacgcccaagcaaccaccgctccacagctaagctaagccaagccagccaccgcgagaacaagtcgcagcgaaaaagcctgctacgcttgccatgacttccatggagctgctccacgccgtgatcccggagaagcagcgcgaggactcgctggcgccggcgccggcgctgacgacgacgagcagcagcgccaccgccacgagcggcgacgagggctcccacgtgccgcaggggtgggccaagaggaagcgctcgcgccgccagcgctccgaggaggagaacctcgcgctctgcctcctcatgctctcccgcggcggcaaccaccgcgtccaggccccgccgccggtccccgccgcgccgccggccgccgcggagttcaagtgctccgtctgcggcaagtccttcagctcctaccaggcgctggggggccacaagaccagccaccgtgccaagctgccgacccctcctgcttccgcgggcgctccggccgcacccgtcgttgaggcccccgccccgatcaccgtcgtcgtcccgccgccgatcgaggtcgcccgcgagccggccacgtcatccaccgccgcgtcctccgacggggcggccgcctcgagcagagtccacaggagctccggcaacggcagctccgcggcccggggcgtc

SEQ ID NO: 45173 - protein, 184 aa, Panicum virgatum
  misc_feature: Ceres CLONE 2023718
  misc_feature (92)..(114): Pfam Name: zf-C2H2 Pfam Description: Zinc finger, C2H2 type
MELLHAVIPEKQREDSLAPAPALTTTSSSATATSGDEGSHVPQGWAKRKRSRRQRSEEENLALCLLMLSRGGNHRVQAPPPVPAAPPAAAEFKCSVCGKSFSSYQALGGHKTSHRAKLPTPPASAGAPAAPVVEAPAPITVVVPPPIEVAREPATSSTAASSDGAAASSRVHRSSGNGSSAARG

SEQ ID NO: 45174 - DNA, 962 bp, Panicum virgatum
  misc_feature: Ceres CLONE 2023733
  misc_feature: Encodes the peptide sequence at SEQ ID NO. 45175
ctttacatagcaacgtcgaacaatgcctttcgtcaagcaacaaaagaacaaggcttatttcaagcgttatcaagtcaagtatcgtagaagaagagagggtaagaccgattactatgctcgtaagagactcgtcgttcaagccaagaacaagtacaactctcctaagtacagattggttgtccgtttcaccaacaaggacatcatctgtcaaatcatctacgctaagctccaaggtgatttcgtcctctctgctgcctatgctcatgaacttccccgttatggtgttaagggtggtttgaccaactgggcctctgcttacgctactggtctcctccttgctcgtcgtaccctcgccaagctcggtcttgctgacaagtacgaaggtttcgctgagcccgatggtaccgttcaattgattgaagctgctgaggatgctccccgtcctttcaaggctttcctcgatgtcggtctcgctcgtacctccactggtgcccgtgtctttggtgccatgaagggtgcctccgatggtggtatctttgttccccacaacggtaaccgtttccctggtttcgatatcgagaccaagaccaacgatgatgaacttctccgtaactacatttatggtgttcacgttgctgagtacatggaatacctcgaagaagaagatgaggaacgttacaagaagcaattctctaccttcatcaaggccggtattacctctgataaggtcgaggatatgtacactgaagctcatgaagctatccgtgagaaccctgctgctcaacccaccgagaagaagggtaagcccgccaagccttaccgcagactcgttgccctcaacaagaagcaacgtctcaacaagatcaaggatgccaaggctgctttcgaagcttctcaataaattggtttatcccaatctattagtttaataataaaaaaatcgacttgactttttgttgtat

SEQ ID NO: 45175 - protein, 292 aa, Panicum virgatum
  misc_feature: Ceres CLONE 2023733
  misc_feature (26)..(173): Pfam Name: Ribosomal_L18p Pfam Description: Ribosomal L18p/L5e family
MPFVKQQKNKAYFKRYQVKYRRRREGKTDYYARKRLVVQAKNKYNSPKYRLVVRFTNKDIICQIIYAKLQGDFVLSAAYAHELPRYGVKGGLTNWASAYATGLLLARRTLAKLGLADKYEGFAEPDGTVQLIEAAEDAPRPFKAFLDVGLARTSTGARVFGAMKGASDGGIFVPHNGNRFPGFDIETKTNDDELLRNYIYGVHVAEYMEYLEEEDEERYKKQFSTFIKAGITSDKVEDMYTEAHEAIRENPAAQPTEKKGKPAKPYRRLVALNKKQRLNKIKDAKAAFEASQ

SEQ ID NO: 45176 - DNA, 671 bp, Panicum virgatum
  misc_feature: Ceres CLONE 2023735
  misc_feature: Encodes the peptide sequence at SEQ ID NO. 45177
gccaactgcagagtgctccttcggccccccttccttccccattcgcgccccagagggctccggaaccgcgaggccgatctgagccaaggcgatggagtcgccgttccgggcggacgtgctcaagggcaaggcggcgctggtcaccggcgggggttccggcatcggcttcgagatcgccgcccagctcgcgcgccacggcgcgcaggtcgccatcatgggccgccgccgcgaggtcctcgacaaggccgtcgcggccctccgctcccagggcctccgggctgtcggttttgatggagatgtccgcaagcaggaggatgcggccagagtgctcgcggcgacagttgagcattttggcaagcttgacattcttgttaatggcgcagctggcaacttccttgcttccccagaggatttgacgcccaagggattccgaacagttctcgacattgacactgtgggcacatacacaatgtgctttgaagccctcaagtatctgaaaaagggtgggccaggaaaaggcccgtccactggtggcctaatcattaacataagtgcaacactgcattacactgcaacttggtaccaaattcatgtctctgctgctaaggcaggtgttgatagcatcacaagatcactggctctgggatggggatctgattatgacattagag

SEQ ID NO: 45177 - protein, 193 aa, Panicum virgatum
  misc_feature: Ceres CLONE 2023735
  misc_feature (13)..(187): Pfam Name: adh_short Pfam Description: short chain dehydrogenase
  misc_feature: SWISSPROT Homolog: EC 1.3.1.34 2,4-dienoyl-CoA reductase (NADPH)
MESPFRADVLKGKAALVTGGGSGIGFEIAAQLARHGAQVAIMGRRREVLDKAVAALRSQGLRAVGFDGDVRKQEDAARVLAATVEHFGKLDILVNGAAGNFLASPEDLTPKGFRTVLDIDTVGTYTMCFEALKYLKKGGPGKGPSTGGLIINISATLHYTATWYQIHVSAAKAGVDSITRSLALGWGSDYDIR

SEQ ID NO: 45178 - DNA, 424 bp, Panicum virgatum
  misc_feature: Ceres CLONE 2023736
  misc_feature: Encodes the peptide sequence at SEQ ID NO. 45179
tagtctttggcggctgcgacacgacagcgccgacgctggagtgggccatggccgagctcgtccataaccccaaggtcgaggagcgggtgacggcggaggtgcggaactccttcgcagcgcccgggtcggtgcgggaggactagctcgctgaggcggggctccggtacctgcccctcgtcatcctggagacgctccggctgcactcgccactgccgttcctgatcccgcacgcgtgccacgaaccctgccgcgtgctgggctacgacttgccgcaaggcatcacagtgatggagaacgcatgggcgctgggccgcgactagcagtattggccgggggaccccgacgcgttccggccggagcggttcgagtccggcgtgcggaagctcagcggacttctagggcgccgacttcgagctcctgccga

SEQ ID NO: 45179 - protein, 46 aa, Panicum virgatum
  misc_feature: Ceres CLONE 2023736
  misc_feature (3)..(33): SWISSPROT Homolog: EC 1.14.15.6 Cholesterol monooxygenase (side-chain-cleaving)
  misc_feature (3)..(42): SWISSPROT Homolog: EC 1.14.99.10 Steroid 21-monooxygenase
  misc_feature (1)..(33): SWISSPROT Homolog: EC 1.14.99.9 Steroid 17-alpha-monooxygenase
VFGGCDTTAPTLEWAMAELVHNPKVEERVTAEVRNSFAAPGSVRED

SEQ ID NO: 45180 - DNA, 1091 bp, Panicum virgatum
  misc_feature: Ceres CLONE 2023756
  misc_feature: Encodes the peptide sequence at SEQ ID NO. 45181
aaatacccattttgctcaactgaaaaaaaatccccattttctgctgggaggaggcacagcacatggcggcagccaccggctacggcgacgccccgacggagggggagctgctcgcgtacggcgacctgcccaggcacggccgcgacatggcggaggttttcgccgtgcgcgtccctgcggccgccgtcgccgttggaggaggaggcaggtccccgccttgcggcaccatcttcttccacggcggcaactcctgcagcgaccttatcttcagccgggagcggagcggcaccgacgagctcgccgccccgcaaccctgcgacagcgagggcaacctcgtgctgaccggcccatcagtggccacctcggcgtacggtccggtcggcttcgacatccacctccacgacggcacccacggcgagccctccttgcaagccgacggcggcggcggcgacgaccaggacgacagcaacaacgggagggtattctgcgacaccgtctccggcgagttctccacctacgacagggtcattacggagacggtcgccaccgggtacggccccaccaacgtggtctacgccgttctcagcaacgccgtccaaggccgggtcgccgtgaagctcaccgctctcccggccggagatggagccgacgccgccaccggcgtcctcgggagggtcgtcgcccgcagcaagctcttggacgccggctgcgtgctcttctacggcgagcgcgacggcgagggcggctggcccgtgcgacccggggacctgctgccgctggcgaggcaagcgctcgcggtgccgctgcacaagccgctgacgatcgagctgaacctgcgcagcgactccggcgaggagattgtcagaggcgccgtcgagttcgatccggcgatcaccggcgagcatattgagcgtgtcgtcggcacgagtggcgcagaaatcgaagttatagtctcatggtcagactacccttggtagatcgagcccattagccattagttactcatctgtgcgagaggggctatgtactccctaatatactaatatatgtatctaaagtggtttcaaaataagaatcttttgatgtggcag

SEQ ID NO: 45181 - protein, 304 aa, Panicum virgatum
  misc_feature: Ceres CLONE 2023756
  misc_feature: SWISSPROT Homolog: EC 3.2.2.22 rRNA N-glycosylase
MAAATGYGDAPTEGELLAYGDLPRHGRDMAEVFAVRVPAAAVAVGGGGRSPPCGTIFFHGGNSCSDLIFSRERSGTDELAAPQPCDSEGNLVLTGPSVATSAYGPVGFDIHLHDGTHGEPSLQADGGGGDDQDDSNNGRVFCDTVSGEFSTYDRVITETVATGYGPTNVVYAVLSNAVQGRVAVKLTALPAGDGADAATGVLGRVVARSKLLDAGCVLFYGERDGEGGWPVRPGDLLPLARQALAVPLHKPLTIELNLRSDSGEEIVRGAVEFDPAITGEHIERVVGTSGAEIEVIVSWSDYPW

SEQ ID NO: 45182 - DNA, 642 bp, Panicum virgatum
  misc_feature: Ceres CLONE 2023757
  misc_feature: Encodes the peptide sequence at SEQ ID NO. 45183
gactagagagcttttgccgcagctgctgcgcgccggtcggagaggaagagcagagggacactgagggacagaggaggggagagacagagatggcgatggcgatggcagtcggaggaggagcggaggtggaggagggggtgacgagggtgctggtggtggacgactcccccgtcgaccgccgggtggcgcagctcctgctcagcagcggctcctgcgccggctcattccacgtcatcgccgtggacagcgccaagaaggccatggagttcctcggcctcaaggacggcaaggagcaggccatcgacatggtgctcaccgactactgcatgcccgagatgaccggctacgacctgctcaaggccgtcaaggcgctgaacccccggaagccgatcccggtgatcgtcatgtcgtcagaagacgagccccagcggatcagcagatgcttgagcgctggtgctgaggacttcatcgtgaagcccctgcagagcaaggacgtgcagcgcctcaggaactgctccgccgccaggtcgtccaacagggcctccccgccgtgcgagtgcgacgccgcggccaagaggaagccgctggtgctgccgccctctgccgccgcgtcgccgtcactgccacggcgggcgagcttcg

SEQ ID NO: 45183 - protein, 180 aa, Panicum virgatum
  misc_feature: Ceres CLONE 2023757
  misc_feature (14)..(136): Pfam Name: Response_reg Pfam Description: Response regulator receiver domain
  misc_feature: SWISSPROT Homolog: EC 2.7.13.3 Histidine kinase
  misc_feature: The sequence is a functional homolog of SEQ ID NO 932 in the 10/666,642 US patent application
MAVGGGAEVEEGVTRVLVVDDSPVDRRVAQLLLSSGSCAGSFHVIAVDSAKKAMEFLGLKDGKEQAIDMVLTDYCMPEMTGYDLLKAVKALNPRKPIPVIVMSSEDEPQRISRCLSAGAEDFIVKPLQSKDVQRLRNCSAARSSNRASPPCECDAAAKRKPLVLPPSAAASPSLPRRASF

SEQ ID NO: 45184 - DNA, 711 bp, Panicum virgatum
  misc_feature: Ceres CLONE 2023758
  misc_feature: Encodes the peptide sequence at SEQ ID NO. 45185
cttttcggtttcctccccccatctctccctctctctctctctctctctctctctctctctctcatcatcgtcgccacctccatcccgtctccatccccttcggcctccgatccctccacgagtcgagcagaggatccgcggcggcggcgggcggcgggcggtggtcggccggcgatggcgcaccgggtggacaacgagtacgactacctcttcaagatcgtgctcatcggcgactccggcgtcggcaagtccaacatcctctcccggttcacccgcaacgagttctgcctcgagtccaagtccaccatcggcgtcgagttcgccacccgcaccctccagatagaaggaaagaccatcaaagctcagatatgggatactgctgggcaagagaggtaccgtgcaatcactagcgcttactacagaggagctgtgggtgcacttttagtctacgatatcacaaagaagcagacatttgaaaatatccagaggtggcttcgtgagctccgtgatcatgcagactccaacattgtgatcatgatggttggtaacaaatcggatctgaaccacctgagatcagttccagaggaagatggccaggcattagcggagaaggaaggcttatccttcctggagacatcagctcttgaagccgtgaatgttgagaagggatttcagactattctcgctgatattcatccaatcataagcaag

SEQ ID NO: 45185 - protein, 178 aa, Panicum virgatum
  misc_feature: Ceres CLONE 2023758
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50522
  misc_feature: Useful for making plants with modulated oxidative stress sensitivity
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKQTFENIQRWLRELRDHADSNIVIMMVGNKSDLNHLRSVPEEDGQALAEKEGLSFLETSALEAVNVEKGFQTILADIHPIIS

SEQ ID NO: 45186 - DNA, 663 bp, Panicum virgatum
  misc_feature: Ceres CLONE 2023760
  misc_feature: Encodes the peptide sequence at SEQ ID NO. 45187
atccgcagccactcgctccaccggcacccagcctctggttagccccccgacggagcgctcgcctgagggggcgtgaattgagatctatctggatctagtccgccggcaatggaagcggcggcgggcggcaagcgcgcgtacagcatcatcgtgcccacctacaacgagcgcctcaacgtcgccctcatcgtgtacctcatcttcaagcacctcccggatgtgaactttgagatcattatcgtggatgatggtagtccagatggaactcaagatattgtaaaacaattgcaggaagtgtatggtgaagatcgtatcttactgcgagctaggccaaggaagctaggacttggtactgcgtatttacatggattaaagcatgcctggggggaatttgttgttatcatggatgcagacctatctcaccatccaaagtatttgccaagctttattaggaagcaaaaggaaactggtgctgatgttgtaactggcactcgttatgttaagaatggtggtgtccatggttggaatctcatgcgcaagctaactagccgaggagctaatgttcttgcacagacattactgcaacctggagcctcagatttaactggatcgtttaggttatataagcgagatgtcctggaagatttaatctcctcatgcgtc

SEQ ID NO: 45187 - protein, 184 aa, Panicum virgatum
  misc_feature: Ceres CLONE 2023760
  misc_feature (12)..(181): Pfam Name: Glycos_transf_2 Pfam Description: Glycosyl transferase family 2
  misc_feature: SWISSPROT Homolog: EC 2.4.1.83 Dolichyl-phosphate beta-D-mannosyltransferase
MEAAAGGKRAYSIIVPTYNERLNVALIVYLIFKHLPDVNFEIIIVDDGSPDGTQDIVKQLQEVYGEDRILLRARPRKLGLGTAYLHGLKHAWGEFVVIMDADLSHHPKYLPSFIRKQKETGADVVTGTRYVKNGGVHGWNLMRKLTSRGANVLAQTLLQPGASDLTGSFRLYKRDVLEDLISSC

SEQ ID NO: 45188 - DNA, 355 bp, Panicum virgatum
  misc_feature: Ceres CLONE 2023764
  misc_feature: Encodes the peptide sequence at SEQ ID NO. 45189
aaaaaccctattaaaccctcgccgcctcccccttcccgcgccgcgcaattcctcccaccttgtccctgtcgcacccacccacgcacccagctcttcccgagcgagctcgggtgcacccccgacctcatgcggccaccgagagggggccgcggaggccgacgcttaggcggcggcggcggccgcgccggaggcgcgggacggctcggcagtggccgcggccgcgcctgcgggggacgcgggcccaggcgcgtcctccgcgcagaccctgcgtccgcctaggtcctcgaggtgacgacgatcctccccgtctgcgtcgaggactcggtggccaggcacacgaacgacacctgtgccc

SEQ ID NO: 45189 - protein, 50 aa, Panicum virgatum
  misc_feature: Ceres CLONE 2023764
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
MRPPRGGRGGRRLGGGGGRAGGAGRLGSGRGRACGGRGPRRVLRADPASA

SEQ ID NO: 45190 - DNA, 695 bp, Panicum virgatum
  misc_feature: Ceres CLONE 2023773
  misc_feature: Encodes the peptide sequence at SEQ ID NO. 45191
gcacagctgacagcagagagctagcagcagccatggccgggggctccgggaaggcgacctactacgcggtgcttggcgtggctcgtgacgcgtccgccggcgagatccgcgccgcctggcgccgcctgtccctgatatggcaccctgacaagctgaagggggcagcaggagatcactctcgtcagaaggagcaagccctggccaggtaccacgagatccaggaggcctacaaagtgctgtccgacccgtcgaggaaggccatgtacgaccgggccctgctccagcagcagcggttcgacgatgctgccaacggccgcgacaagaaatctttggtcggcgtgctggagcgtcctggcggctgcggcaccgtggacgacccgtcggacagggtcgacaagatagagatcaagatcaagagctcctcctcgtcggctcgcaccggcaggccagcttctggacggatcgacctgtccttcaccttcaccaccgcggcggcgcccgacgaggggaccagccccggcggcggcggaccccggaacgcccgatgtgcagcaggctcctcctcggccccgcgccgccgtgccgccccgcgctcgaagctacagactttgatcgaggccaggctgcggtgcggccgcaaagactagctatatatgctccgttcgccggccggcggcccaccgtgctgagagctc

SEQ ID NO: 45191 - protein, 204 aa, Panicum virgatum
  misc_feature: Ceres CLONE 2023773
  misc_feature (9)..(79): Pfam Name: DnaJ Pfam Description: DnaJ domain
MAGGSGKATYYAVLGVARDASAGEIRAAWRRLSLIWHPDKLKGAAGDHSRQKEQALARYHEIQEAYKVLSDPSRKAMYDRALLQQQRFDDAANGRDKKSLVGVLERPGGCGTVDDPSDRVDKIEIKIKSSSSSARTGRPASGRIDLSFTFTTAAAPDEGTSPGGGGPRNARCAAGSSSAPRRRAAPRSKLQTLIEARLRCGRKD

SEQ ID NO: 45192 - DNA, 1362 bp, Panicum virgatum
  misc_feature: Ceres CLONE 2023776
  misc_feature: Encodes the peptide sequence at SEQ ID NO. 45193
aatctctcccttttcttcacatttctatttccaaaccaaattgcaattaggatgtctcctctcagtaccagccgtaacaccgataagcctttcatctttgatttgactagtgataccgctacaattccaactgatgagatgtttgacattatgaaagctgctactcgtggtgatgatgtctatcaaactgatgatgattgcaaagcccttgaagactatgttgctcagcaattgggtcatgaagctggtttgttctgtactagtggcactctttccaatcaactcggtttgagatgtctcttgttccaacctcctcactctgttttgtgtgattctcgctctcatgttttcaattatgaatgtggcggcattgcttatcattctcaagccaatgtcgtccctgtagtagcaaagggtacttatatgaccgctgctgaagtagagagccgtatcaataaggatactttatgtggtgccatcactaaagtcgtctctctggaaaataccatgaacggtacaattatgcccattgaagagatcaaaaagattcatgatgtcgctcgtgccaacaacctcaagatgcacatggacggtgcccgtctctggaacgctagtcaaggaagtggtactcccttgagcgaatacggtaaatactttgataccgtttctatttgtttatcaaagggtgctggtgctccaattggctccatgttgactggtaccaaggagctaatcactcgtgctcgtcatatccgcaagatgatgggtggtggttggagacaagctggtatgttggctgtggcagctcgtcattgtatcaacacagttgttcccactatgccagagacacatgctcttgctcgcaagcttgcagaccatcttgaatctcttggtgtcaagattctcttaccagtggacaccaacatggtcttcatcgacgtttctcgcactggtcttattattgccgatttagcagaagctctcaaggcaaagaacattaagatttttagcaacactggcacaacgactcgtatcgtgcttcactatcaaattacatctcaagcaattgatgatttcatgcagattgctagtgacttagttcaaacaaagaagaagtctggatttgttgcacccgttgttaatggctctgctgtcgagacaattgaacaaactgctgaatcagcttatcctactgcaactgcttaaacatacacacaacacgtttttgtatacattgattattattattttttcagttggaaatagagattctttttttattagtgtatataatatccattctctttctcatttcatttctactcataaaatacttgaataaaaaattttggttttcatttc

SEQ ID NO: 45193 - protein, 384 aa, Panicum virgatum
  misc_feature: Ceres CLONE 2023776
  misc_feature (17)..(300): Pfam Name: Beta_elim_lyase Pfam Description: Beta-eliminating lyase
  misc_feature: SWISSPROT Homolog: EC 4.1.2.5 Threonine aldolase
MSPLSTSRNTDKPFIFDLTSDTATIPTDEMFDIMKAATRGDDVYQTDDDCKALEDYVAQQLGHEAGLFCTSGTLSNQLGLRCLLFQPPHSVLCDSRSHVFNYECGGIAYHSQANVVPVVAKGTYMTAAEVESRINKDTLCGAITKVVSLENTMNGTIMPIEEIKKIHDVARANNLKMHMDGARLWNASQGSGTPLSEYGKYFDTVSICLSKGAGAPIGSMLTGTKELITRARHIRKMMGGGWRQAGMLAVAARHCINTVVPTMPETHALARKLADHLESLGVKILLPVDTNMVFIDVSRTGLIIADLAEALKAKNIKIFSNTGTTTRIVLHYQITSQAIDDFMQIASDLVQTKKKSGFVAPVVNGSAVETIEQTAESAYPTATA

SEQ ID NO: 45194 - DNA, 617 bp, Panicum virgatum
  misc_feature: Ceres CLONE 2023785
  misc_feature: Encodes the peptide sequence at SEQ ID NO. 45195
ccaaccatccaaacactgaatcttgtgtctgtctgctcggcactagctagcagtagctacctgccttccttcttaggcttggagtaggattgtgcttgctggttgctgctctgagcaaagatggcctccgccttctcttccaaggctgctgcacttgcagcactagtcttctcgctcctggtcacttacggctcgtgcgctaggccggtgaacttcaacacctccgccttcaccggcgatcccaactgggaggccgccagggccacctggtacggcgcgcccaccggcgccggtcctgacgatgatggtggcgcctgcgggttcaagaatgtcaacctgccaccgttctcggccatgacgtcgtgcggcaacgagccgctgttcaaggacggcaagggatgcggctcttgctaccagataagatgtaccaaccacgctgcgtgctccggcaacccggagacggtgatcatcaccgacatgaactactacccggtggccaaataccatttcgacctcagcggcacggccttcggcgccatggccaagcccggccgcaacgacgagctccgccatgccggcatcatcgacatccagttcaagagggtgcccagcaacta

SEQ ID NO: 45195 - protein, 165 aa, Panicum virgatum
  misc_feature: Ceres CLONE 2023785
  misc_feature (80)..(159): Pfam Name: DPBB_1 Pfam Description: Rare lipoprotein A (RlpA)-like double-psi beta-barrel
  misc_feature: Functional homolog of the protein sequence given in SEQ ID NO 51060
  misc_feature: Useful for making plants with altered carbohydrate content
  misc_feature: Functional homolog of the protein sequence given in SEQ ID NO 51592
  misc_feature: Useful for making plants with altered cell wall content and/or composition
MASAFSSKAAALAALVFSLLVTYGSCARPVNFNTSAFTGDPNWEAARATWYGAPTGAGPDDDGGACGFKNVNLPPFSAMTSCGNEPLFKDGKGCGSCYQIRCTNHAACSGNPETVIITDMNYYPVAKYHFDLSGTAFGAMAKPGRNDELRHAGIIDIQFKRVPSN

SEQ ID NO: 45196 - DNA, 665 bp, Panicum virgatum
  misc_feature: Ceres CLONE 2023805
  misc_feature: Encodes the peptide sequence at SEQ ID NO. 45197
aatcctcccgccgcggcgccgcttcacccccacccgtcggcccgtcccatactccgccgctgacacgttggcctgcctaaactgaaccttccaatggctgccgccgccgccgcctccgccaccgctgccgcctccgccgtcgtgcttccccacgccttcctctcccaccgctcgccgccgccgcaggtcgtcgccgtggcctcctcgttccgccggctctccctgtgcgcctcccctcgccggaccacccacctagtcgcccgcgccgacgccggcgccgaagctgccggggaaccggagcctgaggctgaggccgagcctgccactgcctcagctgacgccgaggagggggaggccgagggggctgtcgcggtggccgaggaagaggaggcagaggaaccgccgccgagcaagccgaaggttaagttcggcgaaatcatcgggattctgaacaagcaattcattgaggaggccgagaaggtgaagactgtaccagatctgaggcctggcgacatcatcgagctgaggatgcaacggcccaacaagaggagattgtcactctttaagggaataatcatcgcaaagcacaaagctggtggtcacaccacaatccgtgtcagaaggatcattgctggtgtaggagttgagattaccttcccagtgta

SEQ ID NO: 45197 - protein, 190 aa, Panicum virgatum
  misc_feature: Ceres CLONE 2023805
  misc_feature (121)..(190): Pfam Name: Ribosomal_L19 Pfam Description: Ribosomal protein L19
MAAAAAASATAAASAVVLPHAFLSHRSPPPQVVAVASSFRRLSLCASPRRTTHLVARADAGAEAAGEPEPEAEAEPATASADAEEGEAEGAVAVAEEEEAEEPPPSKPKVKFGEIIGILNKQFIEEAEKVKTVPDLRPGDIIELRMQRPNKRRLSLFKGIIIAKHKAGGHTTIRVRRIIAGVGVEITFPV

SEQ ID NO: 45198 - DNA, 657 bp, Panicum virgatum
  misc_feature: Ceres CLONE 2023808
  misc_feature: Encodes the peptide sequence at SEQ ID NO. 45199
gaagaaggggaggagagcaaggagctcggcggcaagggggaggacgacgctgacaagagcaagaaaggggcggcggcggggaaggccaagggcaagggcgagaagcggcagcggcagccgcggttcgcgttcatgaccaagagcgaggtcgaccacctcgaggacggctaccggtggcgcaagtacggccagaaggccgtcaagaacagcccgtaccccaggagctactaccggtgcacgacgcagaagtgccccgtgaagaagcgggtggagcggtcgtaccaggacccggcggtggtgatcaccacgtacgagggcaagcacacgcaccccatctcggccacgctccgcggcagcacccacctcctcgccgcgcagctgcaccaccaccaccacgccggcgccggcggccaccacctcggcggcgccttcccgccgctgccgcagatgggcgcgccgttcgggcggcctggtgtcggcggcggcgtcatcgacgtgctgggcctcctgccgccccgcgacgcccacaaccaccacaccgtgccgccggcgataggcctcgcgtcgtcccagggcatgagcggtccgatgagcaccgtcgcgggcgcgaccaccgccgcagccaccaccaccgcctcgtcgtctcccccgtcgctc

SEQ ID NO: 45199 - protein, 218 aa, Panicum virgatum
  misc_feature: Ceres CLONE 2023808
  misc_feature (53)..(112): Pfam Name: WRKY Pfam Description: WRKY DNA -binding domain
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
EEGEESKELGGKGEDDADKSKKGAAAGKAKGKGEKRQRQPRFAFMTKSEVDHLEDGYRWRKYGQKAVKNSPYPRSYYRCTTQKCPVKKRVERSYQDPAVVITTYEGKHTHPISATLRGSTHLLAAQLHHHHHAGAGGHHLGGAFPPLPQMGAPFGRPGVGGGVIDVLGLLPPRDAHNHHTVPPAIGLASSQGMSGPMSTVAGATTAAATTTASSSPPS

SEQ ID NO: 45200 - DNA, 1406 bp, Panicum virgatum
  misc_feature: Ceres CLONE 2023817
  misc_feature: Encodes the peptide sequence at SEQ ID NO. 45201
aaaaaacacaccgaggggctctggctctcctcccttcactgcctcgcctctatttatagaggggcagctagctacggctgtgacacacagatcaatcacattctcaagtctcaacctgtgcagcaacactccaagagattcagagagagccgagaggtgtcccctgccattagtctctgctcgtattctgccttcccagaggaagaagagaggagaggaaggccatctccgtcgtcgccatggctcagctcgccgacctcatcaaccttgacctctccgactgcaccgagaagatcatcgccgagtacatctgggttggcggctctgggatggatgtgaggagcaaagccaggacactgtccggacctgtggatgaccctagcaagcttccgaaatggaacttcgacggctccagcacaggccaagctacgggagacgacagtgaagtcatcctttgtccccaagccatcttcagggatccgttcaggaaggggaagaacatactggttatgtgcgactgctatgcgccgaacggggagccgattccgaccaacaagcggcacggggcggcgaagatcttcagccagcctgatgtcaaggctgaagaaccatggttcgggattgagcaggagtacacccttcttcagaaggacaccaactggcctcttggctggccattaggcggctaccctggccctcagggaccttactactgcgccgccggagcggacaaatcgtacgggcgggacatcgtggacgcgcactacaaggcctgcctctacgccggcatcgacatcagcgggatcaacggggaggtcatgccagggcagtgggagttccaggtcggccccaccgtcggcatctccgccggcgaccaggtctgggtggctcgctacattcttgagaggattaccgaaatcgctggcgtggtcgtctccttcgatcccaagccgattccgggagattggaatggcgctggtgctcacactaactacagcaccaagtcgatgaggagcaacggcgggtacgaggtgatcaagaaggcgatccagaagctgggcctccggcaccgggagcacatcgccgcgtacggggacggcaacgagcgccgcctcaccggccgccacgagaccgccgacatcaacaccttcatctggggtgtcgccaaccgcggcgcgtcggtgcgggtcggccgcgacaccgagaaggaaggcaaaggctacttcgaggaccggaggccggcgtccaacatggacccgtacgtggtgacctcgctgatcgcggagaccaccatcctgtgggagccgagccactccaacggcaacggcgtcgcggctgcttgatggttcttcccggatagatccaccggaggagtcacaccggttttctttcggccccgggtgtgt

SEQ ID NO: 45201 - protein, 367 aa, Panicum virgatum
  misc_feature: Ceres CLONE 2023817
  misc_feature (103)..(355): Pfam Name: Gln-synt_C Pfam Description: Glutamine synthetase, catalytic domain
  misc_feature (17)..(97): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MAQLADLINLDLSDCTEKIIAEYIWVGGSGMDVRSKARTLSGPVDDPSKLPKWNFDGSSTGQATGDDSEVILCPQAIFRDPFRKGKNILVMCDCYAPNGEPIPTNKRHGAAKIFSQPDVKAEEPWFGIEQEYTLLQKDTNWPLGWPLGGYPGPQGPYYCAAGADKSYGRDIVDAHYKACLYAGIDISGINGEVMPGQWEFQVGPTVGISAGDQVWVARYILERITEIAGVVVSFDPKPIPGDWNGAGAHTNYSTKSMRSNGGYEVIKKAIQKLGLRHREHIAAYGDGNERRLTGRHETADINTFIWGVANRGASVRVGRDTEKEGKGYFEDRRPASNMDPYVVTSLIAETTILWEPSHSNGNGVAAA

SEQ ID NO: 45202 - DNA, 700 bp, Panicum virgatum
  misc_feature: Ceres CLONE 2023818
  misc_feature: Encodes the peptide sequence at SEQ ID NO. 45203
aaccagctccagaaccctcgaaaggcaagcgacgaaggcaagatacgcccacccacctgctccggcgatgcagcagcagatgcccatgcagccggcgcccgccggcgccgcggcggcggcgcccccggcggccggcatcaccaccgagcagatccaaaagtatttggatgaaaataagcagcttattttggccatcctggaaaatcagaacttaggaaagttggctgaatgtgctcagtatcaagctcagcttcaaaagaatctcttgtacctggctgcaattgcagatgcccaaccccaaccaccacagaaccctgcaagtcgcccacagatgatgcaacctggcatggtaccaggtgcagggcattacatgtcccaagtaccaatgttcccgccaagaacaccattaaccccgcaacagatgcaagaacagcagcagcagcaacttcaacagcagcaagcacaggctcttgctttcccgggacagatggtcatgagaccggctaccattaacggcatgcagcctatgcaagccgaccctgctgccgtcgccagcctacagcagtcagcgcctgtccctgctgatgggcgaggaggcaagcaggacgcaactgctggggtgagcacagagccttctggcaccgagagccacaagagcacaaccggggcagatcacgatgtgggcagtgatgtggtggag

SEQ ID NO: 45203 - protein, 210 aa, Panicum virgatum
  misc_feature: Ceres CLONE 2023818
  misc_feature (21)..(84): Pfam Name: SSXT Pfam Description: SSXT protein (N-terminal region)
MQQQMPMQPAPAGAAAAAPPAAGITTEQIQKYLDENKQLILAILENQNLGKLAECAQYQAQLQKNLLYLAAIADAQPQPPQNPASRPQMMQPGMVPGAGHYMSQVPMFPPRTPLTPQQMQEQQQQQLQQQQAQALAFPGQMVMRPATINGMQPMQADPAAVASLQQSAPVPADGRGGKQDATAGVSTEPSGTESHKSTTGADHDVGSDVV

SEQ ID NO: 45204 - DNA, 672 bp, Panicum virgatum
  misc_feature: Ceres CLONE 2023828
  misc_feature: Encodes the peptide sequence at SEQ ID NO. 45205
ccccttccccaccgccactctacccgcgcgcagccagagccagccaggaggaggaacaggagcggcgccgggcggagcacgcgaggcatggatagataccacagggtagagaagccccggaatgacacccccatcagccagaatgagatcagaatcactacacaggggaggatgaggaactatatcagctatgggatgtctttgcttgaggaaaatggccatgatgagattagtatcaaggccatggggcgggccataaataagacagttatggttgtggaattgatcaagagaagagttggaggtcttcatcagaacactgttactgaatctgttgatatcacggacacatgggagcctttggaagaaggccttctcccactagagacaactcgccatgtatcaatgatcactgtgaccctatccaagaagcctctggatacatcatctccagggtaccagccaccaatcccagctgaagaggtgaaacctgctttcgactatgatcatgaagattcctacccccctggtcgcggaagaggtcgtggtggtgggaggagaggcaggggaagaggaatgagcaatggcccccctccacctgcatacggctaccatgaagagtgggaggaggaaggagattattacaacagagggcgtgggagagggaggtcg

SEQ ID NO: 45205 - protein, 194 aa, Panicum virgatum
  misc_feature: Ceres CLONE 2023828
  misc_feature (17)..(87): Pfam Name: Alba Pfam Description: Alba
  misc_feature: SWISSPROT Homolog: EC 3.1.26.5 Ribonuclease P
MDRYHRVEKPRNDTPISQNEIRITTQGRMRNYISYGMSLLEENGHDEISIKAMGRAINKTVMVVELIKRRVGGLHQNTVTESVDITDTWEPLEEGLLPLETTRHVSMITVTLSKKPLDTSSPGYQPPIPAEEVKPAFDYDHEDSYPPGRGRGRGGGRRGRGRGMSNGPPPPAYGYHEEWEEEGDYYNRGRGRGR

SEQ ID NO: 45206 - DNA, 652 bp, Panicum virgatum
  misc_feature: Ceres CLONE 2023831
  misc_feature: Encodes the peptide sequence at SEQ ID NO. 45207
atccattcagagctctcgcttcgaaactgaaccagcacacccagctgccgttgccgtttctagagaactccctgccgttcgagatcccgctcgccacgatgcctgctctcgccaagcccgcctcgcggcccgccaagaccgccgcggcgccgaagccgaagcccgccgccgccaagcccaaggccgcggccgccgctggcgcctcgcacccgccctacttcgaggtgagcactgtccgatccccgtctggtttcgtcttcgattggggctgttccgtggtgagtgcgggctgatcgggattttggttttgttccttgcagatgatcaaggaggcgatcacggcgctcaaggagaggaccggctcgagctcgcacgccatcgccaagtacatggaggacaagcacggcccgtcgctgccggccaactacaagaagatgctctccatccagctccgcgggttcgccgccaagggcaagctcgtcaaggtcaaggcctcgtacaagctctccgacgccgccaagaaggaggcgcccaaggccaagaccgccgcggccaagccagccaaggccgccgcgaaaccgaagaagagtgccgccgccgccgccgccgccgccgccgccgccgccaagcccaagaagaccgccgccgggac

SEQ ID NO: 45207 - protein, 110 aa, Panicum virgatum
  misc_feature: Ceres CLONE 2023831
  misc_feature (1)..(64): Pfam Name: Linker_histone Pfam Description: linker histone H1 and H5 family
  misc_feature: Functional homolog of the protein sequence given in SEQ ID NO 50919
  misc_feature: Useful for making plants with modulated nitrogen use efficiency
  misc_feature: Useful for making plants with modulated oxidative stress sensitivity
MIKEAITALKERTGSSSHAIAKYMEDKHGPSLPANYKKMLSIQLRGFAAKGKLVKVKASYKLSDAAKKEAPKAKTAAAKPAKAAAKPKKSAAAAAAAAAAAAKPKKTAAG

SEQ ID NO: 45208 - DNA, 1119 bp, Panicum virgatum
  misc_feature: Ceres CLONE 2023849
  misc_feature: Encodes the peptide sequence at SEQ ID NO. 45209
ctggccgcaccacccgcctccagtccttcggtttcctcccttttctccccacggcgcgcggcagcggcaggcagcctcccctctccgaggagggtgctaaaaccctagagcccctcgcgaaagggtctcttcgcctcgctcgccatgcggaccgccgaggagaagggcaagagggcgaggaccgacggcgccgagggcgacgggggagagcccatcgaccgcgccctcctgctctccatcgagaagctccaggaggtccaggacgagatcgagaaggtaaatgaggaagcaagcgataaggttttagaggtggaacagaaatacaataaaattcgcagaccagtttatgttcgacgcaatgaaattatccagaagattccagacttctggctgacagcgttccttagccatcctgtgcttggtgatcttttaaccgaggatgatcaacagatttgcaaacacttggagtccgtttttgtggacgagtcagaggatattaaatcgggctgctctattactcttaccttttcttcaaatccatattttgaagawaaaaagcttacaaagacatattccatgagtgatgatggaacagtcacagtaaaggctacctccattaagtggaaggcaggaatggatattgtcaacggaaaggcatgcaccaagaagggtgaaaagcgactactggttgatcaaagctgcttcacttggttcaatggagcaaagaatgaaagttttgctcatggtgagatggatcaggtggcagatatcatcaaggaagacttgtggcctaatcctttgaagtatttcaacaatgagctagaaagtgagtttgaacaagagagtgatgaagagggatctgatgaggaagccaaagatgacgatgaagatgagggggctgaagaggagacctgagccctcctgttccaattgggtctgataacttatgtctgcagaatgcgtgagactgggccctccaaagggctgatgaaacagaggcgtccccttttgcggtgttttagtgcttgccttagttggaggtttaggagctattttcacaacttcagtttatcggtcgagaagcaactctttgctctactggataagatttctgtactt

SEQ ID NO: 45209 - protein, 256 aa, Panicum virgatum
  misc_feature: Ceres CLONE 2023849
  misc_feature (32)..(228): Pfam Name: NAP Pfam Description: Nucleosome assembly protein (NAP)
  misc_feature (136)..(136): Xaa is any aa, unknown, or other
MRTAEEKGKRARTDGAEGDGGEPIDRALLLSIEKLQEVQDEIEKVNEEASDKVLEVEQKYNKIRRPVYVRRNEIIQKIPDFWLTAFLSHPVLGDLLTEDDQQICKHLESVFVDESEDIKSGCSITLTFSSNPYFEXKKLTKTYSMSDDGTVTVKATSIKWKAGMDIVNGKACTKKGEKRLLVDQSCFTWFNGAKNESFAHGEMDQVADIIKEDLWPNPLKYFNNELESEFEQESDEEGSDEEAKDDDEDEGAEEET

SEQ ID NO: 45210 - DNA, 1231 bp, Panicum virgatum
  misc_feature: Ceres CLONE 2023851
  misc_feature: Encodes the peptide sequence at SEQ ID NO. 45211
cccccaaatcccaatcgaacccgcccgccgctccccccaaaccctcgccctgctcgagaacctctccgccgccgccggccgccgtctccgccccaccggccgccatggctcgcaacgaggagaaggcgcagtcgatgctgaaccgcttcatcacgatgaagcaggaggagaagcgcaagccccgcgagcgccggccctacctcgcctccgagtgccgcgacctcgccgacgccgagcgctggcgctccgagatcctccgcgagatcggcgccaaggtcgccgagatccagaacgagggcctcggcgagcaccgcctccgcgacctcaacgacgagatcaacaagctcctccgcgagcgcggccactgggagcggcgcatcgtcgagctcggcggccgagactactcccgcagctccaacgcgccgctcatgaccgacctcgacggcaacatcgtcgccgtccccaacccctccggccgtgggccggggtaccgctacttcggcgccgccaggaagctccccggcgtgcgggagctctttgacaagccgcccgagacgcggaagcggcgcacccgctacgagatccacaagcgcatcaacgccgggtactacgggtactatgatgacgaggacggcgtgctggagcgccttgaggcccctgcagagaagcgcatgcgggaggaggttgttacagagtggcaccgcgtggagcgggtgcggcgggaggccatgaagggggtggtgagcggcgaggtggctgctgccggtgggcgcagtggggatgctgctagggaggtgctgtttgagggggtggaggaagaggtcgaagaagagaggaagcgcgaggaagagaagtgggaaagggagaaaggggaggatgctgggagggaatttgttgcacatgtgccgctacctgatgagaaggagattgagcgtatggtcttagagaggaagaagaaggagctgcttagcaagtatgcaagcgataccctgctcgttgagcaggaggaggccaaggagatgctcaatgtgcgacgatagaagaggcggcccgttcttgatttacatgcctccaatgaaaacttttaacttatgttagtgatcttgactttaagtactgtatgttcaatatgctttagagctaagatgagtgttcttatttttttgctgctgtctgaattatttgcgccattactgttggtgtagtctagctgcaaagaactcatttgacg

SEQ ID NO: 45211 - protein, 311 aa, Panicum virgatum
  misc_feature: Ceres CLONE 2023851
  misc_feature (1)..(292): Pfam Name: Isy1 Pfam Description: Isy1-like splicing family
MARNEEKAQSMLNRFITMKQEEKRKPRERRPYLASECRDLADAERWRSEILREIGAKVAEIQNEGLGEHRLRDLNDEINKLLRERGHWERRIVELGGRDYSRSSNAPLMTDLDGNIVAVPNPSGRGPGYRYFGAARKLPGVRELFDKPPETRKRRTRYEIHKRINAGYYGYYDDEDGVLERLEAPAEKRMREEVVTEWHRVERVRREAMKGVVSGEVAAAGGRSGDAAREVLFEGVEEEVEEERKREEEKWEREKGEDAGREFVAHVPLPDEKEIERMVLERKKKELLSKYASDTLLVEQEEAKEMLNVRR

SEQ ID NO: 45212 - DNA, 665 bp, Panicum virgatum
  misc_feature: Ceres CLONE 2023859
  misc_feature: Encodes the peptide sequence at SEQ ID NO. 45213
ggtagcagccggttcacttctccaggtaaggtaaagggttgggactcatggcgccgacgcagcccaagtccggcctcttcgtgggcatcaacaagggccatgtcgtcaccaagcgcgagctgccgccgcgcccgtcccaccgcaaggggaaagcaacgaagcgggtgaccatggtcaggggcctgatcagggaggttgctgggtttgctccttatgagaagcgaatcactgagcttctgaaggttggcaaggacaagcgtgctctgaaggttgctaaaagaaagctcggaactcacaagagggcaaagaagaagagagaggagatggccaatgtcctcaggaagatgagatctgctggtacccacactgataagaagaaatagagcatctcaagtccgtgaagctgggggcaacattctcctgtgtcggttttccctacctgtagaacctaatagacttgtcaaagtacctgccaggtgccagcaaaacatcgtgttgttagttatgtgttgaaccaccccatgagtttttgatccaactttgaatgcatctatggtttgtctatcctttgctgtggtttacaataccttctatcttgttcacttccgtgattttgggttacttacccgttgccaggcattaacggtactgcattgttgttgtct

SEQ ID NO: 45213 - protein, 111 aa, Panicum virgatum; identical to SEQ ID NO: 12334
  misc_feature: Ceres CLONE 2023859
  misc_feature (5)..(103): Pfam Name: Ribosomal_L36e Pfam Description: Ribosomal protein L36e

SEQ ID NO: 45214 - DNA, 597 bp, Panicum virgatum
  misc_feature: Ceres CLONE 2023879
  misc_feature: Encodes the peptide sequence at SEQ ID NO. 45215
atccagcatccacggaccacacgcacggccgccgctactccatccacctctccatcctccatcctcacactggcaccgagctctccaagcccctctgctctgctctgggccattcactctgcagctcctcctcgctcggtcgctccgctccgctcccatccgcccaaccaccgcgaccgccagctcctcctctagatcggcgggcgggcaccggccggcgatgacatccgccgtcgccaccaccgtagggtgcggggtccttcccttccgcccgtcctctacggcgcccacacgacgaccccgcggcagatgggttgtccgagctcaagccgcaggagcggacgcctccgacgacaagtcggtggagatcatgcgcaagttctccgagcagtatgcccgccgctccaacacctacttctgcgcggacaaaaccgtcactgccgttgtcatcaagggacttgctgatcacaaggatacattcggagctcctctgtgcccttgtaggcattatgatgacaaagctgccgaggtagcacaaggattttggaactgcccatgcgttcccatgcgtgagaggaaggaatgccactgtatgct

SEQ ID NO: 45215 - protein, 125 aa, Panicum virgatum
  misc_feature: Ceres CLONE 2023879
  misc_feature (46)..(125): Pfam Name: FeThRed_B Pfam Description: Ferredoxin thioredoxin reductase catalytic beta chain
  misc_feature: Functional homolog of the protein sequence given in SEQ ID NO 50461
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MTSAVATTVGCGVLPFRPSSTAPTRRPRGRWVVRAQAAGADASDDKSVEIMRKFSEQYARRSNTYFCADKTVTAVVIKGLADHKDTFGAPLCPCRHYDDKAAEVAQGFWNCPCVPMRERKECHCM

SEQ ID NO: 45216 - DNA, 1061 bp, Panicum virgatum
  misc_feature: Ceres CLONE 2023886
  misc_feature: Encodes the peptide sequence at SEQ ID NO. 45217
ctcttcgaacgcttctgacggctgccgcgccgccctcacgagccgcgccaatctgccgcgttctgctcggccgcgccgctgcggtgatctcccgccgccagaggcgaagctccgtatccttcgcgcgcggatcacctgccgccgccatgacggagtactgggtgagccagggaaacaaatggtgcgacttctgcaagatttttatatcgaacaatccctttagcatcagaacacatgaacttggtaagcgccacaaggacaatgtcaccaaaagattatcgacgatgcaaaaggatagtgatgcgaaggacaaggaacagcagcaagctgcccgagccctccagcagatcgaagctaaagctaaaaagagctatcaaaaggacttggagaatagccagaggaatgtggatggagacacttctgcagcaccaggagatggatgggtattcgactcaacatcaggatattattgcgacaaatctactggaatttactacgattcaaactccggtttctattattctgatggtttagggaaatgggttactcaagaagaggcgtacaaatctgtgcaaagttccaaaacagatgttggtcaatcttcaacttcacaagcaaaagctcttgctgctgcggcaacggctgtgcccgcaattaaaggaggtccagctccaggtcgggttgtcacaaaaccattgaacccgatgagacctatcaagggcaagggcactcccgctccatctgctgtagctgttaacaagaggaagagagaagatggcaagcctaaggtgatgtccaaggaggaagcggccctcaaagcccgtgaagcagcgagaaagagagtagaggatagagagaagccgctgatgggattatacaagacgtactaaggtgtcttgtctatcatccttcccggacttctctctccccctatgtgccaaatgattgccctacttgatgttgtaagaaatattgacaaatggtgctctgagaaaaaaaatgggcagggtttcagagatgtaaaaaacaacatgttcattgaatattgttttcgtgaatgc

SEQ ID NO: 45217 - protein, 247 aa, Panicum virgatum
  misc_feature: Ceres CLONE 2023886
  misc_feature (8)..(44): Pfam Name: zf-U1 Pfam Description: U1 zinc finger
MTEYWVSQGNKWCDFCKIFISNNPFSIRTHELGKRHKDNVTKRLSTMQKDSDAKDKEQQQAARALQQIEAKAKKSYQKDLENSQRNVDGDTSAAPGDGWVFDSTSGYYCDKSTGIYYDSNSGFYYSDGLGKWVTQEEAYKSVQSSKTDVGQSSTSQAKALAAAATAVPAIKGGPAPGRVVTKPLNPMRPIKGKGTPAPSAVAVNKRKREDGKPKVMSKEEAALKAREAARKRVEDREKPLMGLYKTY

SEQ ID NO: 45218 - DNA, 734 bp, Panicum virgatum
  misc_feature: Ceres CLONE 2023888
  misc_feature: Encodes the peptide sequence at SEQ ID NO. 45219
gggatggacgatattcaaatagagagtcacgatgtcactaggattgaaaggattggagcacacagtcatattcgaggactaggtctatcccaagacttacaacctaaattagttgctgatggaatggttggtcagctagcggctcgccgtgcttgtggagtagttctcagaatgattcaagctggaattattgcaggccgaggtgttcttttagcaggaccagcaggaagtggaaaaacagcattagcaatgggtcttgcaaagtctcttggacctgatgtaccttttgtttcaatttctggttcagaaatctactctcttgaaatgtccaaaacagaagcactcactcaagctctcagacgagcaattggtgtccgaattaaagaggaaaccgaaatcatcgaaggagaggttgttgagcttgtcatcgaacgaccacaaagcggtggaaccaaaattggtaaacttacaatcaaaaccactgatatggaaacaatctatgacttgggagaaaaaatgatcgatgctcttttaaaagaaaaggctcaatcaggtgatattattcaaattgacaaagccagtggaaaaattactaaacttggacgttcgcatacacgaacacatgattacgaggttatgcctcggggtgtagcttttgtaaattgtcctgaatggagacttcaaagaagacatgaagttgtccataaagtaagtcttcatgaaattgatgtcat

SEQ ID NO: 45219 - protein, 243 aa, Panicum virgatum
  misc_feature: Ceres CLONE 2023888
  misc_feature (119)..(243): Pfam Name: TIP49 Pfam Description: TIP49 C-terminus
MDDIQIESHDVTRIERIGAHSHIRGLGLSQDLQPKLVADGMVGQLAARRACGVVLRMIQAGIIAGRGVLLAGPAGSGKTALAMGLAKSLGPDVPFVSISGSEIYSLEMSKTEALTQALRRAIGVRIKEETEIIEGEVVELVIERPQSGGTKIGKLTIKTTDMETIYDLGEKMIDALLKEKAQSGDIIQIDKASGKITKLGRSHTRTHDYEVMPRGVAFVNCPEWRLQRRHEVVHKVSLHEIDV

SEQ ID NO: 45220 - DNA, 682 bp, Panicum virgatum
  misc_feature: Ceres CLONE 2023891
  misc_feature: Encodes the peptide sequence at SEQ ID NO. 45221
gcatcagataagccagccgtctcctctgaataagcagcccaaagggctcctctactactgtcagagagaagcaggggaaaagatggtgaagcttgcatttggaagcttgggcgactctttcagcgtggcgtccctcaaggcctatgtcgccgaattcattgccacgctcctcttcgtgttcgccggcgtcggctccgccattgcctactcgcaattgacaaagggcggcgcgctggaccccgccggcctggtggccatcgccatcgcccatgcgttcgcgctcttcgtcggtgtctccatggccgccaacatctccggcgggcacctgaaccccgccgtcaccttcggcctcgccatcggcggccacatcaccatcctcaccggcatcttctactgggtcgcccagctgctcggcgcctccgtggcgtgccttctcctgaagttcgtcacccacggaaaggccatcccgacgcacggcgtgtccggcatcagcgagatcgagggcgtggtgatggagatcgtgatcaccttcgcgctggtgtacaccgtgtacgccaccgcggcggacccgaagaagggctccctgggcaccatcgcccccatggccatcggcttcatcgtgggcgccaacatcctggccgcggggcccttcagcggcggctccatgaacccggcccgctcc

SEQ ID NO: 45221 - protein, 199 aa, Panicum virgatum
  misc_feature: Ceres CLONE 2023891
  misc_feature (11)..(199): Pfam Name: MIP Pfam Description: Major intrinsic protein
MVKLAFGSLGDSFSVASLKAYVAEFIATLLFVFAGVGSAIAYSQLTKGGALDPAGLVAIAIAHAFALFVGVSMAANISGGHLNPAVTFGLAIGGHITILTGIFYWVAQLLGASVACLLLKFVTHGKAIPTHGVSGISEIEGVVMEIVITFALVYTVYATAADPKKGSLGTIAPMAIGFIVGANILAAGPFSGGSMNPAR

SEQ ID NO: 45222 - DNA, 719 bp, Panicum virgatum
  misc_feature: Ceres CLONE 2023898
  misc_feature: Encodes the peptide sequence at SEQ ID NO. 45223
acccaacacagcagcgaacctagtgtgggaagctgaagcactgatccggtatgggtgcggcaggcgcgccgaagatcatggcggtcctggctctcgcgctagctctcctctgcgctgccgccgagccggccgccgcgcagaactgcggctgccagccgggctactgctgcagcaagtacggctactgcggcctgggcgacccctactgcggcgagggatgccggtcgggcccgtgctactcgggaggcggtggtggtggcggcggcggaagcggcggccgcggcgcgaacgtggctagcgtcgtcaccgacgcgttcttcaacggcatcaagaaccaggccgggggcgggtgcgagggaaagaacttctacacgcggagcgcgttcctgagcgcctccaacaagtactccggcttcgcccacggcggctccgaggtcgagggcaagcgcgagatcgccgccttcttcgcgcacgtcacgcacgagacagggcatttctgctacatcagcgagatcaacaagaacaacaactactgcgatgccagcaacacgcagtggccgtgcgcggcggggaagaagtactacgggcgcggcccgctgcagatctcgtggaactacaactacgggcccgccgggagggacaacggcttcgacgggctgcggaacccggacgcggtggcgcaggacgccgtgatcgcgttcaggcggcgctctggtact

SEQ ID NO: 45223 - protein, 213 aa, Panicum virgatum
  misc_feature: Ceres CLONE 2023898
  misc_feature (75)..(213): Pfam Name: Glyco_hydro_19 Pfam Description: Chitinase class I
  misc_feature (20)..(53): Pfam Name: Chitin_bind_1 Pfam Description: Chitin recognition protein
  misc_feature: SWISSPROT Homolog: EC 3.2.1.14 Chitinase
  misc_feature: The sequence is a functional homolog of SEQ ID NO 12 in US patent 7087810
MAVLALALALLCAAAEPAAAQNCGCQPGYCCSKYGYCGLGDPYCGEGCRSGPCYSGGGGGGGGGSGGRGANVASVVTDAFFNGIKNQAGGGCEGKNFYTRSAFLSASNKYSGFAHGGSEVEGKREIAAFFAHVTHETGHFCYISEINKNNNYCDASNTQWPCAAGKKYYGRGPLQISWNYNYGPAGRDNGFDGLRNPDAVAQDAVIAFRRRSG

SEQ ID NO: 45224 - DNA, 835 bp, Panicum virgatum
  misc_feature: Ceres CLONE 2023934
  misc_feature: Encodes the peptide sequence at SEQ ID NO. 45225
aagacggcgacctaaaaacgccgccgccgccatggccgatgagaccgacaccaggcccacgtccgccggctcccggggccgctccgtgccggacgacaacgacagggaggagggcgagatcaccgacgactcctccgcgcccaccccgccgctccaccccgccacgcacccactcgagcactcctggaccttctggttcgacaacccgttcggaaaatccaagcaggccgcatgggggagctccatccgacccatccacaccttctccaccgtcgaggacttttggggcctttacaataatattcaccaccctagcaagttggctgtgggagcggacttccattgcttcaagaacaagattgaacctaaatgggaagaccctatttgtgctaatggcggtaaatggaccatcatctgtggcaaaggaaaatctgacacactgtggctgcacactgtaagcatcgggaagcagtggaaggaatttctggactacaaggattccattggattcatcgtccatgacgatgcaaagaagatggacaagggtccgaagaaccgttacacggtatgatcctggagctggaattcccagaggagcaggatcggatgatcccgatgcactagaatcttgctgtgagatgtttaggcatgcataatctaacatgtcgcatctatattcctgtactgtactcgataagtaagccacttcttagtgttgttttgtctcactgctgtgcttttactatgtacgcgtgaaactgagctgtgggaataatgtactgaataatgagcttaatttgatctggactgcatgcagtgcagtacgaatgctagc

SEQ ID NO: 45225 - protein, 179 aa, Panicum virgatum
  misc_feature: Ceres CLONE 2023934
  misc_feature (1)..(179): Pfam Name: IF4E Pfam Description: Eukaryotic initiation factor 4E
MADETDTRPTSAGSRGRSVPDDNDREEGEITDDSSAPTPPLHPATHPLEHSWTFWFDNPFGKSKQAAWGSSIRPIHTFSTVEDFWGLYNNIHHPSKLAVGADFHCFKNKIEPKWEDPICANGGKWTIICGKGKSDTLWLHTVSIGKQWKEFLDYKDSIGFIVHDDAKKMDKGPKNRYTV

SEQ ID NO: 45226 - DNA, 1433 bp, Panicum virgatum
  misc_feature: Ceres CLONE 2023954
  misc_feature: Encodes the peptide sequence at SEQ ID NO. 45227
gctgaaaattttgctaaaagcgagcgagtgaatcctcgtctttccggccctttgttgaccggcgatgtcgggcggcgacaagcagacgacggcgtgcgtgaccggcgggaacgggtacatcgcctccgccctcatcaagacgctgctgcacaagggctacgccgtgaagacgacggtcaggaaccgcgatgacatggccaagaactcgcacctcgaggacttgcaggcaatcggccccctgcaggtcctccgcgccgacctggatgaagacggcagctttgacgaagccgtcgccggctgcgactacgccttcctcgtcgctgctccgatgaacctcaaatcggagaatcctgagaaagagctgatcgaggccgccgtccgtggaaccctgaacgtcttgaggtcgtgcgtgaaagcgggcaccgtgaagcgcgtggtcctgacctcgtcggcggccgccgtctccaccaggccgcagctgcaaggcgacggccacgagctggacgaggagtcctggtccgacgtcgactacctcactgccaacaagactggcctctgtgtacgctcgcggctcgcacaccaccaccacaccctgacacccgcataggcgtacccggtctccaaggtgctcgtggagaaggaggcgtccaggttcgcgcaggagcacggcatgagcctggtcaccgtctgtccccccgtcgtcgtcggcgcgtcaccggccagaaggaaccacaccagcgttcccgccaacctctctttgctatccggtgagaagcagaataattttctgtcgaagcgccaagccagaagccacccaccatccatgagaccatgatacgtgcgcaagtgtcctggtaattctgcgtcattttcaggtgaccaagcagcgttcgcggtgctgaaagccatcgagagggacaccggctgtatgccgctggtacacgtggacgacctctgccgcgccgaggtgttcgtcgctgaggcggcggcggcggccgcggggaggtacatctgctgcagcctcaacacgaccatcgtcgacatcgcccgtttcctggcacacaagtatccacagtacaatgtgaacacaaaaaatctctccgtcgaggtgcttgagaaacccagagtgtgcctctcgtcagcaaagctcatcagggaagggtttcagtacaagtacaggaccctggatgagatatacgtcgacttcgtggagtacgggaaggctctgggcattctgcccaactgatgtgtgatgctcctcctctgcttttcggtcggtggtaatcaggattcagaacaccaaaaccatgtggctgcagaataaatctcggttcgttcagtttgtataaaactagagatgtggccagtgtcaagaaataattgtcgcaacaaaagacttgtacagattgaaacagcaagacctaaattccgcc

SEQ ID NO: 45227 - protein, 180 aa, Panicum virgatum
  misc_feature: Ceres CLONE 2023954
  misc_feature: SWISSPROT Homolog: EC 1.3.1.77 Anthocyanidin reductase
MSGGDKQTTACVTGGNGYIASALIKTLLHKGYAVKTTVRNRDDMAKNSHLEDLQAIGPLQVLRADLDEDGSFDEAVAGCDYAFLVAAPMNLKSENPEKELIEAAVRGTLNVLRSCVKAGTVKRVVLTSSAAAVSTRPQLQGDGHELDEESWSDVDYLTANKTGLCVRSRLAHHHHTLTPA

SEQ ID NO: 45228 - DNA, 708 bp, Panicum virgatum
  misc_feature: Ceres CLONE 2023975
  misc_feature: Encodes the peptide sequence at SEQ ID NO. 45229
actcacaccacaccagaggcatcggtttcctaggacgccatccagaggcggcggctggtgctgggatctccaatatattattctatccaagcgatagatagatagatagatgccggcagcgatggcttctggttccagcaggctcgtcgtgatgagaacaacgctgctggtgctcggcgccgtgtgctcggcggcgctgctcgccggcgtcgcgagcgccgccggcagcttctaccaggacgtggacatcacctggggcgacggccgcggcaagatcctcaacggcggccagctcctgacgctgtccatggaccgggcctccgggtcggggttccagtccaggagccagtacctctacggccgcttcgacatgcagctcaagctcatccccggcgactccgccggcacggtcaccaccttctacctgtcgtcgcaggggtcgcagcacgacgagatcgacttcgagttcctggggaacgcgagcggcgagccgtacacggtgcacaccaacgtgtacagccagggcaagggcggccgcgagcagcagttccgggtgtggttcgaccccacggcggacttccacacctactccgtggtctggaaccccagccacatcgtcttctacgtggacggcgtgcccatccgcgacttccgcgcccgcgccgccgccgccgccggggtgccgttccgggccagccagccgatgcg

SEQ ID NO: 45229 - protein, 195 aa, Panicum virgatum
  misc_feature: Ceres CLONE 2023975
  misc_feature (37)..(195): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50903
  misc_feature: Useful for making plants with altered carbohydrate content
  misc_feature: Functional homolog of the protein sequence given in SEQ ID NO 51497
  misc_feature: Useful for making plants with altered cell wall content and/or composition
MASGSSRLVVMRTTLLVLGAVCSAALLAGVASAAGSFYQDVDITWGDGRGKILNGGQLLTLSMDRASGSGFQSRSQYLYGRFDMQLKLIPGDSAGTVTTFYLSSQGSQHDEIDFEFLGNASGEPYTVHTNVYSQGKGGREQQFRVWFDPTADFHTYSVVWNPSHIVFYVDGVPIRDFRARAAAAAGVPFRASQPM

SEQ ID NO: 45230 - DNA, 706 bp, Panicum virgatum
  misc_feature: Ceres CLONE 2023978
  misc_feature: Encodes the peptide sequence at SEQ ID NO. 45231
agtttatcaaggtacattaccgcatggacaagaagttgcagtaaaagtccgatcaagctcatcaacacagggaacacgtgagtttaacaatgagttaggacttctttctgctatatggcatgagaatttggtcccacttattggctactgctgtgaaaaggatcaacagatattggtatatccattcatgtccaatggctcactacaggatcgcctctatggtgaggcatctaaaaggaaagttcttgattggcctaccagactatctgtttgtattggtgcagcaagagggctggtatatctacacaattttgcagggcgttgtatcatccacagagatattaaatcaagcaacatacttctggatcatagcatgtgtggcaaggtagccgatttcgggttttctaagtatgcaccacaggaaggtgacagcaatccatcaatggaagtgagaggaactgctggatatttggatcctgaatactattccactcaggtgttatccaccagaagtgatgtcttcagttttggagttgtcctgttagaaattgtgacaggaagagaacctcttgatgtcaaaaggccccgtgatgaatggagcttagttgagtgggcaaaaccttacataagggagtacaagatcgaagagatagtggatcctggcataaaagggcaatattgttcagaggccatgtggagagtgctt

SEQ ID NO: 45231 - protein, 234 aa, Panicum virgatum
  misc_feature: Ceres CLONE 2023978
  misc_feature (1)..(218): Pfam Name: Pkinase_Tyr Pfam Description: Protein tyrosine kinase
  misc_feature: SWISSPROT Homolog: EC 2.7.11.1 Non-specific serine/threonine protein kinase
VYQGTLPHGQEVAVKVRSSSSTQGTREFNNELGLLSAIWHENLVPLIGYCCEKDQQILVYPFMSNGSLQDRLYGEASKRKVLDWPTRLSVCIGAARGLVYLHNFAGRCIIHRDIKSSNILLDHSMCGKVADFGFSKYAPQEGDSNPSMEVRGTAGYLDPEYYSTQVLSTRSDVFSFGVVLLEIVTGREPLDVKRPRDEWSLVEWAKPYIREYKIEEIVDPGIKGQYCSEAMWRV

SEQ ID NO: 45232 - DNA, 688 bp, Panicum virgatum
  misc_feature: Ceres CLONE 2023997
  misc_feature: Encodes the peptide sequence at SEQ ID NO. 45233
aggcccagttcccagcctctgtttctgttcctcctcctcccctcacctccccgctcccctactccccggtcctcctcgagatctccaaggccacgagcgcttccgcaccgctccgcctccgccgcgtccgccgctcgcgattttggccgccgccgggggagatggcaggcctgggaaaggcgatgtacgcggtggggttctggatccgggagaccggccaggccctcgaccgcctcggctgccgcctgcagggcaaatacttcttccacgagcagatttcaaggcatcgcacgctcatgaacatctttgacaaaacccctcatgttcatagagatgcatttgttgctccaagtgcatcgcttattggtgatgttcaagttggaccaggagcttccatttggtatgggtgcgtcctaagaggggatgcaaacaacatccagattggatctgggaccaatatacaagacaattctcttgtacatgtggcgaagtcgaatctaagtgggaaagtctttccgacaattatcggtgaaaatgtcacagtaggtcatagtgctgtcttacaaggatgcaccatcgaggatgaagcttttgttggcatgggggcaaccctattggatggtgttgttgtggaaaagcatggaatggttgctgctggagccctcgtaagacagaatactaggatccc

SEQ ID NO: 45233 - protein, 175 aa, Panicum virgatum
  misc_feature: Ceres CLONE 2023997
  misc_feature: SWISSPROT Homolog: EC 4.2.1.1 Carbonate dehydratase
MAGLGKAMYAVGFWIRETGQALDRLGCRLQGKYFFHEQISRHRTLMNIFDKTPHVHRDAFVAPSASLIGDVQVGPGASIWYGCVLRGDANNIQIGSGTNIQDNSLVHVAKSNLSGKVFPTIIGENVTVGHSAVLQGCTIEDEAFVGMGATLLDGVVVEKHGMVAAGALVRQNTRI

SEQ ID NO: 45234 - DNA, 711 bp, Panicum virgatum
  misc_feature: Ceres CLONE 2024001
  misc_feature: Encodes the peptide sequence at SEQ ID NO. 45235
gcttggagaaagtgtaaagtactcagaattgttttatggtcgccacttcaatgttgtttttattggcgcggtgctctttgctttacaacagttatctggcataaattctgtgttctatttctcctcaactgtgttcagaggtgtgggggtgcctgctaaccttgccaacataagcatggggatttcgaatctatcaggctccattatagcaatggttctaatggacaagttaggtagaaaaatgcttctttctgggagtttccttggaatggccttcgcaatggggcttcaggctgttggagcaaaccgtcagtttcttggttctacaagtgtatatctttcagttggtggaatgctgttgtttgtcttgtcattttcattaggagcaggcccagttcctggacttcttttgcctgagattttccccaataaaattcgagcgaaggctgtggctctctgcatgtctgtgcattggattgtaaacttctttgttagtctgctgttcttgcgtcttctggagcaacttggtccacaggttctgtacacaatattttcatcagtctgtgtgatagcttcaatatttgtgcggcgccatgtccttgaaacaaagggaaagacattgcaagagatagaagtttcactcctacaagcacaataaaggttctatctgggtggtacagattcggcgttgattggagtctgacatgacac

SEQ ID NO: 45235 - protein, 218 aa, Panicum virgatum
  misc_feature: Ceres CLONE 2024001
  misc_feature (1)..(214): Pfam Name: Sugar_tr Pfam Description: Sugar (and other) transporter
LGESVKYSELFYGRHFNVVFIGAVLFALQQLSGINSVFYFSSTVFRGVGVPANLANISMGISNLSGSIIAMVLMDKLGRKMLLSGSFLGMAFAMGLQAVGANRQFLGSTSVYLSVGGMLLFVLSFSLGAGPVPGLLLPEIFPNKIRAKAVALCMSVHWIVNFFVSLLFLRLLEQLGPQVLYTIFSSVCVIASIFVRRHVLETKGKTLQEIEVSLLQAQ

SEQ ID NO: 45236 - DNA, 702 bp, Panicum virgatum
  misc_feature: Ceres CLONE 2024004
  misc_feature: Encodes the peptide sequence at SEQ ID NO. 45237
acacaaactcatcagcagcagcttattactaagcaatactcaactcaagagagcgagtgtgggtgtgtgtgagagagagacggagagagatcgagcgagagcaaccgagatggcagctgccagcagcacgctctccttcccggtgatcaacatggagaagctccagaccgaggagaagccggcggccatggaggtcatccgcgacgcctgcgagaactggggcttcttcgagctgcttaaccatggcatctcccacgagctgatggacgaggtggagcggctgaacaaggcgcactacaccagctgccgcgagcccaagttccaggagttcgcggcgcggacgctggaggccggcgagaagggcgccgacgtcaaggacgtggactgggagagcaccttcttcgtccgccacctccccgcctccaacatcgccgacctccccgacctcgacgaccactacaggcaagtgatgaagcaattcgcgtcggagatacagaagctgtcggagaagctgctggagctgctgtgcgagaacctgggcctggagcaggggtacctgaagcaggccttcgctgggtcgaacggcccgacgttcggcaccaaggtgagcgcgtacccgccgtgcccgcggccggacctcgtcgacggcctccgcgcgcacaccgacgccggcggcatcatcctgctgttccaggacgacca

SEQ ID NO: 45237 - protein, 197 aa, Panicum virgatum
  misc_feature: Ceres CLONE 2024004
  misc_feature: SWISSPROT Homolog: EC 1.14.17.4 Aminocyclopropanecarboxylate oxidase
  misc_feature: Functional homolog of the protein sequence given in SEQ ID NO 50854
  misc_feature: Useful for making plants with modulated heat sensitivity
MAAASSTLSFPVINMEKLQTEEKPAAMEVIRDACENWGFFELLNHGISHELMDEVERLNKAHYTSCREPKFQEFAARTLEAGEKGADVKDVDWESTFFVRHLPASNIADLPDLDDHYRQVMKQFASEIQKLSEKLLELLCENLGLEQGYLKQAFAGSNGPTFGTKVSAYPPCPRPDLVDGLRAHTDAGGIILLFQDD

SEQ ID NO: 45238 - DNA, 658 bp, Panicum virgatum
  misc_feature: Ceres CLONE 2024005
  misc_feature: Encodes the peptide sequence at SEQ ID NO. 45239
acaaaacaaacgcaacgcatcgcggccgcttccccagtctctctggtccggtctccctcccctctgcggctctgccctcccaatccccgcccgcgagatcgccgcccccagggggccctagatcccgatggcctcgcgccggcgcaccctgctcaaggtcatcatcctcggcgacagcggggttgggaagacgtcgttgatgaaccaatacgtgaacaagaagttcagcaaccagtacaaggctacgattggcgcggatttcctcaccaaggaggtgcagttcgaggacaggctcttcactttgcaaatatgggacacagctggtcaggaaaggtttcagagtctcggtgttgcattctaccggggagcagattgttgtgtcctagtctatgatgttaattctatgaagtcatttgataatctgaacaactggcgtgaagagtttctaattcaggctagcccatcagatccggacaacttcccttttgttcttttgggtaacaaagttgatgtagatggtggcaacagccgtgtggtctccgagaaaaaggcaaaggcatggtgcgcctctaaagggaacatcccatactttgagacatctgcgaaggatggaacaaatgtcgaagatgctttccagtgtatcgtaaagaacgctctg

SEQ ID NO: 45239 - protein, 176 aa, Panicum virgatum
  misc_feature: Ceres CLONE 2024005
  misc_feature (10)..(176): Pfam Name: Ras Pfam Description: Ras family
  misc_feature (10)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50193
  misc_feature: Useful for making plants with modulated water use efficiency
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNA

SEQ ID NO: 45240 - DNA, 692 bp, Panicum virgatum
  misc_feature: Ceres CLONE 2024016
  misc_feature: Encodes the peptide sequence at SEQ ID NO. 45241
gcgcgatacagagaggcagaggagaggcaccctctcaagcctcaaaggcttcacgagacctcccctctgctgccatctcctctcctcccctcctctcctctgctgctgctgtgtgtgtgcaagaaaccccaagggagaggtgaaagcaagaggctaggcttcctcgacggagatgggggcgcagaggtacaggttcttcttctgcgggtgcggcgccaatgcggcggccggcgaccgtgagggcgacgacgacggggatttcggcgcgttcggggagaaggccgagaagggggccgaagccggcccgcgggggctgtcgtgggcgcaggtggaggcgatgaccggcgggttcacctccgccgtggtcggcgagggcgggttcagcaccgtgtacctcgcgcgcctctccggcgcgctcgccgccgtcaaggtccaccgcagcagcgagcgcctccaccgcgtgttccgccaggagctcgacgcgctccagcgcgtccggcacccgcacatcgtccgcctcctcgccttctgcgagcagcaagaggaaggcgtgctggtgctcgaattcgcggcgaacgggaacctgcacgagcggctccacggcgggggcaaggcggcgggggctatgccgtgggcgcggcgggtgtcggtggcgctgcaggtggcgcgggcgctcgagtacctgcacgacc

SEQ ID NO: 45241 - protein, 173 aa, Panicum virgatum
  misc_feature: Ceres CLONE 2024016
  misc_feature (61)..(173): Pfam Name: Pkinase_Tyr Pfam Description: Protein tyrosine kinase
  misc_feature: SWISSPROT Homolog: EC 2.7.11.1 Non-specific serine/threonine protein kinase
MGAQRYRFFFCGCGANAAAGDREGDDDGDFGAFGEKAEKGAEAGPRGLSWAQVEAMTGGFTSAVVGEGGFSTVYLARLSGALAAVKVHRSSERLHRVFRQELDALQRVRHPHIVRLLAFCEQQEEGVLVLEFAANGNLHERLHGGGKAAGAMPWARRVSVALQVARALEYLHD

SEQ ID NO: 45242 - DNA, 1127 bp, Panicum virgatum
  misc_feature: Ceres CLONE 2024023
  misc_feature: Encodes the peptide sequence at SEQ ID NO. 45243
atcgccatccgggctgcgcgacgcatcggcccggtcctgctccgcctctggctggccgctgccttcagcatcagccccctccgcgcgcgccgctgcgcgcccgtctcccgcccaccgccgtgcacgccgccggccgccaccgcccgcttctgcgcaccccgcgagctcccggccacccacctgccgctcgcctactgctccctctgccagcctcacttctctcccgagggcaaggaggggaaacggggagaagcagcgttacaagacaagagtagttgagaaatcacctggtgaagaggctggtataaaatcagcaacagttgaactagagggaagatatgcctatggctatctctctggtgagaaagggacacacaggattgtccgtcagtcaccatttaacgctaaagggcttcggcagacatcctttgctggtgttgaggttatgcctcttctaccggaggaatccatggctgtggaaatacctgaggaggacctggagataagcttcacaagagctggaggtaaaggaggccagaatgtgaataaggtggaaacggctgttcgcatggtccatattcctactggcattgcagttcgttgctcagaggagaggagtcagctggccaacaaaataaaggctctcagtcgactcaaagcgaagctgctggtgatcgcggaggaacaacgtgcatcggagatcaagcagatccgtggcgacatggtgaaggcggaatgggggcagcaaatacgcaactacgtcttccacccctacaagctcgtcaaggacgtccggacggggtgcgaaacctcggacatcaccggtgtcatggatggtgaactcgaccccttcgtcaaagcgtacctcaggtacaagctcaccgcagcaacttccagctgatgttgaggagcaaagcgacaagcagtgattggccccctatccagtagtatccattttttttttgaaaggagtagtatccatttttggtgcaaagttcatcgttttttatcttcttttcctgatgtagtagactttcattcatagtagtagcatcttatttcttgatttaggaatcgtaacggataaaaccaaaatggatgggttgcaccttgagttttttttttcc

SEQ ID NO: 45243 - protein, 299 aa, Panicum virgatum
  misc_feature: Ceres CLONE 2024023
  misc_feature (152)..(265): Pfam Name: RF-1 Pfam Description: Peptidyl-tRNA hydrolase domain
  misc_feature (49)..(121): Pfam Name: PCRF Pfam Description: PCRF domain
SPSGLRDASARSCSASGWPLPSASAPSARAAARPSPAHRRARRRPPPPASAHPASSRPPTCRSPTAPSASLTSLPRARRGNGEKQRYKTRVVEKSPGEEAGIKSATVELEGRYAYGYLSGEKGTHRIVRQSPFNAKGLRQTSFAGVEVMPLLPEESMAVEIPEEDLEISFTRAGGKGGQNVNKVETAVRMVHIPTGIAVRCSEERSQLANKIKALSRLKAKLLVIAEEQRASEIKQIRGDMVKAEWGQQIRNYVFHPYKLVKDVRTGCETSDITGVMDGELDPFVKAYLRYKLTAATSS

SEQ ID NO: 45244 - DNA, 1115 bp, Panicum virgatum
  misc_feature: Ceres CLONE 2024028
  misc_feature: Encodes the peptide sequence at SEQ ID NO. 45245
aaaaaaatgaatctcgtcccagaagctcagatcaaagacggttaacctcgattgcccagccaactaaccaacacaaacctgcttggcttccatccccttcttctccggagctagctctgcattgacgcccatggaaacgaccaagtccctggtcttactatgcacagtccttgcggcgtgcctcgcgctcgccgcagctggctggtctccgggcaccgccacgttctacggcggagccgatggctccggcacaatgggcggcgcgtgcggctacgacaacctgtacaacgcggggtacggcgtcaacaacgcggcgctgagcacggcgctgttcaacgacggcgcgtcctgcgggcagtgctacaagatcatctgcgaccggtcacgctcgggcggccagtactgcaagcccggcaacagcatcaccgtcacggccaccaacctgtgcccgcccaactacgcgctccccaacggcggctggtgcggcccggggcgcccccacttcgacatggcgcagccggcgtgggagcacatcggcgtctaccaggccggcgtcgtccccgtcctctaccagcaggtcaagtgctcgcacagcggcggcgtgcgcttcagcatcgccggctccaactacttcctgctcgtcaacatccagaacctcgccggcagcggctccgtggccgcggcctgggtcaagggcgacaagacggggtggatccagatgtccaggaactggggcgccaactggcaggcgctctccgggctcgtcggccagagcctcagcttcgccgtgaccagcaccggtgggcagtacattcagttcctgaacgtcgtgccgagctggtggcagttcggcatggccttctccaccaacaagaatttcgtccgctagctgaaccgtggaagcagcatagttctcgtatctcctttgcaaccaatttcggggtgttgttgtgtcgaatggcgagtgcgtgctcttgattttgatggagccatttaaatgcacttgtgccattgcatcctagttggccacctgaatggctttgtctcctacgtgatgctccgactgcgggaggaaatggcaagggtctttggaatgttgcatagaccttattatt

SEQ ID NO: 45245 - protein, 252 aa, Panicum virgatum
  misc_feature: Ceres CLONE 2024028
  misc_feature (60)..(147): Pfam Name: DPBB_1 Pfam Description: Rare lipoprotein A (RlpA)-like double-psi beta-barrel
  misc_feature (158)..(235): Pfam Name: Pollen_allerg_1 Pfam Description: Pollen allergen
  misc_feature: SWISSPROT Homolog: EC 3.2.1.4 Cellulase
  misc_feature: Functional homolog of the protein sequence given in SEQ ID NO 51623
  misc_feature: Useful for making plants with altered carbohydrate content
  misc_feature: Functional homolog of the protein sequence given in SEQ ID NO 51670
  misc_feature: Useful for making plants with altered cell wall content and/or composition
  misc_feature: Functional homolog of the protein sequence given in SEQ ID NO 50489
  misc_feature: Useful for making plants with altered lignin content
METTKSLVLLCTVLAACLALAAAGWSPGTATFYGGADGSGTMGGACGYDNLYNAGYGVNNAALSTALFNDGASCGQCYKIICDRSRSGGQYCKPGNSITVTATNLCPPNYALPNGGWCGPGRPHFDMAQPAWEHIGVYQAGVVPVLYQQVKCSHSGGVRFSIAGSNYFLLVNIQNLAGSGSVAAAWVKGDKTGWIQMSRNWGANWQALSGLVGQSLSFAVTSTGGQYIQFLNVVPSWWQFGMAFSTNKNFVR

SEQ ID NO: 45246 - DNA, 448 bp, Panicum virgatum
  misc_feature: Ceres CLONE 2024028-R
gttttttgggcccgcccccggttaaagggggcaaaaaggggggggtcctctttttcggggaaggggggggccaacgggggggggtttttggggtttttgggcgagaccctttttttttgggtgacccccccgggggggggaaaatttttttttttaattttgggcgggaggggggggttttttgccagccctttttcccccaaaaaaatttttttcccccatgaaaccggggaaaaaaaaatttttttttttttttttttccccccattttggggggtttttttttttaaatgggggggggtttttttttttttttgggggccctttaaaaaccctttggccccttcccccttttgggcccccccaggggttttttttttctctgggggttccccccggggggggaaaaaaaaagggtttttttattttttttaaacccctttttttt

SEQ ID NO: 45247 - DNA, 573 bp, Panicum virgatum
  misc_feature: Ceres CLONE 2024032
  misc_feature: Encodes the peptide sequence at SEQ ID NO. 45248
tgctctctcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggcggctacggtcgccgcgagggcggtggcggctacggcggcggcggcggcggcggcggcggctacggtggccgtggaggcgtcggcggcggcggctacggtggccgtggaggctactgtggcggcggctacgggggcaac

SEQ ID NO: 45248 - protein, 157 aa, Panicum virgatum
  misc_feature: Ceres CLONE 2024032
  misc_feature (10)..(81): Pfam Name: RRM_1 Pfam Description: RNA recognition motif. (a.k.a. RRM, RBD, or RNP domain)
  misc_feature (48)..(157): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MEASDVEYRCFVGGLAWATDDNSLHNAFSPYGEVLESKIILDRETQRSRGFGFVTFSSEQAMRDAIEGMNGKELDGRSITVNEAQSRGGPRSGGGGGYGRREGGGGYGGGGGGYGRREGGGGYGGGGGGGGGYGGRGGVGGGGYGGRGGYCGGGYGG

SEQ ID NO: 45249 - DNA, 594 bp, Panicum virgatum
  misc_feature: Ceres CLONE 2024049
  misc_feature: Encodes the peptide sequence at SEQ ID NO. 45250
atcatcgcttgtttcccttccatctcacaccaagttctcactctctaactcgctctctctgactctcgagcaggactcacgcccgaaatccgccaagagattgactcctccctctgagccgaaggtgtgcggccgctgctgctgacgtccgcggcgtgatcgggcaactactgtccaaccaaaacggcagcggcggcgaccggcctcccggagatcgcgcggctgcgggagctgctggacgagcggcaacccgccctggccttggggggcgggatcagcgacccgcctcgggaggaggaggaggaggagggtccaggcggcggggcgccgggcgacgaggaactggtggcgtctgctatcccgccgtttcgtgatgcgccggctgtggcggaccgagacggtggactctctgctgtccgaccaccagagctgccacagcgcggactcgctccccgacttgtcccgcgggtactgccccgtgtacgtggggccccagcaccggatgttcgtgatccagaccatctacctggagatccccatgttcctgctcctgctggacaaggccgacgaggacttcgggttcccgcacgaggg

SEQ ID NO: 45250 - protein, 73 aa, Panicum virgatum
  misc_feature: Ceres CLONE 2024049
  misc_feature (1)..(73): Pfam Name: Auxin_inducible Pfam Description: Auxin responsive protein
MRRLWRTETVDSLLSDHQSCHSADSLPDLSRGYCPVYVGPQHRMFVIQTIYLEIPMFLLLLDKADEDFGFPHE

SEQ ID NO: 45251 - DNA, 671 bp, Panicum virgatum
  misc_feature: Ceres CLONE 2024067
  misc_feature: Encodes the peptide sequence at SEQ ID NO. 45252
aggccctcgccttcctccatcttcctcctctcgctctcatccactctcctccccccgcgccactgcggtgcggagcttcggcggctcaggtcgaggaaaggaaaatgggacagggactgcaagccatcaggttggatggaagtgtgcttaaatatgctgttcaacaacacatcagcgctcccaaaccagcaatggttcctgctgccttttctcgcttcatgtcagcttcatctgctcgcctagaggacagcggattagaaactgccactggagctgatatcgtgaagtctaaagggaagagtgcggatggatcttggctctggtgcaccacaaaggacagtgtctatgatgctggcaaaacgatgacgcaacacaatgtgggggctgtggtggtggtcaaaccgggacaggaaaaatcaattgctggcattgtcacggagagagattatctccggaaaatcatagtgcaaggacgatcttccaagtcaactaaggatggagacatcatgactgaagagaacaaactgatcaccgcgaagcctggcaccaaggtcatgcaagcaatgcagatgatgacacagaaccgcatcagacacatcccggaggacgaaggcacggggatgctggggatggtctccatcggcgacatcgtccgtgcggtggtcatcgag

SEQ ID NO: 45252 - protein, 188 aa, Panicum virgatum
  misc_feature: Ceres CLONE 2024067
  misc_feature (65)..(187): Pfam Name: CBS Pfam Description: CBS domain pair
  misc_feature: SWISSPROT Homolog: EC 1.1.1.205 IMP dehydrogenase
MGQGLQAIRLDGSVLKYAVQQHISAPKPAMVPAAFSRFMSASSARLEDSGLETATGADIVKSKGKSADGSWLWCTTKDSVYDAGKTMTQHNVGAVVVVKPGQEKSIAGIVTERDYLRKIIVQGRSSKSTKDGDIMTEENKLITAKPGTKVMQAMQMMTQNRIRHIPEDEGTGMLGMVSIGDIVRAVVI

SEQ ID NO: 45253 - DNA, 559 bp, Panicum virgatum
  misc_feature: Ceres CLONE 2024069
  misc_feature: Encodes the peptide sequence at SEQ ID NO. 45254
ttcatctgtaacattggcttctaaatggcgcggcgagattgagcgcatggtccgttgtttatttgaccttgcgacggcctatgctccaagtacaattttcattgatgaaatcgactccttgtgtacatcccgtgtagcttctggtgaacatgaatcatcgagaagggtgaagtctgaacttcttgtgctaattgatggtgtaaacaatagctctaccactgaagatggtcaaccaaaaattgtgatggttctggctgctacctactttccatgggatattgatgaatcacttaagcgtaggctggagaatcgtatttatcttccacttccagactttgaaagtagaaaggcacttatcaacattaaccttagaacacttcagataactgcagatgttgacatagatgaacttgctcggaaaactgatggttacggtggatatgaccttacaaatgttggtcgcgacgcgtaaatgaacggcatgacgctaaagatagacggcgagacccgcgatgagatcaagaacatggcgaacgatgatatagctaaggacccactg

SEQ ID NO: 45254 - protein, 156 aa, Panicum virgatum
  misc_feature: Ceres CLONE 2024069
  misc_feature (1)..(156): Pfam Name: AAA Pfam Description: ATPase family associated with various cellular activities (AAA)
  misc_feature: SWISSPROT Homolog: EC 3.6.4.3 Microtubule-severing ATPase
SSVTLASKWRGEIERMVRCLFDLATAYAPSTIFIDEIDSLCTSRVASGEHESSRRVKSELLVLIDGVNNSSTTEDGQPKIVMVLAATYFPWDIDESLKRRLENRIYLPLPDFESRKALININLRTLQITADVDIDELARKTDGYGGYDLTNVGRDA

SEQ ID NO: 45255 - DNA, 696 bp, Panicum virgatum
  misc_feature: Ceres CLONE 2024097
  misc_feature: Encodes the peptide sequence at SEQ ID NO. 45256
atcgccgcagctggctccgctcgcggtcgcggcgtcctctcctctccctcccctcccctccccgtcaccccctcgtcccccgccaccggagccgggcctgcctcctctctctcgttcagggtccggggagaggagaagggagccggccgccatggggttctgggaggccttcctcaactggctccgcagcctcttcttcaagcaagagatggaactttccttgatagggctccaaaatgctgggaaaacatcacttgtgaatgtcattgctaccggtgggtttagtgaggatatgattcctactgtaggattcaatatgagaaaggtaaccaaaggaaatgtcacaataaaattgtgggatcttggaggccagccaagattccgaagcatgtgggagagatactgccgtgcagtttctgcaattgtgtatgttgttgacgcggcagatcgagaaaacatggccattgcaaaaggcgagctccatgacctcctgagcaaaccatctttgactgggatcccgctactagtcattggcaataaagttgacaagcctgaagctttccctaagcaaagcttcactgaagtcatgggcttaaagacaatcactgaccgagaagtggcatgcttcatgatatcatgcaagaactcgaccaacattgattctgtcatcgactggctggtgaagcactcgaaaaa

SEQ ID NO: 45256 - protein, 181 aa, Panicum virgatum
  misc_feature: Ceres CLONE 2024097
  misc_feature (7)..(180): Pfam Name: Arf Pfam Description: ADP-ribosylation factor family
  misc_feature: Functional homolog of the protein sequence given in SEQ ID NO 51703
  misc_feature: Useful for making plants with altered terpenoid content
MGFWEAFLNWLRSLFFKQEMELSLIGLQNAGKTSLVNVIATGGFSEDMIPTVGFNMRKVTKGNVTIKLWDLGGQPRFRSMWERYCRAVSAIVYVVDAADRENMAIAKGELHDLLSKPSLTGIPLLVIGNKVDKPEAFPKQSFTEVMGLKTITDREVACFMISCKNSTNIDSVIDWLVKHSK

SEQ ID NO: 45257 - DNA, 987 bp, Panicum virgatum
  misc_feature: Ceres CLONE 2024100
  misc_feature: Encodes the peptide sequence at SEQ ID NO. 45258
ctgacccaccacttgccggccaccatcaccaatccccccagccagcgcggatcgagcgagcccgccgtcgccgtcgccgagctccgtcatggccgccgcgctgagggctgcgccgccgtccccggccaccgccaggcccgcggaaggcttcgccaaggcggtggcggcgtcgcgggtcgcggcaggcggcggcgtcggggcggccgggaagaggaaggcgcgcggcgtggcggtccgggcgtcgctgttctcgcccaagcccgcggcggccaaggacgcgcggccgtccaaggtgcaggagctctacgtgtacgagatcaacgagcgggaccgcgagagccccgcgtacctgcgcctcagcgccaagcagacggagaacgcgctgggcgacctcgtgcccttcaccaacaaggtgtacaacgggagcctggacaagcggctgggcatcaccgccggcatctgcgtgctgatccagcacgtccccgagcgcaacggcgaccggtacgaggccatctacagcgtctacttcggcgactacggccacatcacggtgcagggcccgtacctgaccttcgaggtgaagctccaccagatcgtcttccccttcaagatcttttacaccttctacctccggggcatcccggacctgccgcgggagctgctctgcacgcccgtcccgccctcccccgccgtcgagcccacccccgccgccagggccgccgagccccacgcctgcgtcaacttcaccaactgatggccatggcggcttctggtttcatgtggaattaattgtgtacggctatggctagtttccttcgcttggacggacggacggacgattcgtcgtcgtagactcgtagtagtagagcaaaataagagaggagggagagagctgcgtgctccgcttcgcttggctgctggctcctctccctctcctgattgtgatcgattagcaagctaaagcagttgagatggcgaagaggagat

SEQ ID NO: 45258 - protein, 221 aa, Panicum virgatum
  misc_feature: Ceres CLONE 2024100
  misc_feature (62)..(221): Pfam Name: Allene_ox_cyc Pfam Description: Allene oxide cyclase
  misc_feature: SWISSPROT Homolog: EC 5.3.99.6 Allene-oxide cyclase
  misc_feature: Functional homolog of the protein sequence given in SEQ ID NO 51600
  misc_feature: Useful for making plants with modulated nitrogen use efficiency
MAAALRAAPPSPATARPAEGFAKAVAASRVAAGGGVGAAGKRKARGVAVRASLFSPKPAAAKDARPSKVQELYVYEINERDRESPAYLRLSAKQTENALGDLVPFTNKVYNGSLDKRLGITAGICVLIQHVPERNGDRYEAIYSVYFGDYGHITVQGPYLTFEVKLHQIVFPFKIFYTFYLRGIPDLPRELLCTPVPPSPAVEPTPAARAAEPHACVNFTN

SEQ ID NO: 45259 - DNA, 1176 bp, Panicum virgatum
  misc_feature: Ceres CLONE 2024106
  misc_feature: Encodes the peptide sequence at SEQ ID NO. 45260
acccacccatctcgccgcgccgccgcgtaaaccccgctccacccatctcgctgcccagcgccgccgtctccaggcgcaaccatggcggccgcgtcgaggggcctgctcgcgcgcctccgcggcctctctctctccgcgggcggtggcccgcgcctccccctcctgcccccttcccgtctcttctccgcggagcccatcgtctcccactccgacgacgacgacgctgggggcgggggcgggggcgggggcggtggccggatcattgatgctcaggccggtgtcatgggacccacctcgcggcgaaccggcgtgatcggcgtgaagtgcgggatgtcggcgatgtgggacaagtggggcgcaaaggtgcccatcaccgtcctctgggtcgacgacaacatcgtcacccaggtcaagactgccgagaaggagggattcttcgccctacagcttggggcaggacagaagaaggaaaaacacctaacaaagcccgaagttggccactttagagcacagggagtgcctctgaagagaaagttaagggaatttcctgttaccgaggatgcacttcttcctgttgggacaaccatcacagttcgtcattttgtgcctggacaatttgttgatgtcaccggaatcacgaagggcaaaggttttgcaggtggaatgaaaagacatggttttaaagggatgcctgcatcacatggtgcatctttgtcacatcgcagtggtggttctactggtcaaagagatgctcctggaagggttttcaaaaataggaagatgcctggacgcatgggtggtgtgcaacgcacagtaaaaaatgtatgggtttaccaaatagacccagccaggaacttactatatctgaagggccaggttcctggccctcaaggtagctttgttttcgttaaggattctatattcaagaaacctgacacggctttgctaccgttccctacatatttcacgcaagaaggtgagccagaagtcttggagcccctgattgctgatcttggcgacgttgacccgttcatagcagcggattaaaaacagtggacaaacttggaggactccttttgtgttctgtgagctcgtctattccacaagattgttaaattttgtatggatatgtgagcagtttctgaatgacaagcttcatccggttactggccagcc

SEQ ID NO: 45260 - protein, 321 aa, Panicum virgatum
  misc_feature: Ceres CLONE 2024106
  misc_feature (81)..(277): Pfam Name: Ribosomal_L3 Pfam Description: Ribosomal protein L3
MAAASRGLLARLRGLSLSAGGGPRLPLLPPSRLFSAEPIVSHSDDDDAGGGGGGGGGGRIIDAQAGVMGPTSRRTGVIGVKCGMSAMWDKWGAKVPITVLWVDDNIVTQVKTAEKEGFFALQLGAGQKKEKHLTKPEVGHFRAQGVPLKRKLREFPVTEDALLPVGTTITVRHFVPGQFVDVTGITKGKGFAGGMKRHGFKGMPASHGASLSHRSGGSTGQRDAPGRVFKNRKMPGRMGGVQRTVKNVWVYQIDPARNLLYLKGQVPGPQGSFVFVKDSIFKKPDTALLPFPTYFTQEGEPEVLEPLIADLGDVDPFIAAD

SEQ ID NO: 45261 - DNA, 684 bp, Panicum virgatum
  misc_feature: Ceres CLONE 2024128
  misc_feature: Encodes the peptide sequence at SEQ ID NO. 45262
gaagggtttgaagcagaagaaggctcacctcatggagattcaggtcaatggcggtaccattgctgacaaggtggactatggctacaagttcttcgagaaggaggttccggttgacgctgtgttccagaaggatgagatgattgacatcattggtgtgaccaagggtaagggttatgagggtgtggtcactcgttggggtgtcacccgccttccccgcaagacccacaggggtctccgcaaggttgcctgtattggtgcctggcatccggctagggtttcctacactgttgcccgtgctggtcagaatggttaccaccaccgtactgagatgaacaagaaggtttacaagattggcaaggctggacaggagagccatgatgcctccacagagtttgacaggactgagaaggacatcactcccatgggcggcttcccccactacggtatcgtgaagggcgactacctgatgatcaagggttgctgcgtcggccccaagaagagagtggtgaccctccgccagtccttgttgaagcagacgtcacggctggccctggaggagatcaagctcaagttcatcgacacatcttccaagtttgggcacggtcgcttccagaccaccgacgagaagcagaagttctacggcaaggtcaaggcctaagcttctgctgctggtggtgcttgttc

SEQ ID NO: 45262 - protein, 218 aa, Panicum virgatum
  misc_feature: Ceres CLONE 2024128
  misc_feature (1)..(172): Pfam Name: Ribosomal_L3 Pfam Description: Ribosomal protein L3
KGLKQKKAHLMEIQVNGGTIADKVDYGYKFFEKEVPVDAVFQKDEMIDIIGVTKGKGYEGVVTRWGVTRLPRKTHRGLRKVACIGAWHPARVSYTVARAGQNGYHHRTEMNKKVYKIGKAGQESHDASTEFDRTEKDITPMGGFPHYGIVKGDYLMIKGCCVGPKKRVVTLRQSLLKQTSRLALEEIKLKFIDTSSKFGHGRFQTTDEKQKFYGKVKA

SEQ ID NO: 45263 - DNA, 695 bp, Panicum virgatum
  misc_feature: Ceres CLONE 2024129
  misc_feature: Encodes the peptide sequence at SEQ ID NO. 45264
acacttccattccacacactcgagactcgagagctagccaggcagccagcttccagcagcgcacgagctgggctgaacctgagaggcaccgccgccgccaccaccaccaccagggataggatgatggcgcccaccgcctcatccttcctcgccgtcttcctgctcatggcggcggccgcgtcgacgccggcgcggtcgtgcgcaccgagcgacctgcgcgcgctgctgagcatgaagcaggcgctgggcaacccggcgacgctgtcgtcgtggagcccgtcgtcgcccaactgctgcgcgtgggaccacctccggtgcgacgacgccgggcgcgtgaacaacgtgttcatcgacggcgccgccgacgtgcacgggcagatcccgtcggcggtggcggggctgacggcgctcatgtcgctgtccctgttccgcctgccggggctcacgggcgccatcccgccctgcctcgcggggctctccaacctgcagttcctcaccatctcccacaccaacgtgtcgggccccatcccggaggccctggcgcggctccgcaccctggactcggtcgacctctccagcaacaagctgtgcggccgcatcccggcggcgttcgccgacctgcccaacctccggtcgctggacctccagcacaaccagctgacgggccccatcccggcggggctcgtgcagggggc

SEQ ID NO: 45264 - protein, 190 aa, Panicum virgatum
  misc_feature: Ceres CLONE 2024129
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTASSFLAVFLLMAAAASTPARSCAPSDLRALLSMKQALGNPATLSSWSPSSPNCCAWDHLRCDDAGRVNNVFIDGAADVHGQIPSAVAGLTALMSLSLFRLPGLTGAIPPCLAGLSNLQFLTISHTNVSGPIPEALARLRTLDSVDLSSNKLCGRIPAAFADLPNLRSLDLQHNQLTGPIPAGLVQG

SEQ ID NO: 45265 - DNA, 649 bp, Panicum virgatum
  misc_feature: Ceres CLONE 2024140
  misc_feature: Encodes the peptide sequence at SEQ ID NO. 45266
cagagacacacaccgctgttcgagcccggggagctcaagtcctggtcgttctaccgcgcgggtatcgccgagttcgtcgccaccttcctcttcctctacatcaccatcctcaccgtcatgggcgtctccaagtccaactccaagtgcgccaccgtcggcatccagggcatcgcctggtccttcggaggaatgatcttcgcgctcgtctactgcaccgccggcatctccggagggcacatcaacccggcagtgacgttcgggctgttcttggccaggaagctgtccctgactagggccgtcttctacataatcatgcaatgcctcggtgctatctgtggagctggagtggtgaagggcttccagcagggactttacatgggcaacggtggtggtgccaacgctgtcgcccccggctacaccaagggatcaggccttggtgctgagatcattggcaccttcgtcctggtctacaccgtcttctcagccacagatgccaagaggaacgccagggactcccatgttcctatccttgccccattgccaattgggttcgcggtgttcctggtccaccttgccaccatccccattactggcactggcatcaacccagctaggagccttggcgctgccatcatctacaacagggagc

SEQ ID NO: 45266 - protein, 216 aa, Panicum virgatum
  misc_feature: Ceres CLONE 2024140
  misc_feature (11)..(215): Pfam Name: MIP Pfam Description: Major intrinsic protein
  misc_feature: Functional homolog of the protein sequence given in SEQ ID NO 50195
  misc_feature: Useful for making plants with modulated water use efficiency
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
QRHTPLFEPGELKSWSFYRAGIAEFVATFLFLYITILTVMGVSKSNSKCATVGIQGIAWSFGGMIFALVYCTAGISGGHINPAVTFGLFLARKLSLTRAVFYIIMQCLGAICGAGVVKGFQQGLYMGNGGGANAVAPGYTKGSGLGAEIIGTFVLVYTVFSATDAKRNARDSHVPILAPLPIGFAVFLVHLATIPITGTGINPARSLGAAIIYNRE

SEQ ID NO: 45267 - DNA, 1015 bp, Panicum virgatum
  misc_feature: Ceres CLONE 2024141
  misc_feature: Encodes the peptide sequence at SEQ ID NO. 45268
aacgacggccgttcagcaaataccgccaacatgaagctgaacatttcgcatcctgcgaacggctcgcagaagctgatcgaggtggaggatgagcggaagctgaggcacttcttcgagaagcgcatgggcgctgaggtcccggccgacccccttggcgatgagtggaagggctacatcgtccgcatcacgggcggcaacgacaaacagggtttcccgatgaagcagggtgttattgcccccaaccgtgtccgccttctcctcgccgacggccactcctgctaccgcccccgccgtaccggtgagcgcaagcgcaagtccgtccgcggttgcatcgttggcgccgacctctccgtcctcgctctcgccattgtcaagcagggcgagcaggacatccccggcctgaccgacactgttcaccccaagcgcctcggccccaagcgcgccaccaagatccgtcggttcttcggcctcagcaaggatgacgatgtccgcaagtacgtcattcggcgtgaggtccagcccaagggcgagggcaagaaggcctacaccaaggctcctcgcatccagcgcctggtcaccccccagcgcctgcagcacaagcgccaccgcattgcgctcaagcgccgccagaccgagaaggtcaaggatgaggcgaacgagtatgcccaggtcctcgccaagcgtgtcgctgaggccaaggccaccaaggccgatctccgcaagcggagggccagctctatgcgcaagtaaaattggggcgtttgttaatgggtctcgggttgctttgggaaaacggtcacggcgtgcttgcttgacggctcatctagggcgtgtacatggtataaacacccacgaatctcgacaatgagttattgctttgagcgtacagggcgcttaagcgaggccgcgcaaagagctatgcaacacccactcccaaatactagcacctgctcccgtggcgattgtgtgattcatagatgctttgcgcaatgataccagtttgacttgttttgcc

SEQ ID NO: 45268 - protein, 239 aa, Panicum virgatum
  misc_feature: Ceres CLONE 2024141
  misc_feature (1)..(127): Pfam Name: Ribosomal_S6e Pfam Description: Ribosomal protein S6e
MKLNISHPANGSQKLIEVEDERKLRHFFEKRMGAEVPADPLGDEWKGYIVRITGGNDKQGFPMKQGVIAPNRVRLLLADGHSCYRPRRTGERKRKSVRGCIVGADLSVLALAIVKQGEQDIPGLTDTVHPKRLGPKRATKIRRFFGLSKDDDVRKYVIRREVQPKGEGKKAYTKAPRIQRLVTPQRLQHKRHRIALKRRQTEKVKDEANEYAQVLAKRVAEAKATKADLRKRRASSMRK

SEQ ID NO: 45269 - DNA, 687 bp, Panicum virgatum
  misc_feature: Ceres CLONE 2024154
  misc_feature: Encodes the peptide sequence at SEQ ID NO. 45270
tagtgtccgagtgggaccacgccaaggacgccctcgcgaaagcaggacttgtcggaattggagtgcacgcgaccgcgccgaccaccccttccccgttcccgcctcgcgcggtcgcgcctcgctgagagatctgcggcggccaccgatccgcccgccgttggcgccggaagctgcggggagaacgagcagagatggaggacacagcagcggcgccggcgccggcggagaaggcgtcgtcgtacaggtactgggtgcgggaggcgaccggcgacgccgcgccgctcccggtcccgcgcaagctcgacccggccgcggccgccgccaacggcaacgggaacgggaacccgccgccgctcggctccgtctggaaccaggctggaacctgggaggagaaaaacctcaactcatgggccaatagtaggattaaggatttgttgggttctctaggttcattggaattcccaacagggaaggcatccattgatgaagtgtccaaatgctcaggagatgcatttcaggttacggttcgcaacaaaaagagagtagggtataattatgagctgagcttgagatttagaggtgaatggttagttaaagaagaaaacaagaaagtaaaaggtcatttagacattcctgagttttcatttggtgagcttgaggacttggagttacaagtaaggttcagtg

SEQ ID NO: 45270 - protein, 165 aa, Panicum virgatum
  misc_feature: Ceres CLONE 2024154
  misc_feature (67)..(165): Pfam Name: Aha1_N Pfam Description: Activator of Hsp90 ATPase, N-terminal
MEDTAAAPAPAEKASSYRYWVREATGDAAPLPVPRKLDPAAAAANGNGNGNPPPLGSVWNQAGTWEEKNLNSWANSRIKDLLGSLGSLEFPTGKASIDEVSKCSGDAFQVTVRNKKRVGYNYELSLRFRGEWLVKEENKKVKGHLDIPEFSFGELEDLELQVRFS

SEQ ID NO: 45271 - DNA, 696 bp, Panicum virgatum
  misc_feature: Ceres CLONE 2024159
  misc_feature: Encodes the peptide sequence at SEQ ID NO. 45272
atcccccctccctcgtcgtcttcctcgcccccgcccccgccccgcgcccccagctagacacaccgtaccgccaggtttttgctttatgctggttcatgtgtccacagacaatggactaattgctgacctgtctctgtgattcaccatgggaagcagtggagctgatacaccgtctaagacaagcaaggcgtctgcctcacaggaacaacagccacctgctacctcaggtgctgcaacaccggctgtttacccagattggtccagcttccaggcatatcctccaatcccaccacatgggttcttcccttcacctgtggcatcaagtccacagggtcatccttacatgtggggagctcaacctatgatcccaccatatggaacaccgccgccgccatatgtcatgtaccctcctggagtatatgctcacccgtctatgcccccgggtgcacatccattcactacttatgctatgacttctccaaatggctatgctgatgctactggaactactgcagcagctggtgatactgacaggaagccctctgaaggcaaagacaaaagtccaacaaaaagatccaaaggtagtttaggtagcttgaacatgcttactgggaagaatcctaccgaacatggtaagacctcaggagcatcagctaatggagccacttctcaaagtggggaaagcggtagtgaaag

SEQ ID NO: 45272 - protein, 183 aa, Panicum virgatum
  misc_feature: Ceres CLONE 2024159
  misc_feature (1)..(183): Pfam Name: MFMR Pfam Description: G-box binding protein MFMR
  misc_feature: Functional homolog of the protein sequence given in SEQ ID NO 51160
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MGSSGADTPSKTSKASASQEQQPPATSGAATPAVYPDWSSFQAYPPIPPHGFFPSPVASSPQGHPYMWGAQPMIPPYGTPPPPYVMYPPGVYAHPSMPPGAHPFTTYAMTSPNGYADATGTTAAAGDTDRKPSEGKDKSPTKRSKGSLGSLNMLTGKNPTEHGKTSGASANGATSQSGESGSE

SEQ ID NO: 45273 - DNA, 1154 bp, Panicum virgatum
  misc_feature: Ceres CLONE 2024162
  misc_feature: Encodes the peptide sequence at SEQ ID NO. 45274
aaccacctgccccccaaacccccaatcgcgcatcgcagagagcgccgcgtcctccagcgcccacgcctcgcctcgtcgtctagcctagttccaaaagcaacccgcagccgagccctctcgctctctgatcgaggaggaccgcaaggggcccccaccaccggcgagcaagatgatctccgccgacgcggcccgcaacgtcgtcggcatcatcggcaatgtcatctccttcggcctcttcctctccccagtgccgacgttctaccggatctgcaaggccaaggacgtggaggagttcaaggcggacccctacctggccacgctgctcaactgcatgctctgggtcttctacggcatccccatcgtccaccccaacagcatcctcgtcgtcaccatcaacggcatcgggctcgtcatagaggccgcgtacctcatcatcttcttcatctacagcgacaacaagaagcgcaagagggcgttcgccgtcctggccgtggagattgtgttcatggtcatcgtggtggtctcggtgctcctgaccgcgcacacccacgagaagcgctccatgatcgtcggcatcctctgcgtcatcttcggcgcgatgatgtacgcctccccgctcaccgtcatggggaacgttatcaagaccaagagcgttgagtacatgcccttcttcctgtcgctggtgagcttcctcaacggcgtctgctggacagcctacgccctcatccgcttcgacctctacgtcacgatccccaacgccctcggcgccttcttcggcgcggtccagctgatcctctacgcctgctactacaagtccacccccaagaaggagaagaatgtggagctgcccaccgtcgtctccggcaacgtccgcggcggcgccggcggcaacgtctccgtcaccgttgagcgatagatgagaggaagcggcaggtagccgccggcgaccgtcgaggaagaactcgacgagacgtggtttagttcctgtagtagtagttttgccttagtgttagagtcgtggtttgctctctcctcccggatgatggttcaatagtgagtgctagttttgcccggtgtcaggtgtcgtgccatgaacagttaatgtatcccttcgccgattgagataatgacaatcacgtctgattgctgccact

SEQ ID NO: 45274 - protein, 248 aa, Panicum virgatum
  misc_feature: Ceres CLONE 2024162
  misc_feature (132)..(218): Pfam Name: MtN3_slv Pfam Description: MtN3/saliva family
  misc_feature (9)..(98): Pfam Name: MtN3_slv Pfam Description: MtN3/saliva family
MISADAARNVVGIIGNVISFGLFLSPVPTFYRICKAKDVEEFKADPYLATLLNCMLWVFYGIPIVHPNSILVVTINGIGLVIEAAYLIIFFIYSDNKKRKRAFAVLAVEIVFMVIVVVSVLLTAHTHEKRSMIVGILCVIFGAMMYASPLTVMGNVIKTKSVEYMPFFLSLVSFLNGVCWTAYALIRFDLYVTIPNALGAFFGAVQLILYACYYKSTPKKEKNVELPTVVSGNVRGGAGGNVSVTVER

SEQ ID NO: 45275 - DNA, 689 bp, Panicum virgatum
  misc_feature: Ceres CLONE 2024179
  misc_feature: Encodes the peptide sequence at SEQ ID NO. 45276
acagcccaatcccccaccctccaggctccagccgaggcgaggcctccgtccagcgatcccatggcgtcggcgcccgccgcccccgccaactcctccgcctcgtaccggtgcgcggcgtgcggcgcggacctgaacctgtcggcggcgcacctgtacccggcgggcgtcttcttcgaggccgggaacaagggcacgctgtccttcgcgtgggtggacgagtcgcgcctccggttcgcggccgaggaccggatccgccccttcttcgagacccgcaactactggggcatccaccgcaagcgcacgcgcatcagctgcgacgcctgcggccgcctcctcggccacgtctacgacgacggcccgccgatcatgcagggccacggccagttcgggatggggcccagccaggtcatcccgcgccgccccaggtaccggatcaagaccaaggccgtcgccgccgctgccgccgccgccgccgcgtatggcaagtgaagcgagcctgctgccgcgtatggcttcgattctggtcgccgtgccgtatcgtggtgcgattttattcttcctgtaaattagtactagtagcatcctgtagattgatggtggtttcacctttggtttggttgcaataaatttcgccactgtattcctttgaggtacacatgcaaatggattctcaaatttgatgcgcttcg

SEQ ID NO: 45276 - protein, 142 aa, Panicum virgatum
  misc_feature: Ceres CLONE 2024179
  misc_feature: SWISSPROT Homolog: EC 1.8.4.12 Peptide-methionine (R)-S-oxide reductase
MASAPAAPANSSASYRCAACGADLNLSAAHLYPAGVFFEAGNKGTLSFAWVDESRLRFAAEDRIRPFFETRNYWGIHRKRTRISCDACGRLLGHVYDDGPPIMQGHGQFGMGPSQVIPRRPRYRIKTKAVAAAAAAAAAYGK

SEQ ID NO: 45277 - DNA, 674 bp, Panicum virgatum
  misc_feature: Ceres CLONE 2024213
  misc_feature: Encodes the peptide sequence at SEQ ID NO. 45278
acgccgacgccgatcgagctacctcccacctacatcttgcggagttgcagtcctatctcttccgatccgtcccgcccgccgcctcagcttgggttagttcttctccgcccggagatccgtgagccatggctgctgagttgaccatgcagactgttgtcctcaaggtggctatgtcatgccagggttgcgtcggggcggtcaggagagtgctctcaaagatggaaggagttgagacctttgacatagacctcaaggagcagaaggtgacagtcaaaggcaatgtcaagcctgaggatgtcttccggaccgtttccaagtcggggaagaagacctcctactgggagggcgaagccacagcccaggctgcttcggctccagcaacagaagctgctgcaccagagatcaccccagtcaaatctgacgcttgatcgtcacataagatgctgtgaccccaaaaccttactctagaactagctgggaaaccgagtcttgtgtgatttgcatcatgttgttgccactctagcaagtgattgcaaattatagaataaatgataaaacccagtatgtccgtctgtgtgatttcaggatgaacacatcccttcactacattttactttattttaccattgctttcgagttccccctaaacacttgtctagaccctattgtcttac

SEQ ID NO: 45278 - protein, 100 aa, Panicum virgatum
  misc_feature: Ceres CLONE 2024213
  misc_feature (10)..(71): Pfam Name: HMA Pfam Description: Heavy-metal-associated domain
  misc_feature: SWISSPROT Homolog: EC 3.6.3.4 Copper-exporting ATPase
MAAELTMQTVVLKVAMSCQGCVGAVRRVLSKMEGVETFDIDLKEQKVTVKGNVKPEDVFRTVSKSGKKTSYWEGEATAQAASAPATEAAAPEITPVKSDA

SEQ ID NO: 45279 - DNA, 689 bp, Panicum virgatum
  misc_feature: Ceres CLONE 2024214
  misc_feature: Encodes the peptide sequence at SEQ ID NO. 45280
tgctggtgtactggttatggagagcctggagcatgcaatgaagcgtgatgcaccaataatagcagaatatttgggaggggcagtgaactgtgacgcttaccatatgactgatcctagatcagatggactgggtgtatcgtcctgtatcaaaaagagccttgaagatgcaggtgttgcacctgaggaggtgaactacattaatgcgcatgcaacttccacgcttgctggtgacttggctgaagtaagagccataaagcaagtcttcaacaatacatctgagataaaaattaattcaacgaagtcaatgataggccattgcctaggtgcagctggtggattagaagctattgccacggtagaagctataactactggatgggtgcatcctacaattaatcaattcaacccagagcctgaagttgagtttgatacagtagccaatgaaaagaagcagcatgaagtgaatgttgccatctctaattcctttggattcggaggacacaactctgtggtagtatttgctccattcaagctgtgatccatccttgctccatatttatacaacctgcagcacagtctcaagattggtaatttagagaggaatttgttagatgtagcatacgatttttcctcttctttttcgtcggcttcaaagcaacaagttttgattcatcgagtgatgctgtcat

SEQ ID NO: 45280 - protein, 178 aa, Panicum virgatum
  misc_feature: Ceres CLONE 2024214
  misc_feature (20)..(134): Pfam Name: Ketoacyl-synt_C Pfam Description: Beta-ketoacyl synthase, C-terminal domain
  misc_feature: SWISSPROT Homolog: EC 2.3.1.41 Beta-ketoacyl-acyl-carrier-protein synthase I
AGVLVMESLEHAMKRDAPIIAEYLGGAVNCDAYHMTDPRSDGLGVSSCIKKSLEDAGVAPEEVNYINAHATSTLAGDLAEVRAIKQVFNNTSEIKINSTKSMIGHCLGAAGGLEAIATVEAITTGWVHPTINQFNPEPEVEFDTVANEKKQHEVNVAISNSFGFGGHNSVVVFAPFKL

SEQ ID NO: 45281 - DNA, 660 bp, Panicum virgatum
  misc_feature: Ceres CLONE 2024216
  misc_feature: Encodes the peptide sequence at SEQ ID NO. 45282
cagaccaccgagctgaaactagagaggcagccaggcagagatagcgtgttcatcaggcggcagcaaggcaagaacctccaagaagggaaccaggaaaccaaggaggaagagggagagatcagagatggcggcaagggctgtgtccacctccacccttgcggcagcagccacgatggtgctggccgcggcggtcctcctggccggcggcgcgtcggcgcagtcgccgccgtcgtctccggcgagccagtgcacatcggtgctggtgagcctgtcgccgtgcctgaactacatctccgggaacgagtcgacggcgccggcgtcgtgctgcgcgcagctgggcaaggtggtgcggtcggacccgcagtgcctgtgcgtggcgctgagcgcggacccggcgtcgctggggctcagcgtcaaccgcacccgcgcgctgggcctccccaccgcgtgcgacgtcgcgacgcccgacgtcagcagctgcaagggcgccgccgccgggcagccggcaaccgcgcccggggccggcacgccagctgggcaggcgccgggcggcacggggtccaagacgacgccggcgacggggtccgtgcccggcgccgccgccgcgtcgccgcggaggtcgtccggcgccggcctggtcgcgggcttcgtcgccgcggc

SEQ ID NO: 45282 - protein, 178 aa, Panicum virgatum
  misc_feature: Ceres CLONE 2024216
  misc_feature (42)..(119): Pfam Name: Tryp_alpha_amyl Pfam Description: Protease inhibitor/seed storage/LTP family
MAARAVSTSTLAAAATMVLAAAVLLAGGASAQSPPSSPASQCTSVLVSLSPCLNYISGNESTAPASCCAQLGKVVRSDPQCLCVALSADPASLGLSVNRTRALGLPTACDVATPDVSSCKGAAAGQPATAPGAGTPAGQAPGGTGSKTTPATGSVPGAAAASPRRSSGAGLVAGFVAA

SEQ ID NO: 45283 - DNA, 634 bp, Panicum virgatum
  misc_feature: Ceres CLONE 2024218
  misc_feature: Encodes the peptide sequence at SEQ ID NO. 45284
aaatcaaaaattaaatcatttggttcgtgagatggcccaaaagagtaaattccttcaatggattgactacagagtcagagtaacaatccaagataacagaatgttccttggtactttcctcgcctacgacaaacatctcaacgttgtcctcagcgaatgcgaagaattcagaagaattaagccaaagaagcagggtgaacctgaaaaagaaattaaaagagcactcggtatggttatcataagaggagagaatattttttctgttacagctgaagctccaccaaatatacaagctaaaagacttgatcaaggcgtcggtcccggaaaagctcagcctatcgatcgtccaggagtccagatcaaccccagtcaagctccagttggtcttggtggtatgtctaaaggagttggacaaatcaatccctctgctatgttacccggtcaacgtccaggcggccaacctgctcctggaggtattcccatgcaaatgccaggaggacctggtatgatgggaggacccggcagaccacctggtggattgccaccaatgatgggaatgccaggcggccttccaggtggtcttccaggagttcccatgcaacagccaggaactcagcctcctactcagccccca

SEQ ID NO: 45284 - protein, 200 aa, Panicum virgatum
  misc_feature: Ceres CLONE 2024218
  misc_feature (5)..(80): Pfam Name: LSM Pfam Description: LSM domain
MAQKSKFLQWIDYRVRVTIQDNRMFLGTFLAYDKHLNVVLSECEEFRRIKPKKQGEPEKEIKRALGMVIIRGENIFSVTAEAPPNIQAKRLDQGVGPGKAQPIDRPGVQINPSQAPVGLGGMSKGVGQINPSAMLPGQRPGGQPAPGGIPMQMPGGPGMMGGPGRPPGGLPPMMGMPGGLPGGLPGVPMQQPGTQPPTQP

SEQ ID NO: 45285 - DNA, 537 bp, Panicum virgatum
  misc_feature: Ceres CLONE 2024222
  misc_feature: Encodes the peptide sequence at SEQ ID NO. 45286
gggacatagatccatgggaagagttgacatatgattataggtttttttcgagtgatcagcgacttccctgttattgtggattccccaaatgccgtggagttgttaatgatgttgaggcagaagaacaggcagctaaattaaagctaaagagaagtgaattgtttcaaaaaggagatacctaaaggtagagagtatttattggttgggagatgacgcaggcttgggtgatatactttgcctgtgcctactgtcaaattatgaaaatttgctgagttcattctagaaactctgataattgttgtcattcttttagaatggaatgccaatgtaattgtataggtaaccaatgtaggataggtagtcaatccaatttgggaacggcagttgaatcggttgtgtagagtaccattgaaatattgggtgtttacatgtaatttggccactaatcgtgccacctataaacctctgggattgcgattggggtggtccgattaaatagtctgagatggcatgccaagtgtaaccaaaatatccctt

SEQ ID NO: 45286 - protein, 59 aa, Panicum virgatum
  misc_feature: Ceres CLONE 2024222
  misc_feature: SWISSPROT Homolog: EC 2.1.1.43 Histone-lysine N-methyltransferase
DIDPWEELTYDYRFFSSDQRLPCYCGFPKCRGVVNDVEAEEQAAKLKLKRSELFQKGDT

SEQ ID NO: 45287 - DNA, 703 bp, Panicum virgatum
  misc_feature: Ceres CLONE 2024224
  misc_feature: Encodes the peptide sequence at SEQ ID NO. 45288
caatctgccgcctcacttgtaagtagcgaccctcctcgtctttccccaaacccttgccctactcctcgcgccgtcaccaccgcatcccagcgccccgccgccgccggagaggagcagggagccgccgccagcagctatgggtcgcgtccgcaccaagaccgtgaagaagacctccaggcaggtgattgagaagtactactcccgcatgaccctcgacttccacaccaacaagaaggtcctggaggaggtctcgatcctgccctcgaagcgcctccgcaacaaggtggccggcttcaccacccacctgatgcgccgcatccagcgcggcccggtccgcggcatctccctcaagctgcaggaggaggagcgcgagcgccgcatggacttcgtcccggagaagtcggcgctcgaggtcgacgagatccgcgtcgacaaggagaccatggagatgctcgcgtccctcggcatgggcgacctccccggcgtcgagcgccaggctgaggtctccagcgcccccgcctacggccgcccgcagtacggtggtccacgccgcgaccgtgcctaggcgtgtttgatcttcagcaattttatagattataatgagagttgctactttttatgctatttggttgcttgccagcttgaatgttttattatatgggagttgtactgtgccgatataagtttaagtgcctgtgacatg

SEQ ID NO: 45288 - protein, 142 aa, Panicum virgatum
  misc_feature: Ceres CLONE 2024224
  misc_feature (1)..(122): Pfam Name: Ribosomal_S17e Pfam Description: Ribosomal S17
MGRVRTKTVKKTSRQVIEKYYSRMTLDFHTNKKVLEEVSILPSKRLRNKVAGFTTHLMRRIQRGPVRGISLKLQEEERERRMDFVPEKSALEVDEIRVDKETMEMLASLGMGDLPGVERQAEVSSAPAYGRPQYGGPRRDRA

SEQ ID NO: 45289 - DNA, 497 bp, Panicum virgatum
  misc_feature: Ceres CLONE 2024259
  misc_feature: Encodes the peptide sequence at SEQ ID NO. 45290
gacatcctgccacggcgttaattgggaccgtcattccttaactgacttacgggctgttgttgcatgcattggcggccatagcttggcgttgctcctccgccatctagctgttgattacggaagctggtctagtggaatgcctgatctactgctatggcgtttcattgatgaaagagggggaggtgaggttaaacttgtggaggtcaaaggaccaagggaccagctgtcagagcaacagcgtgcatggattcttcttctcatggattttggatttgatgtggaagtttgcaaagtaagcccagttgttaagcggagatagctcccctttcaaagttgcacttagtgtaacaatttcaatttattgatcatttatgcatcagataagcctttgattaattagaagagcaaaactgtaacatgttaacagtgacattgtttttttaaatgtcaacagtgacattgttgtgatgtggtacagaagtaaaaacattctcgtc

SEQ ID NO: 45290 - protein, 105 aa, Panicum virgatum
  misc_feature: Ceres CLONE 2024259
  misc_feature (1)..(100): Pfam Name: VRR_NUC Pfam Description: VRR-NUC domain
TSCHGVNWDRHSLTDLRAVVACIGGHSLALLLRHLAVDYGSWSSGMPDLLLWRFIDERGGGEVKLVEVKGPRDQLSEQQRAWILLLMDFGFDVEVCKVSPVVKRR

SEQ ID NO: 45291 - DNA, 575 bp, Panicum virgatum
  misc_feature: Ceres CLONE 2024265
  misc_feature: Encodes the peptide sequence at SEQ ID NO. 45292
aacgaacgctaaaaaagtaacagtttctgtactttattggaggttccaagatggtccactcgtacggctacaagagcggcacgcgccacctgttccagaagaagttccgcaagcatggcatgcccagcgtgtcgacgatgctcacgaccttcaaggtcggtgactacgtcgacgtcgtcgcggatccgtctgtgcgcaagggtatgccgcacaagttctaccacggcaagacgggtatcgtctggaacgtgaccccccgcggtctcggcgtgatcgtcaacaaggtggtcggcacccgcacgctccgcaagcgcatctgcgtgcgcttcgagcacgtgaagaagtcgcgctgccgtgaggcgttcctcgccaagcagaaggcgtactcgagcttcatcgcgaacaagaaggccggcaagaccgaggccgtcaagaaggcgtcgccccgcgctggtggcatcgttcgcgccaagaacgtcgagaccctgaagaagcgcccggaggacttcgacgcgtacctgccgtactagaaacggcatgtaggaggaaccttctactcacatcatctcccttgc

SEQ ID NO: 45292 - protein, 159 aa, Panicum virgatum
  misc_feature: Ceres CLONE 2024265
  misc_feature (2)..(100): Pfam Name: Ribosomal_L21e Pfam Description: Ribosomal protein L21e
MVHSYGYKSGTRHLFQKKFRKHGMPSVSTMLTTFKVGDYVDVVADPSVRKGMPHKFYHGKTGIVWNVTPRGLGVIVNKVVGTRTLRKRICVRFEHVKKSRCREAFLAKQKAYSSFIANKKAGKTEAVKKASPRAGGIVRAKNVETLKKRPEDFDAYLPY

SEQ ID NO: 45293 - DNA, 704 bp, Panicum virgatum
  misc_feature: Ceres CLONE 2024266
  misc_feature: Encodes the peptide sequence at SEQ ID NO. 45294
aagtatatctcgccgcggcccaaagccctagccgccgtccgccgccttcttcgtcgccgtcttctcgagccctcggcgcgctgccttggaggaacgaggagcgccaccgcacagggcacatcccctacccgtaggaggtggctccaacttggtggcgtgggctcttgccgattagcatcgaacagcaatggcgaagcatcatcctgatctcatcatgtgccggaagcagcctggcattgcgatcggtcgcctgtgtgagaaatgcgatggcaagtgcgtcatctgcgactcatacgtgcgcccatgcacgcttgttcgggtctgcgatgagtgcaactacggctcattccagggaaggtgtgtgatctgcggaggagtcggcatctcagacgcctactactgcaaggagtgtacccagcaggagaaggaccgggatggttgtcccaagattgtcaatcttggaagcgccaagactgatctcttctacgagcggaagaagtacgggtttaagaagagatgattgagaggagggagttgctgggttctattgtgttctgccgcactgatactgaaagtaggctgctgaggcagcagcgttgtattcatgttatgatttgatattgatgtgagaatacacccctgatatgctttgtaataactggttcaactgtatggtctaagaccccaaagactacttaatgcat

SEQ ID NO: 45294 - protein, 110 aa, Panicum virgatum
  misc_feature: Ceres CLONE 2024266
  misc_feature (1)..(106): Pfam Name: PHF5 Pfam Description: PHF5-like protein
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 45295 - DNA, 589 bp, Panicum virgatum
  misc_feature: Ceres CLONE 2024275
  misc_feature: Encodes the peptide sequence at SEQ ID NO. 45296
agcgcctcatctttgccggcaagcagctcgaggatggccgcactctttctgactacaacattcagaaggagtcaaccctccatttggtccttcgtctgcgtggtggaatgcagatcttcgtcaagactctcaccggcaagaccatcacccttgaggtcgaggcctcggacacgatccaagctgtcaagcagaagatccaagacaaggaaggtatccctcctgatcagcagcgcctcatcttcgctggcaagcagctcgaggatggccgcactctttctgactacaacattcagaaggagtcgactctccatttggtccttcgtctgcgtggtggaatgcagatcttcgtcaagactctcaccggcaagaccatcaccctcgaggtcgaggcctcggacacgatccaagctgtcaagcagaagatccaagacaaggaaggtatccctcctgatcagcagcgcctcatctttgccggcaagcagctcgaggatggccgtactctttctgactacaacattcagaaggagtcgactctccatttggtccttcgtctccgctaagagagtaaatcgttctttgttgctctttt

SEQ ID NO: 45296 - protein, 185 aa, Panicum virgatum
  misc_feature: Ceres CLONE 2024275
  misc_feature (41)..(109): Pfam Name: ubiquitin Pfam Description: Ubiquitin family
  misc_feature (117)..(185): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
RLIFAGKQLEDGRTLSDYNIQKESTLHLVLRLRGGMQIFVKTLTGKTITLEVEASDTIQAVKQKIQDKEGIPPDQQRLIFAGKQLEDGRTLSDYNIQKESTLHLVLRLRGGMQIFVKTLTGKTITLEVEASDTIQAVKQKIQDKEGIPPDQQRLIFAGKQLEDGRTLSDYNIQKESTLHLVLRLR

SEQ ID NO: 45297 - DNA, 475 bp, Panicum virgatum
  misc_feature: Ceres CLONE 2024291
  misc_feature: Encodes the peptide sequence at SEQ ID NO. 45298
attgttcccctcgccccagcagcagagactcgccttccgcacgcgcccaaagaaccctccctctctccgtgctcctctgcaacacaccaacacaccatgtctgactgggagaccggcctctgcgaatgcttctctgacttcccgacttgtctgtcggcgtacttctgcggctgcttcgatgtggcctaccactacgccgccgctgaggaccgcgagtgcagcgtagtcgacggcatcgtcgcctacttctgcttccccttctgtgcctgcattgcccgcaacaaggtcagggagaagtacaacatctcgggcagcttcctgggcgacatcttggccgtgtggtgctgtggttgctgcgctgtctcgcagcagtcgagggagctcaagcacaagggcgtcagcaagtactcctgcttctaagacccctcaagagggttgcagaagaagaaagtatcaatagaggaagagagcacac

SEQ ID NO: 45298 - protein, 107 aa, Panicum virgatum
  misc_feature: Ceres CLONE 2024291
  misc_feature (4)..(96): Pfam Name: PLAC8 Pfam Description: PLAC8 family
MSDWETGLCECFSDFPTCLSAYFCGCFDVAYHYAAAEDRECSVVDGIVAYFCFPFCACIARNKVREKYNISGSFLGDILAVWCCGCCAVSQQSRELKHKGVSKYSCF

SEQ ID NO: 45299 - DNA, 613 bp, Panicum virgatum
  misc_feature: Ceres CLONE 2024322
  misc_feature: Encodes the peptide sequence at SEQ ID NO. 45300
ggttctggttctacttcctccttgcatagaagaacctctgctagtgctctgttgcaagctgcaacttttggtgcttctctattatctggttctaaattgtcagcctacctggacagtgatactgttaatcagtatgatgatgatttcaatatcttgaactggtggcatgagcataagctatcatatcctgttctttcaattctagctatagatgtaatgattgctcctgtttcaacaatatcatcagaatctgcatttagtatgactggcaggattatccaggagcgacgacgacgtctgggccctgaggtcgtggagatgttggctctgatcaaggactgggagcaagccgatgcaagacttcagcatctcatagaggatgaagaacttgaaaaatcatttgaaaacttatatctagatgttgaatctgtataactatgtagtgtggactgtggacttgaacttgaacttgtgatgaacatttgaacatttagagctggctgtactcttttcatttgtagggttttgtcctcacgaggtgtggggttttacctacaaatgtttttaacgaggcaacactcaaaacagctcaatttaataaatttgttatcat

SEQ ID NO: 45300 - protein, 144 aa, Panicum virgatum
  misc_feature: Ceres CLONE 2024322
  misc_feature (32)..(115): Pfam Name: hATC Pfam Description: hAT family dimerisation domain
GSGSTSSLHRRTSASALLQAATFGASLLSGSKLSAYLDSDTVNQYDDDFNILNWWHEHKLSYPVLSILAIDVMIAPVSTISSESAFSMTGRIIQERRRRLGPEVVEMLALIKDWEQADARLQHLIEDEELEKSFENLYLDVESV

SEQ ID NO: 45301 - DNA, 610 bp, Panicum virgatum
  misc_feature: Ceres CLONE 2024328
  misc_feature: Encodes the peptide sequence at SEQ ID NO. 45302
gggaagcggctccagacgggccactggaacgtggtggacgtctgcaacgggctcctcggcgggttcgcggccatcacggccggctgcagcgtcgtcgacccgtgggccgccgtgatctgcgggttcgtgtccgcgtgggtgctcatcggggcgaacgcgctcgccgcgcgcctcaagttcgacgacccgctggaggccacgcagctccacggcgggtgcggcgcgtggggcatcctcttcaccgcgctcttcgccaggcagaagtacgtggaggagatctacggcccggggaggccgtacgggctgttcatgggcggcggcgggcgcctcctcgccgcgcacatcatccagatcctggtcatcgccgggtgggtgagctgcaccatgggcccgctcttctacgcgctcaagaagctggacctgctgcgcatctcggccgacgacgagatggccggcatggacctgacccgtcacggcggcttcgcctacgtctaccacgacgaggaacccggcgacaaggccggggttggtgggttcatgctcaggtccgcgcagaaccgtatcgagccggcggcggcggcggcggcggcgacgaccggcaaccaggtgt

SEQ ID NO: 45302 - protein, 203 aa, Panicum virgatum
  misc_feature: Ceres CLONE 2024328
  misc_feature (1)..(163): Pfam Name: Ammonium_transp Pfam Description: Ammonium Transporter Family
  misc_feature: Functional homolog of the protein sequence given in SEQ ID NO 51423
  misc_feature: Useful for making plants with modulated carbon-nitrogen partitioning
  misc_feature: Functional homolog of the protein sequence given in SEQ ID NO 51424
  misc_feature: Useful for making plants with altered carbon content
  misc_feature: Useful for making plants with altered nitrogen content
GKRLQTGHWNVVDVCNGLLGGFAAITAGCSVVDPWAAVICGFVSAWVLIGANALAARLKFDDPLEATQLHGGCGAWGILFTALFARQKYVEEIYGPGRPYGLFMGGGGRLLAAHIIQILVIAGWVSCTMGPLFYALKKLDLLRISADDEMAGMDLTRHGGFAYVYHDEEPGDKAGVGGFMLRSAQNRIEPAAAAAAATTGNQV

SEQ ID NO: 45303 - DNA, 649 bp, Panicum virgatum
  misc_feature: Ceres CLONE 2024329
  misc_feature: Encodes the peptide sequence at SEQ ID NO. 45304
acaatcacaactcgcatctggagccatcagagttcatcagcactctctagtcacacagcacatcttcttctcctgctacagagctcagctcaggcaaaagcttcgccgccacaacatcccaatggctcgcttcgccgtggtcgccgccatcgtcgccctcctcgccgtcaccgcggccgcgcaggccccggccgcgacgcccaccccggcgcccaggatggccccgctgccgcgtcccccggcgcgctccccggccaccgccccggcaccggccgcgaagccgcccaccgcctcggcgccgtccccgctggcctctcccccggccccgcccgccaccgagggccccgccgcggccgcgccctccgcgctgacaccgaccagctccgtctccgcccccgccggcgcccccaccgccacgcccaccgggaatggcgccgcctcctccgccgtcagcttcgtcgccgtcgccgccgcgtttgccgccgccgccgtcgtgttctagatgggggacgcgtgatgggatctcgagctgtttatactgccatattcttttttgccattcttttttattagataccgagtgctgtacacatcatgcatggttcatgatgatatgattattaatggaattctttcatttgttactacc

SEQ ID NO: 45304 - protein, 126 aa, Panicum virgatum
  misc_feature: Ceres CLONE 2024329
  misc_feature: Functional homolog of the protein sequence given in SEQ ID NO 50188
  misc_feature: Useful for making plants with altered carbohydrate content
MARFAVVAAIVALLAVTAAAQAPAATPTPAPRMAPLPRPPARSPATAPAPAAKPPTASAPSPLASPPAPPATEGPAAAAPSALTPTSSVSAPAGAPTATPTGNGAASSAVSFVAVAAAFAAAAVVF

SEQ ID NO: 45305 - DNA, 659 bp, Panicum virgatum
  misc_feature: Ceres CLONE 2024336
  misc_feature: Encodes the peptide sequence at SEQ ID NO. 45306
ccatccgcctgctcctgccaaaccattctcccccaaatctccctcgcaatccccatccccgtagccctcccagcgagcatcgaccatgtcggcctactgcggaaagtacaaggatgagctcatcaagaacgctgcctacattggcacccctgggaagggtatccttgcagctgatgagtccactggcaccattggcaagcgtctttccagcatcaatgtcgagaacgttgaggagaaccgccgtgccctccgtgagctcctgttctgctgccctggtgccctccagtacataagtggtgtgatcctcttcgaggagaccctgtaccagaagaccaaggatggcaagcccttcgtcgatgtcctcaaggagggaggcgctctccccggcatcaaggttgacaaggggaccatcgaggttgctggcactgataaggagaccaccacccagggccatgatgaccttggcaagcgctgcgccaagtactacgaggctggtgcccgctttgccaagtggcgtgctgtcctcaagattggccccaacgagccatcacaacttgccattgacctgaacgctcagggtcttgctcgctatgccatcatctgccaggagaatggtctggtgccgatcgtggagcatcgaccatgtcggcctactgcgg

SEQ ID NO: 45306 - protein, 191 aa, Panicum virgatum
  misc_feature: Ceres CLONE 2024336
  misc_feature (11)..(191): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Functional homolog of the protein sequence given in SEQ ID NO 50216
  misc_feature: Useful for making plants with modulated phosphate use efficiency
  misc_feature: Functional homolog of the protein sequence given in SEQ ID NO 50217
  misc_feature: Useful for making plants with modulated biomass
MSAYCGKYKDELIKNAAYIGTPGKGILAADESTGTIGKRLSSINVENVEENRRALRELLFCCPGALQYISGVILFEETLYQKTKDGKPFVDVLKEGGALPGIKVDKGTIEVAGTDKETTTQGHDDLGKRCAKYYEAGARFAKWRAVLKIGPNEPSQLAIDLNAQGLARYAIICQENGLVPIVEHRPCRPTA

SEQ ID NO: 45307 - DNA, 812 bp, Panicum virgatum
  misc_feature: Ceres CLONE 2024348
  misc_feature: Encodes the peptide sequence at SEQ ID NO. 45308
agcgagccagcgagcggtctccggacgccattgctgacggttgcagaagctccccgtgcgacgagaaatttccatgcgtccaatttccccggaccgtggaggcgttgaatcgtgcgtgagccattacgtagcgtcgacaacccccactcagctgcccgccgtcccatcgccgtcgaagagatccccgcctctgactttcttgtttcactcagcatcgtcccgcacgggtggagaaactgaaacaccatcccaaccaatccggaacctgattcggtggtcacctccaatttcatcagtaccgaatcccagggccaataagaatcgctccttttaagttctctccgagcttaatctgatcgtgctgctcgggctccgaacttgagattgcgatttgaggagttgcgggagggagatggcgcagagcaaggaggagttcttggagcagttcggcggggactacggctacccggacgctcccaggggcatcgacgagctgcgcgccgccgatttcaagcggctggaagggatggtttacctggaccatgccggtgcaacactctactcagaggcacagatggcggatgttgccaaagaccttatgtcgaatgtctacggaaatccccatagccagagcgattcaagcatggctacaagcgaccttgtcacttctatgcgacatctggtcctaaaatacttcaatgcatctccaagggactataaatgtatatttacctccggggccacagcagctctgaaacttgtcggcgaatgttttccatggagtggagatagctgctacatgtacacaatgg

SEQ ID NO: 45308 - protein, 133 aa, Panicum virgatum
  misc_feature: Ceres CLONE 2024348
  misc_feature: SWISSPROT Homolog: EC 2.8.1.7 Cysteine desulfurase
  misc_feature: Functional homolog of the protein sequence given in SEQ ID NO 51704
  misc_feature: Useful for making plants with modulated drought sensitivity
MAQSKEEFLEQFGGDYGYPDAPRGIDELRAADFKRLEGMVYLDHAGATLYSEAQMADVAKDLMSNVYGNPHSQSDSSMATSDLVTSMRHLVLKYFNASPRDYKCIFTSGATAALKLVGECFPWSGDSCYMYTM

SEQ ID NO: 45309 - DNA, 521 bp, Panicum virgatum
  misc_feature: Ceres CLONE 2024365
  misc_feature: Encodes the peptide sequence at SEQ ID NO. 45310
aactaacgctaaaaaagtaacagtttctgtactttattgtgaaccgcgtctccacactcccagcagaatggccaaggctcagtccaagaagtcggcggcgacgtcgaaggcggcgtcgggcaagcgctcgacgcgcaagccgaagcgcacgtactcgacgtacatctcgaaggtgctgaagggcgcgtccaagtccaagctgacgctgagctccaagtccatgaagatcctgaattcgctggtggtcgatttctttgaccgcctggcgaccgaggcggcgtcgctggcgcgcagcacgaagaagcgcacgctcggatcgcgggaaatgcagacggcggttcgcctgacgctgccggcggagctggcgaagcacgccatggcggagggcactcgcgccgtggcgaaggcgtcggcctaatagatcgctcacgcgacaggccaatttctacctccaccacttgatttagcgacgcgcctgcgtactgcgggcgtcgatcgcgacctggaccaccaccaaacag

SEQ ID NO: 45310 - protein, 116 aa, Panicum virgatum
  misc_feature: Ceres CLONE 2024365
  misc_feature (23)..(94): Pfam Name: Histone Pfam Description: Core histone H2A/H2B/H3/H4
MAKAQSKKSAATSKAASGKRSTRKPKRTYSTYISKVLKGASKSKLTLSSKSMKILNSLVVDFFDRLATEAASLARSTKKRTLGSREMQTAVRLTLPAELAKHAMAEGTRAVAKASA

SEQ ID NO: 45311 - DNA, 649 bp, Panicum virgatum
  misc_feature: Ceres CLONE 2024366
  misc_feature: Encodes the peptide sequence at SEQ ID NO. 45312
gtctcctcctccctttcccctcccaaggccaggccagccttgccctctccgcgtccaggaattccgcaaggagttcaaggagaagaaccctaaaaacaagtctgttgctgcggtggggaaagctgccggcgacaggtggaaatccctgacagaagcggacaaggctccttatgtagccaaggccaataaactcaagcttgagtacaacaaggccattgcggcctacaacaagggcgagagcactgctgccaagaaggctcctgccaaggaggaagaggaggaggatgaagaggagtctgacaagtcaaagtctgaggtcaacgacgaggatgatgaagagggtagtgaggaggatgaagacgatgacgagtaagctcaggtcaagttgatgctccattcaacaatggagtgccagaatgcaaaggccctgtgtcgggaattaaaaggagcctatccagtctactagaattattcagtttcacttcacatcgtgatgttttacttttgtctgtcctataatggatatcgctccttgttggcgccaccggcgggctagtgtttgcacggtgggcacaccggcaatacccgcttgtacctagattaccgtttccattgtcatcagctaacattgtgataatatcagtttggg

SEQ ID NO: 45312 - protein, 123 aa, Panicum virgatum
  misc_feature: Ceres CLONE 2024366
  misc_feature (7)..(76): Pfam Name: HMG_box Pfam Description: HMG (high mobility group) box
  misc_feature: Functional homolog of the protein sequence given in SEQ ID NO 50396
  misc_feature: Useful for making plants with altered alkaloid content
  misc_feature: Functional homolog of the protein sequence given in SEQ ID NO 50397
  misc_feature: Useful for making plants with altered lignin content
  misc_feature: Useful for making plants with altered terpenoid content
SPPPFPLPRPGQPCPLRVQEFRKEFKEKNPKNKSVAAVGKAAGDRWKSLTEADKAPYVAKANKLKLEYNKAIAAYNKGESTAAKKAPAKEEEEEDEEESDKSKSEVNDEDDEEGSEEDEDDDE

SEQ ID NO: 45313 - DNA, 687 bp, Panicum virgatum
  misc_feature: Ceres CLONE 2024375
  misc_feature: Encodes the peptide sequence at SEQ ID NO. 45314
gatggcaaccaataagcacttgttcctctcatcaatctttctctcattcctttcagttccgctgtgctcccgtgcatccccatggcaggccaggggcacaggcacatccctgcgagtagatcacggggaaatcttcctcgtctctccagacacgaccttctcctgcggcttctactcgtctggagaaggcactaacgcctactacttctccatctggttcaccaacaccaccgacaggactgttgtatggacggcgaaccgtggctctccggtaaacggccatggatcaaagatctccttcaaccgtgaagggaacctgctccttaccgatgtcaacggctccacggtgtgggagagcaagacaaaatggggaaagcgcaccacagtggctctcctcaacagcggcaatcttgtcatcagggcctccactgatcaggtagtatggcagagcttcgattcgcccactgacaccttgcttccttcacagaatttgaccagagaaacgaagttagtctctccatctggttatcataacctctattttgacaatgacaacgtactgcggctcctgtacaatggaccagagatcacgagcatatactggccaagtccggactacaatgcactgcaaaatggcaggactagattcaacagcagcaagattgcagttctggacagcgaaggcgt

SEQ ID NO: 45314 - protein, 228 aa, Panicum virgatum
  misc_feature: Ceres CLONE 2024375
  misc_feature (78)..(187): Pfam Name: B_lectin Pfam Description: D-mannose binding lectin
MATNKHLFLSSIFLSFLSVPLCSRASPWQARGTGTSLRVDHGEIFLVSPDTTFSCGFYSSGEGTNAYYFSIWFTNTTDRTVVWTANRGSPVNGHGSKISFNREGNLLLTDVNGSTVWESKTKWGKRTTVALLNSGNLVIRASTDQVVWQSFDSPTDTLLPSQNLTRETKLVSPSGYHNLYFDNDNVLRLLYNGPEITSIYWPSPDYNALQNGRTRFNSSKIAVLDSEG

SEQ ID NO: 45315 - DNA, 712 bp, Panicum virgatum
  misc_feature: Ceres CLONE 2024416
  misc_feature: Encodes the peptide sequence at SEQ ID NO. 45316
gagtaagatggaagtttatgctcttacaaaagcaaagatgtgtttacccttcctagctccgttttacctttaggatttggattttctttaaggatggagtttgaatggtgttatgtatgatgggaaggaccctcttttgctgcttaagtgttactatgatattatgtgttaagctcatgctaccctttgaatagtagttccttctgagttaattagttttcccccttgggaactgaaataggaaaaaaaaaaaaaaaaaagccgccgccggaccactcgtcgccctcctctcctccgcgagcgctcgcttcggaagcaagggattcgagatggccaagtcgaagaaccacacggcgcacaaccagtcgtacaaggcgcacaagaacggcatcaagaagcccaagcgccaccgccagacctccactaaggggatggaccccaagttcctgaggaacctgaggtactcaaggaagaacaacaagaagagcggtgaggctgaagcggaggagtaagatggaagtttatgctcttacaaaagcaaagatgtgtttacccttcctagctccgttttacctttaggatttggattttctttaaggatggagtttgaatggtgttatgtatgaatgggaaggaccctcttttgctgcttaagtgttactatgatattatgtgttaagctcatgctaccctttgaatagtagttccttct

SEQ ID NO: 45316 - protein, 60 aa, Panicum virgatum; identical to SEQ ID NO: 13919
  misc_feature: Ceres CLONE 2024416
  misc_feature (3)..(42): Pfam Name: Ribosomal_L29e Pfam Description: Ribosomal L29e protein family

SEQ ID NO: 45317 - DNA, 678 bp, Panicum virgatum
  misc_feature: Ceres CLONE 2024450
  misc_feature: Encodes the peptide sequence at SEQ ID NO. 45318
gaaaaacattggaaaaataagaagatggcgcgtggcttcggtgtgctgggtttcggccttctcctcctcctcgctgccctcctctcgtgcgcgcaggccgaagtgctcgtgcgcaagaccatcaccaacagcgagatcctctcctcgcgagatgtggtcgtgaagatcggcatctacaacgtgggcacgagccccatcttcgacgtgaccctggtcgacgacgactgggagaagaacttcgacgtcaaggtcggcctccccaccgccacgtgggacaggatcgcgcccggccagaacgtgtcccatttcttcgtcatccagcccaaggccaatgcggccaacacggtcgtgaggaccctgcccggctacgtgcagtaccgcgagacccccaagggcgccttccaggtggccctcaccacgggcgtgggctccctccccatccagacctcgagcgagggcgagacgcggtcgggatcgaccatcgccaactggggcatcttcaccctcctcagcgtcgcctccatcatgctgcccttcggcttctggggctacatccagctccacttcgaggacggcctcaagaggaagaagctccacaagaagtccaagtaaatcccccaaaaatgaatcctcaccattccccttcttgttcagtccttcagtaaagagcttccacct

SEQ ID NO: 45318 - protein, 195 aa, Panicum virgatum
  misc_feature: Ceres CLONE 2024450
  misc_feature (12)..(186): Pfam Name: TRAP_beta Pfam Description: Translocon-associated protein beta (TRAPB)
MARGFGVLGFGLLLLLAALLSCAQAEVLVRKTITNSEILSSRDVVVKIGIYNVGTSPIFDVTLVDDDWEKNFDVKVGLPTATWDRIAPGQNVSHFFVIQPKANAANTVVRTLPGYVQYRETPKGAFQVALTTGVGSLPIQTSSEGETRSGSTIANWGIFTLLSVASIMLPFGFWGYIQLHFEDGLKRKKLHKKSK

SEQ ID NO: 45319 - DNA, 682 bp, Panicum virgatum
  misc_feature: Ceres CLONE 2024510
  misc_feature: Encodes the peptide sequence at SEQ ID NO. 45320
ttctacactgatcagtgtcaaccgacttgcttgttgccacgatggttgtcggcaaagtcacactggagtacccggtggccgtgtcggttgagctgctgtggaaggtggcgttctccggcgatgtgtccatcttaaccaaggcctgcgtcggcatgattgacgccgtggaggtcgacggtgacggcgggcccgggagcgtcaccaccataaagctcaaccctgccgtgggtgacgcaaaggtgttcaagacccggctcctatcgcgtgatgcggcggcacgtgtcgtgaagtcagagatggtggtggagggcagcgagctgtccgtgcagttcaagtcgcaggtgtccgaggtgaaggtggtgccggccggcgagggtgctagcgtggtgcacatgacggtggagtacgagcgggtggacggcgcgctgctgccgccgggggaggaggccaggattgggcagggctacctcggcctcatcaagaaggtggaggagtacctcgtcgcgcaccccaccgagttcgcctaaagctacctgccattatgcatcgtccgttgcggcgatcgggccagagaaatccgtgttaaataaattaaatgatggtgaccatggcatgggtgtgttcttgatttgaacatcggaataacgagaggaagtgatcctttgcttggtcggtcaattgt

SEQ ID NO: 45320 - protein, 161 aa, Panicum virgatum
  misc_feature: Ceres CLONE 2024510
  misc_feature (1)..(156): Pfam Name: Bet_v_I Pfam Description: Pathogenesis-related protein Bet v I family
MVVGKVTLEYPVAVSVELLWKVAFSGDVSILTKACVGMIDAVEVDGDGGPGSVTTIKLNPAVGDAKVFKTRLLSRDAAARVVKSEMVVEGSELSVQFKSQVSEVKVVPAGEGASVVHMTVEYERVDGALLPPGEEARIGQGYLGLIKKVEEYLVAHPTEFA

SEQ ID NO: 45321 - DNA, 689 bp, Panicum virgatum
  misc_feature: Ceres CLONE 2024511
  misc_feature: Encodes the peptide sequence at SEQ ID NO. 45322
agcaactgtgagaaccggtcagagggacttgagacaagagagagaaagcatgtgacccctctctgtctctcttacttccctcctcttctacaaggagccagtgagccacaaccacaccaaatagcagaagaacaagctcctcgccttgcctcttgttctctgctctgcctacctctgctcatttctttcttccaccttgggccttggctatggcatccagcgtgtcccggttcattaagtgtgtcacggtgggggacggcgccgtggggaagacctgcattctcatctgctacaccagcaacaagttccccactgattacatacccactgtcttcgataacttcagcgcaaacgttgtggtcgacggcaccacggtgaacttgggcctttgggacactgcaggacaggaagattacaacaggttgaggcccctgagctaccgcggagccgatgtgttcgtgctcgccttctcgctcgtcagccgagctagctacgagaatgttgttaagaagtggctacccgagcttcggcattatgcaccgggtgtccccatagttttggctggaactaaattggatcttcgtgaagacaagcactacttactcgaccatcctggtgcagtacctgttactacggcacagggggaggaacttcgcaagcacatcggagcaacatgttacctggagtgc

SEQ ID NO: 45322 - protein, 159 aa, Panicum virgatum
  misc_feature: Ceres CLONE 2024511
  misc_feature (10)..(159): Pfam Name: Ras Pfam Description: Ras family
  misc_feature (10)..(123): Pfam Name: Miro Pfam Description: Miro-like protein
  misc_feature: Functional homolog of the protein sequence given in SEQ ID NO 50617
  misc_feature: Useful for making plants with modulated nitrogen use efficiency
MASSVSRFIKCVTVGDGAVGKTCILICYTSNKFPTDYIPTVFDNFSANVVVDGTTVNLGLWDTAGQEDYNRLRPLSYRGADVFVLAFSLVSRASYENVVKKWLPELRHYAPGVPIVLAGTKLDLREDKHYLLDHPGAVPVTTAQGEELRKHIGATCYLE

SEQ ID NO: 45323 - DNA, 627 bp, Panicum virgatum
  misc_feature: Ceres CLONE 2024516
  misc_feature: Encodes the peptide sequence at SEQ ID NO. 45324
gatgagatcttcattgttgacaggctcaaggagataatcaaatacaagggcttccaagtacctcctgcagaacttgaggcccttctcatcacacatcctgaaattaaggatgctgctgttgtctcaatgaaagatgaacttgccggtgaagtccccgttgcattcattatacggactgaagattctcagatcagtgaggacgagatcaagcagtttgttgcaaaggaggttgtattctacaagaggatcaataaagttttcttcacggattccattccgaagaatccttctggcaaaatccttaggaaggacctgagagcacgacttgctgcaggaattcctagcggtgacagcacacagtccaaaaactaagcctgataccgcccccccccccccccaaaaaaaaagtttgtacacccttgtcaaatatcatgctgtaatattcatgatatggcaataatacatatagaaaggccaagcaattgctattgattcttttatatgggtaaaagtgtactttgtttatttgttcttatttatgtattgcatcatgtatagatacccttttgaccccaaaaaaaaagctgattattatatgtaccatgtttgaattccatcaacttcagt

SEQ ID NO: 45324 - protein, 123 aa, Panicum virgatum
  misc_feature: Ceres CLONE 2024516
  misc_feature: SWISSPROT Homolog: EC 6.2.1.12 4-coumarate--CoA ligase
  misc_feature: Functional homolog of the protein sequence given in SEQ ID NO 50495
  misc_feature: Useful for making plants with altered carbohydrate content
  misc_feature: Functional homolog of the protein sequence given in SEQ ID NO 50497
  misc_feature: Useful for making plants with altered cell wall content and/or composition
  misc_feature: Functional homolog of the protein sequence given in SEQ ID NO 50496
  misc_feature: Useful for making plants with altered lignin content
DEIFIVDRLKEIIKYKGFQVPPAELEALLITHPEIKDAAVVSMKDELAGEVPVAFIIRTEDSQISEDEIKQFVAKEVVFYKRINKVFFTDSIPKNPSGKILRKDLRARLAAGIPSGDSTQSKN

SEQ ID NO: 45325 - DNA, 585 bp, Panicum virgatum
  misc_feature: Ceres CLONE 2024517
  misc_feature: Encodes the peptide sequence at SEQ ID NO. 45326
aggcttcaggactcgacctctctcgccgccgccatgaccttcaagagccgcaacggcgcgccgcaacaagcacggccgatggccatgacaagtacatccgctgcaccaactgcgacgagagctgccccaaggacaaagcaaacaagaggtgtcaggtgaggaacatccagcaccaggcagacatcaaggacgttcaggaggcgtgcgtccatgaccgatacgtccttcccaaacaggacgccaaggtgcaccactgcgtctcgcgcgctatccacgctcacatcctccgcgtcacgttcccatgagaagcacagggaccgcaagccaccggaacgcttcaggagaagggaggataggcctgctggtgggcaaggagggccccgccctgccggacctggccctgctggtgctgctgcatctcctgcaccaaatgctcctcacccatatggttagcatatcaaccgcataacctctggcctgatgatagccatggatgtcttacttcattaccatggtgtcatcaatcagaggagtgtggagttgctatattaccagaacttttgtctgaagtctggaatgtttgct

SEQ ID NO: 45326 - protein, 100 aa, Panicum virgatum
  misc_feature: Ceres CLONE 2024517
  misc_feature (16)..(100): Pfam Name: Ribosomal_S26e Pfam Description: Ribosomal protein S26e
  misc_feature: Functional homolog of the protein sequence given in SEQ ID NO 50755
  misc_feature: Useful for making plants with modulated nitrogen use efficiency
ASGLDLSRRRHDLQEPQRRAATSTADGHDKYIRCTNCDESCPKDKANKRCQVRNIQHQADIKDVQEACVHDRYVLPKQDAKVHHCVSRAIHAHILRVTFP

SEQ ID NO: 45327 - DNA, 657 bp, Panicum virgatum
  misc_feature: Ceres CLONE 2024531
  misc_feature: Encodes the peptide sequence at SEQ ID NO. 45328
attcagctgagtgtgctcgatcatcaagcaatcaacaaagcctcccaattatcctttcatcagatcatcttccttcttccaagatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggtggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccgacctcatcaagcatgcatgcgtcgtctgcccctctgtgtgctttgcgtccgtcctgtgtctgtatgtgttgatcattgcaaagaaaccatgcaggcatacatctctgcatgtgtctctgtaatgatcggtccagagtgatgaatatatggtttgctttatctgcctaatgcgtatttatcgtcttaatttggatcgtctttgcaaaacgg

SEQ ID NO: 45328 - protein, 75 aa, Panicum virgatum
  misc_feature: Ceres CLONE 2024531
  misc_feature (1)..(75): Pfam Name: Metallothio_2 Pfam Description: Metallothionein
MSCSCGSSCNCGSNCKCGKMYPDLEEKSSGGAQATIVLGVAPEKKAGQFEVAAESGETAHACKCGNSCSCDPCNC

SEQ ID NO: 45329 - DNA, 649 bp, Panicum virgatum
  misc_feature: Ceres CLONE 2024536
  misc_feature: Encodes the peptide sequence at SEQ ID NO. 45330
atagcgacagcgacagccagcagcaagaacacgcgagcacgagagagagagagagagagagagcgccgcgcctggccgggaataaagccagccagcgagcgcgcgcacggcggcggcatccatatggcggccgaccaccacggccagcagccgccgggggcgggggcggaggcggagatcaaggagcaggaccggctgctgcccatcgccaacgtcggccgcatcatgaagcagatcctgccgcccaacgccaagatctccaaggaggccaaggagaccatgcaggagtgcgtctccgagttcatcagcttcgtcaccggggaggcctccgacaagtgccacaaggagaagcgcaagaccgtcaacggcgacgacgtctgctgggccttcggcgccctcggcttcgacgactacgtcgaccccatgcgcaggcacctccacaagtaccgcgagctcgagggcgaccgcgccgccgccgccgcctcctcccgcgggggcgggggctccacctcggccggccccgacgccggggcggcaggacccagcaccggtcatttcatgttcggcgccgccgtggacaggagcgataataacaacagctccgcctccaggcccttttaagttttaatccatcctccatctcttaatt

SEQ ID NO: 45330 - protein, 165 aa, Panicum virgatum
  misc_feature: Ceres CLONE 2024536
  misc_feature (24)..(89): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 2141 in the 10/666,642 US patent application
  misc_feature: The sequence is a functional homolog of SEQ ID NO 336 in the 11/435,388 US patent application
  misc_feature: The sequence is a functional homolog of SEQ ID NO 338 in the 10/714,887 US patent application
  misc_feature: The sequence is a functional homolog of SEQ ID NO 794 in the 10/374,780 US patent application
  misc_feature: The sequence is a functional homolog of SEQ ID NO 92 in the 10/675,852 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 62 in the 10/675,852 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: Functional homolog of the protein sequence given in SEQ ID NO 50466
  misc_feature: Useful for making plants with modulated drought sensitivity
  misc_feature: Functional homolog of the protein sequence given in SEQ ID NO 50467
  misc_feature: Useful for making plants with altered alkaloid content
  misc_feature: Useful for making plants with altered terpenoid content
  misc_feature: The sequence is a functional homolog of SEQ ID NO 22 in the 10/675,852 US patent application
  misc_feature: The sequence is a functional homolog of SEQ ID NO 60 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 791 in the 10/374,780 US patent application
  misc_feature: Functional homolog of the protein sequence given in SEQ ID NO 50465
  misc_feature: Useful for making plants with modulated biomass
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 42 in the 10/675,852 US patent application
  misc_feature: The sequence is a functional homolog of SEQ ID NO 64 in the 10/675,852 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 66 in the 10/675,852 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 44 in the 10/675,852 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 788 in the 10/374,780 US patent application
  misc_feature: The sequence is a functional homolog of SEQ ID NO 803 in the 10/374,780 US patent application
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 793 in the 10/374,780 US patent application
  misc_feature: The sequence is a functional homolog of SEQ ID NO 22 in US patent 7166765
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
MAADHHGQQPPGAGAEAEIKEQDRLLPIANVGRIMKQILPPNAKISKEAKETMQECVSEFISFVTGEASDKCHKEKRKTVNGDDVCWAFGALGFDDYVDPMRRHLHKYRELEGDRAAAAASSRGGGGSTSAGPDAGAAGPSTGHFMFGAAVDRSDNNNSSASRPF

SEQ ID NO: 45331 - DNA, 533 bp, Panicum virgatum
  misc_feature: Ceres CLONE 2024538
  misc_feature: Encodes the peptide sequence at SEQ ID NO. 45332
agtaccacactcacatcctcatcacacttcaagatgactctcgccgttgacctcctcaacccctcgaccgagcagcaggctcgctgccacaagctcaagcgacttgtgcagaaccccaactcgttcttcatggacgtcaagtgccccggctgcttcgccatcaccaccgtcttctcgcacgcccagaccgtcgttgtctgcggctcgtgcgcccaggtgctctcgcagcccaccggtggtaaggcccgcttgaccgagggctgctctttccgcaagaaggcgtaaagtgcttcaaggaattcgcatcgtttcccgccttctttcacacacatacacgcacggtcgtattttgcattccctgcccaccctctcacatctcgaaaaaggggatggtctcgctgcaggactttttggcctgagacacactcatccccaatacagaacagatccgccgctcggcgtacccgctgttctgtcttgtaccatcttccacacccggcctttttcacttgcaacacggctgactttctcgc

SEQ ID NO: 45332 - protein, 83 aa, Panicum virgatum
  misc_feature: Ceres CLONE 2024538
  misc_feature (28)..(82): Pfam Name: Ribosomal_S27e Pfam Description: Ribosomal protein S27
MTLAVDLLNPSTEQQARCHKLKRLVQNPNSFFMDVKCPGCFAITTVFSHAQTVVVCGSCAQVLSQPTGGKARLTEGCSFRKKA

SEQ ID NO: 45333 - DNA, 491 bp, Panicum virgatum
  misc_feature: Ceres CLONE 2024547
  misc_feature: Encodes the peptide sequence at SEQ ID NO. 45334
accaccgccagggccgcgccctccgccgagcaccacgacgccaggtccaggggctccgccacaaccaccacgtcgtcctcctcctccggacgcggcgacgacgagcctgacccgccgccgaggacgctcagggacccgccctacacgctgggccccaagatctccgactgggacgaggagcgcgccgcctggcaccgccgccacccggagacgccgcccttcctcaacgaagtcaagccgcgggtgctgctcgtcaccggctcctctcccaagccctgcgagaaccccgtcggtgaccactacctcctcaagtccatcaagaacaagatcgactactgccgcgtccacggcatcgagatcttctacaacattttcacttggcattgctgtagatatacagaaagaatcgccatgttctttgagacttcatgtttctgacttgcaagtcttgcaatagcaagtggtaaagatattccatttgttgtttctgg

SEQ ID NO: 45334 - protein, 145 aa, Panicum virgatum
  misc_feature: Ceres CLONE 2024547
  misc_feature: SWISSPROT Homolog: EC 2.4.2.39 Xyloglucan 6-xylosyltransferase
  misc_feature: Functional homolog of the protein sequence given in SEQ ID NO 51705
  misc_feature: Useful for making plants with altered carbohydrate content
  misc_feature: Functional homolog of the protein sequence given in SEQ ID NO 51706
  misc_feature: Useful for making plants with altered cell wall content and/or composition
TTARAAPSAEHHDARSRGSATTTTSSSSSGRGDDEPDPPPRTLRDPPYTLGPKISDWDEERAAWHRRHPETPPFLNEVKPRVLLVTGSSPKPCENPVGDHYLLKSIKNKIDYCRVHGIEIFYNIFTWHCCRYTERIAMFFETSCF

SEQ ID NO: 45335 - DNA, 700 bp, Panicum virgatum
  misc_feature: Ceres CLONE 2024557
  misc_feature: Encodes the peptide sequence at SEQ ID NO. 45336
accaaggtcctttccccccctcctccacccgcttccccaccccaaccacctccggcgagctctacaccggcggcagcggaggagcgtgggggctgatcctaggaggcgaaagagcagcggggcggagacgaggtgatggggcagcagcagctgatctacgcgttcgtggcgcggggcacggtggtgctggccgagtacaccgagttcaccggcaacttcaccaccatcgcggcccagtgcctgcagaagctccccgccagcaacaacaagttcacatacaactgcgacggccacaccttcaactacctcgtcgaggacggattcacgtattgtgtagtcgctgttgattcagtcggccggcaaatccccattgctttcctggacagagttaaggaagatttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaagcccaagtctcagaagttaaaggagttatgatggagaatatcgagaaggttctggaccgtggggagaagattgaactgcttgttgacaagactgaaaatctgcgttctcaggcacaagatttcaggcagcagggcaccaaggtgcggcggaagatgtggc

SEQ ID NO: 45336 - protein, 188 aa, Panicum virgatum
  misc_feature: Ceres CLONE 2024557
  misc_feature (127)..(188): Pfam Name: Synaptobrevin Pfam Description: Synaptobrevin
MGQQQLIYAFVARGTVVLAEYTEFTGNFTTIAAQCLQKLPASNNKFTYNCDGHTFNYLVEDGFTYCVVAVDSVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMW

SEQ ID NO: 45337 - DNA, 677 bp, Panicum virgatum
  misc_feature: Ceres CLONE 2024561
  misc_feature: Encodes the peptide sequence at SEQ ID NO. 45338
agaaaggaggtgttatggccattgtcgatgagcgcccatatgttgagctgtttttgtcaactaactgcaagattgctgtagctggctcagattttaccagtagaggatggggctttgcatttccaagggattcccctctgcaaatagacctgtccaccgcaatcctaactttgtcggagaatggggaactgcagcggatccacgacaagtggctcaggacaggcgattgctcagctgacaataccgagtttgtggactcgaaccagctccgccttgagagcttcatgggcctgttcctcatttgtggtgcagcatgtgccctcgcactgctcatttacttcggcatcatgctacgccagtacctgagacatgaaccgcctgattctatctccgcagagccagggtcatcaaaatcaaagcacagcatcaaaagattcttctcattcgtcgataacagggagccaccaaaccaaaatcggtctttgcacctttcagggagttcgatgccaacaacgccaactagtaatgttgacatagaaaggccagggaggccaatcagaaatggaggtgtcgttaatatagagagctagtgcctgtgcatacttttggacctgagatgcatcatctttgggccaatctacacgttcttatatactccctccttccccgtttataag

SEQ ID NO: 45338 - protein, 195 aa, Panicum virgatum
  misc_feature: Ceres CLONE 2024561
  misc_feature (1)..(115): Pfam Name: Lig_chan Pfam Description: Ligand-gated ion channel
KGGVMAIVDERPYVELFLSTNCKIAVAGSDFTSRGWGFAFPRDSPLQIDLSTAILTLSENGELQRIHDKWLRTGDCSADNTEFVDSNQLRLESFMGLFLICGAACALALLIYFGIMLRQYLRHEPPDSISAEPGSSKSKHSIKRFFSFVDNREPPNQNRSLHLSGSSMPTTPTSNVDIERPGRPIRNGGVVNIES

SEQ ID NO: 45339 - DNA, 1226 bp, Panicum virgatum
  misc_feature: Ceres CLONE 2024563
  misc_feature: Encodes the peptide sequence at SEQ ID NO. 45340
attccactttctccgaacattccacctctcacctccgtcaacctcttcggaatccatcaaaccatcattgagtggtggctcttcttggttgttctttgcctgccaaccattgccattgtctaatctggtggcaaaactcgtcctgttttcggggaaactgcacagagattaaggtgcctaattacagcgtcgcgctcagttgagatcggttttcttcaggcaaccgctgccacttttccatcaatcatcaacccatcatgtctcgcaacggaaccaccctttacgtgtccggcttcagccacggcactcgcgcgcgcgaccttgcgtacgaattcgagcgctacggccgtctggttcgctgtgatatcccggctccgcggtccgccagcagcaggctgtttgctttcgtggagtacgaggatcgccgcgatgcggacgacgcgtatcatgatatgcacaacaagcgcatcggtcgcgacgatgtgctgaagattgagtgggctcgtaccccgccttccgcttcgtggcggttcgaccgcagtgaacgggagcgtggaccgcgccgctcttccccgcgccgccggtcgcccagcccgcgtcgtcgcgactactcgcctaggaaggatgatcgccgtgaccgcgaccgggaccgtgactacgaccgtgatcgccgcgacacccgtgaccgctcgcgcagccctgatcgcgatcgggaccgtgacaccaaggacgaccgtgaccgtgacgagcgcgaccgtcgcgagaacggcgcgaatggggacgacaggaagcccatcgacagccccgatcggccggcccacgacgacctcgatgtcgccgaatgaacgcgttttcatcgggaaaccccttcttaatcgcgattccttcagggttctggctgtaagactgttactgcactttcggcgttctctttcctcctgtggtggattactgatgttggacgtctcttggggcgttcaaccttctcaagctcgttacctctgttcccacttttgcgtcggcccagaatgcgataattggaccttccaatccgccccaattccgaaaatataggagggacatccgcgacgaccatttctggagacagtaggatgtacctagccttacgcatgcgatcgttcatctccttacgttctgctggagtcggtggggagttaaaatagacactgttccgagtaggtagttgcaatgcaggttggtttctc

SEQ ID NO: 45340 - protein, 195 aa, Panicum virgatum
  misc_feature: Ceres CLONE 2024563
  misc_feature (8)..(79): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRNGTTLYVSGFSHGTRARDLAYEFERYGRLVRCDIPAPRSASSRLFAFVEYEDRRDADDAYHDMHNKRIGRDDVLKIEWARTPPSASWRFDRSERERGPRRSSPRRRSPSPRRRDYSPRKDDRRDRDRDRDYDRDRRDTRDRSRSPDRDRDRDTKDDRDRDERDRRENGANGDDRKPIDSPDRPAHDDLDVAE

SEQ ID NO: 45341 - DNA, 638 bp, Panicum virgatum
  misc_feature: Ceres CLONE 2024596
  misc_feature: Encodes the peptide sequence at SEQ ID NO. 45342
agcatctccaccaaaaaaacgcaagcgcatccgtcgccgaagcatctccgcccgccgcccgtgcgtgcttgctgcgaccggccgttcgattggttgggtagctagggtttagggggtttgggcgcggagaggcaggagggtaggcggaggagatggcgtcagcggaggaggagatcgcggtgaaggagccgctggatctgatacggctcagcctcgacgagcgcatctacgtcaagctccggtccgaccgcgagctccgcggcaagctccatgcatacgatcaacacttaaacatgatccttggagatgttgaggaggtcgtgacaactgttgagatagatgatgaaacatatgaagaaattgtgcgcacaacgaaacgcactatccccttcctttttgtccgaggtgatggtgtcatattggtttctccgcccctgcgaactgcatgaagctagaagttttagatgcagctgattgtcaactatttatttactctgtatttggccagttgatggcttggagtgtatgccatgtgctgcactgttactgttttctgatggattgtaggcttaacgagtgatacaatcatgtaactactgcttggtgtttgaatcttatggttgtcaacgctcttgcat

SEQ ID NO: 45342 - protein, 98 aa, Panicum virgatum; identical to SEQ ID NO: 12628
  misc_feature: Ceres CLONE 2024596
  misc_feature (15)..(93): Pfam Name: LSM Pfam Description: LSM domain

SEQ ID NO: 45343 - DNA, 674 bp, Panicum virgatum
  misc_feature: Ceres CLONE 2024598
  misc_feature: Encodes the peptide sequence at SEQ ID NO. 45344
acggacggagcacgaatatccccatccatccaaccgctcgtccgggcaggcgacgacgcgtcaatcgattccttcctcctccacctcctccttccccggcgacgccttgtcccctcctccgacccgcacccccgagagatcgagcgatcgatcgccgatcgatccgttccccaagcaccccgatcccctatccaccctgcaaccgaccgaccggccgccggcgcgcgcgcgcgcgcaagattcagatttgccccggcgcgggggaggaggagcggcgagcgaggatgggcgcgtggatgtcgcgcgtgtggttcctgatgttcccggcgcgggagtacaagctcgtcgtggtggggctcgacaacgctggcaagaccaccacgctctacaagctccacctcggcgaggccgtcaccgccgcgcccaccatcggcagcaacgtcgaggaggtcgtcttcaagaacctgcgcttcgaggtgtgggatctaggtggacaagagagtttacgaacttcatgggcaacatactaccgaggaactcatgctgtcatcgtagtaattgacagcaccgaccgcgctcggatcaacatcatcaaggacgagctcttccggttgctccaacacgcagatctggagggtgcggtggttctcgtgtttgcgaacaagcaggacctt

SEQ ID NO: 45344 - protein, 129 aa, Panicum virgatum
  misc_feature: Ceres CLONE 2024598
  misc_feature (5)..(129): Pfam Name: Arf Pfam Description: ADP-ribosylation factor family
  misc_feature: Functional homolog of the protein sequence given in SEQ ID NO 51466
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50150
  misc_feature: Useful for making plants with altered alkaloid content
  misc_feature: Functional homolog of the protein sequence given in SEQ ID NO 50220
  misc_feature: Useful for making plants with altered terpenoid content
MGAWMSRVWFLMFPAREYKLVVVGLDNAGKTTTLYKLHLGEAVTAAPTIGSNVEEVVFKNLRFEVWDLGGQESLRTSWATYYRGTHAVIVVIDSTDRARINIIKDELFRLLQHADLEGAVVLVFANKQD

SEQ ID NO: 45345 - DNA, 709 bp, Panicum virgatum
  misc_feature: Ceres CLONE 2024600
  misc_feature: Encodes the peptide sequence at SEQ ID NO. 45346
cttctcagtagtacactcgctagctagctaagctgctatataaattaaattaaagctagcagcgcgcggcaagtagtactgatcgatcggcatcgccggccggagatcgacatgacgatgatgaagaagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatctgtatctatacatacatgcatacatacatacatacatatatatgatcgctcgctcgctcgctcgatcttagtcgtctacgtgtggcttgctgctgttcatccagccgctcgctacgtgtgtgtgtatatagacacacacacgcgacggataaataaaagatgcatgggttgcctccgggccgctccctatatagctactttgttgtgtattactagtatcaatcaatcctactttctgatgtcttcactacatgtgaaaagctataatct

SEQ ID NO: 45346 - protein, 93 aa, Panicum virgatum
  misc_feature: Ceres CLONE 2024600
  misc_feature (28)..(93): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass
MTMMKKQQAVVLLLLLLVAAGGASAASCNAGQLTVCASALTSGGKPSAACCSNLKAQQGCFCQFAKNPAFARYINSPTARKVVASCGVALPRC

SEQ ID NO: 45347 - DNA, 733 bp, Panicum virgatum
  misc_feature: Ceres CLONE 2024607
  misc_feature: Encodes the peptide sequence at SEQ ID NO. 45348
aaccacagctccgccgcttccgctctcggcttcgtctgcacgctaccccgcctcgccgccgcttctccctcgccccagcatggccgccgcgtcgtccgccacctccgtccacgacttcaccgtcaaggatgcgagcgggaaggacgttgacctcagcacctacaagggcaaggttctcctcatcgtcaacgttgcatcccagtgtggattaactaactccaactacaccgagttggcccagctctatgagaagtacaaggaccaaggctttgagatcctcgcttttccatgcaaccagtttggtgggcaggagcctggcaccaatgaggaaattgtccaatttgcctgcacacgcttcaaggccgagtaccccatctttgacaaggttgacgtcaacggtagcaatgccacacccctctacaagttcctgaagtctagcaagggtggcctgttcggtgacagcatcaagtggaacttctcaaagttcttggttgacaaggaggggcgcgttgtggatcgctacgctccgaccacttcccctctgagcattgagaaggacatcaagaagctgcttgggagctcttaaaccatctgtctagaacctgtagcgcaaaactgtattcatctgagcgctaaaatttacaataatattgtatcaataaagaagctgcttgggagctcttaaactatctgtctagaacctgtagcgcaaaactgtattcatctgagcgct

SEQ ID NO: 45348 - protein, 168 aa, Panicum virgatum; identical to SEQ ID NO: 18691
  misc_feature: Ceres CLONE 2024607
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50171
  misc_feature: Useful for making plants with modulated nitrogen use efficiency
  misc_feature: Functional homolog of the protein sequence given in SEQ ID NO 50170
  misc_feature: Useful for making plants with modulated flowering time

SEQ ID NO: 45349 - DNA, 571 bp, Panicum virgatum
  misc_feature: Ceres CLONE 2024616
  misc_feature: Encodes the peptide sequence at SEQ ID NO. 45350
agatgcgcaaacaccgaatcgccggaccggtcgctgccttgctcgccctcaccctctcgctcacccgcagcgcgcgagaggagccgcccatggccgaccgcgggccgctggctggcggcgtcacggacgcgccgcagaacgacaacgacatccacctccaggagctcgcccgcttcgccgtcgatgagaacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgtggaagagagtgctagcgcttaaggatccctcgtcttccacgtgcaattgctgcctgaagcgctaaacagacttgcagaataaggagctggatcggatgtaatagctgtgtcgttgtgagctccgttgtgtaatatcgtatgaacaccttgccctttgtgtaatatcatgaatgacagtgccctttgtgtataact

SEQ ID NO: 45350 - protein, 102 aa, Panicum virgatum
  misc_feature: Ceres CLONE 2024616
  misc_feature (9)..(97): Pfam Name: Cystatin Pfam Description: Cystatin domain
MADRGPLAGGVTDAPQNDNDIHLQELARFAVDENNKKTNALLEFEKLVKAKTQVVAGTMYYLTVEVKDGEAKKLYEAKVWEKPWENFKELQEFKPVEESASA

SEQ ID NO: 45351 - DNA, 624 bp, Panicum virgatum
  misc_feature: Ceres CLONE 2024619
  misc_feature: Encodes the peptide sequence at SEQ ID NO. 45352
gcttctgcctcctctctccacacgacttgctcccgccgccgccgacgccgccgccgtcgcagcagtccccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggttgcgccagttgttggccattcctgttttaaacaagttaaatgatgaattgaatccccccttgcctagcgtactgctttcgtatcaagttattgaacaatgctactttgtcctttgagtaggctatggagaatggccttaagcaatggaattgtaatttgagtactcgtcttgttgcaagttttggtctgttattgcctgaatgaatttaagtgcacttgatgatgtgtgacatgattttgttgctatcttgggtaacaacaatgaatggcttgtatgactctaatgtttaatttgaactcttactgtccactacaaatcct

SEQ ID NO: 45352 - protein, 65 aa, Panicum virgatum; identical to SEQ ID NO: 9766
  misc_feature: Ceres CLONE 2024619
  misc_feature (1)..(65): Pfam Name: Ribosomal_S28e Pfam Description: Ribosomal protein S28e

SEQ ID NO: 45353 - DNA, 667 bp, Panicum virgatum
  misc_feature: Ceres CLONE 2024621
  misc_feature: Encodes the peptide sequence at SEQ ID NO. 45354
aaactgatcaaccgaaaaattgcacccccaacccacccaaggcccccaacctgctaaaatggcacaacccatggcttccttaaccggcctctccccgggcttgctgcccaccaggcccccccccaccagggccagggcggccttcttcagggcttcggccaagggcaaggccccggcccaggctggccccccccccttgctcgggctgggggccaccggcttctccggcggcttcttcttccaggcggggccccccaataaggccttcaaaaccttcaaaatcggcccccccccccccccctctggggaacttcccggaaccttaaattctaaccaggccaggaacttcaacctccccttgaagaaccggttctacctgcaccctttgccaccggcgaaggccgcaccaagggccaattcttcggcccagaacatcctcaacctcaacccactcatcaacaaaaaggtttggccttatgtcataaacaacctccgcctccgggcctcctacctgccctacaacttcaacaccttcatcccctccaagcccaggaagaaaaaaaaaaccctcaaggacctcaccggcaacttcttcacaaccatcaacaatcttgaccatgcggcaaaaatcaaaacaacccagaaggctaagaattactacccgcca

SEQ ID NO: 45354 - protein, 198 aa, Panicum virgatum
  misc_feature: Ceres CLONE 2024621
  misc_feature (8)..(197): Pfam Name: PsbQ Pfam Description: Oxygen evolving enhancer protein 3 (PsbQ)
MASLTGLSPGLLPTRPPPTRARAAFFRASAKGKAPAQAGPPPLLGLGATGFSGGFFFQAGPPNKAFKTFKIGPPPPPSGELPGTLNSNQARNFNLPLKNRFYLHPLPPAKAAPRANSSAQNILNLNPLINKKVWPYVINNLRLRASYLPYNFNTFIPSKPRKKKKTLKDLTGNFFTTINNLDHAAKIKTTQKAKNYYP

SEQ ID NO: 45355 - DNA, 694 bp, Panicum virgatum
  misc_feature: Ceres CLONE 2024633
  misc_feature: Encodes the peptide sequence at SEQ ID NO. 45356
gcgacgttgaagaaagaaacctctccgtccacacaagttaatactgctaagcgatcgagaagccagttgggttgtgccaggcgatccatagatagagctagcagcaatggcgacctccctcccggccgcgcccctcctcgcccataccattaccaggtgctcctacctcggcttcatccattccattccatccatctccagcgtgcgcgccggcctctcaatgcccaattattccgtacgcagcctccggcatagtggcgccgccgcacgagctcctaatcctcggtccgttgccacggcgaggcccgcgggcgccaggaggagctcgctccgcaccgtcgccgtcaggtacggtgtcgacgaggcgttgcgccccgaggcggaggcggcggcggcggtgccgcgctccgtgccggtgcgcgtcgcctacgagctccatcaggccggccaccggtacctcgacgtcagaaccgaggccgagttcagcgctgggcatcccgaaggagctgtaaatatcccctacatgaacaagaccggctcagggatgaccaaaaacacccactttcttgagcaagtatcgagcatcttcggcaaggatgatgagatcatcgttggatgccaaagtggcaagaggtctctcatggcagcaactgaactctgctctgctggtttcactgctgtgaccggcatcgct

SEQ ID NO: 45356 - protein, 195 aa, Panicum virgatum
  misc_feature: Ceres CLONE 2024633
  misc_feature (102)..(195): Pfam Name: Rhodanese Pfam Description: Rhodanese-like domain
  misc_feature: SWISSPROT Homolog: EC 2.8.1.1 Thiosulfate sulfurtransferase
MATSLPAAPLLAHTITRCSYLGFIHSIPSISSVRAGLSMPNYSVRSLRHSGAAARAPNPRSVATARPAGARRSSLRTVAVRYGVDEALRPEAEAAAAVPRSVPVRVAYELHQAGHRYLDVRTEAEFSAGHPEGAVNIPYMNKTGSGMTKNTHFLEQVSSIFGKDDEIIVGCQSGKRSLMAATELCSAGFTAVTGI

SEQ ID NO: 45357 - DNA, 664 bp, Panicum virgatum
  misc_feature: Ceres CLONE 2024646
  misc_feature: Encodes the peptide sequence at SEQ ID NO. 45358
ctctcttcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcacctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacggtcgccgcgagggcggtggcggctacggcggcggcggcggcggctacggtggccgtggaggctacggtggcggcggcggcggcggctacggtggcaaccgcggcggcggctacggcaactccgatgggaactggaggagctgagcggtggggcccgcgtggccaaagttatcctgtgctttctactgtgacccgagttatcctgtgtcatgatctacctgtgtttggtgtctgtttcgtgttcgttgttgcccatctgtgtttttgatcgc

SEQ ID NO: 45358 - protein, 145 aa, Panicum virgatum
  misc_feature: Ceres CLONE 2024646
  misc_feature (10)..(81): Pfam Name: RRM_1 Pfam Description: RNA recognition motif. (a.k.a. RRM, RBD, or RNP domain)
  misc_feature (48)..(140): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSTYGEVLESKIILDRETQRSRGFGFVTFSSEQAMRDAIEGMNGKELDGRSITVNEAQSRGGPRSGGGGGYGRREGGGGYGGGGGGYGGRGGYGGGGGGGYGGNRGGGYGNSDGNWRS

SEQ ID NO: 45359 - DNA, 656 bp, Panicum virgatum
  misc_feature: Ceres CLONE 2024658
  misc_feature: Encodes the peptide sequence at SEQ ID NO. 45360
attcacttcaactaaacatcagttgctgtacgtcatggcccaagtagtagtgttgcagctgcgccatgttctccatgagttgctgctgccacaagcatcagcagcagtctccatcctgctcatgatcatctgccctcttctggccctcctgatcgtccgccgcccattggcggcggccaccgcaagaagagctagagaacagctgctgagcaagctgccttcacccccctccaggctccccgtcatcggccacctccaccttgtcggctccctcccgcacgtcaccctccgtgacctcgccggcaagcacgccgccggcggcctcatgctcctcctcctccctcacctatccatggcggactgtgtcgtcgatggttacacaatcccacccggcgttcgagtcatcgtcaatgcgtgggctattagcagggatccagagttatgggagaagccggaggagttcatgccagagaggttcatggatggtgggagtgccgtggccatcgactatagagggaacgactttcagtttgtactatttggggctggaaggaggatctgtcctggtctcaactttggtttggctgtggttgacatcatgctggcaaacctcgtgtattgttttgactggcagctgccaaacggcatggaggcca

SEQ ID NO: 45360 - protein, 207 aa, Panicum virgatum
  misc_feature: Ceres CLONE 2024658
  misc_feature: SWISSPROT Homolog: EC 1.14.13.88 Flavonoid 3',5'-hydroxylase
MAQVVVLQLRHVLHELLLPQASAAVSILLMIICPLLALLIVRRPLAAATARRAREQLLSKLPSPPSRLPVIGHLHLVGSLPHVTLRDLAGKHAAGGLMLLLLPHLSMADCVVDGYTIPPGVRVIVNAWAISRDPELWEKPEEFMPERFMDGGSAVAIDYRGNDFQFVLFGAGRRICPGLNFGLAVVDIMLANLVYCFDWQLPNGMEA

SEQ ID NO: 45361 - DNA, 421 bp, Panicum virgatum
  misc_feature: Ceres CLONE 2024659
  misc_feature: Encodes the peptide sequence at SEQ ID NO. 45362
ggcttttgctgctgccaaattttgtgatgcatgcttgcgagcaatgcggggtgaaggtggcatcgtggaatgctcatatattgcgtctcaggtgacagagctgccgttctttgcaacaaaagtgaggctgggccgtggtggagctgaggagatcctccctcttggacctctcaacgaatttgagagagttggcctggaagcggcaaagaaggaactgagtgagagcattcagaagggcatcgcttttgtgaacaagtgatacggaggaagggatcgtccccgagatccccgaccgtacatagatgtaagagcgttgtgatatagtgctcctatacctgtaaatatcacttttgtaaaacaatagtaaaaaatctaattaccctttagcaaattgcatggaataaatttttcgtcttcattc

SEQ ID NO: 45362 - protein, 85 aa, Panicum virgatum
  misc_feature: Ceres CLONE 2024659
  misc_feature: SWISSPROT Homolog: EC 1.1.1.37 Malate dehydrogenase
AFAAAKFCDACLRAMRGEGGIVECSYIASQVTELPFFATKVRLGRGGAEEILPLGPLNEFERVGLEAAKKELSESIQKGIAFVNK

SEQ ID NO: 45363 - DNA, 916 bp, Panicum virgatum
  misc_feature: Ceres CLONE 2024673
  misc_feature: Encodes the peptide sequence at SEQ ID NO. 45364
ggcttctctcctccccgagcacttcgcctccgcctcgagccggcgccaccacagccgcaggccccgccggaagcgaggaggggaggggcgacgcggcgactgcgctcgtcttccccgccaccgtcggcgtcctctcgcgatggcacctctcacggcccccaagtccggcgacgccctcttcgccagcgtcgatcgcgtcaacgcggagctgttcacgctcacgtatggcgccgtcgtgcggcagctgctcacggatctggaggaggtcgaggaggtcaacaagcagctagatcagatgggttacaacattggaacacggttgattgatgagttcttagcaaagtcaaacgtatcaaggtgtgttgacttcaaggagactgctgatgttatcgcaaagcttggatttaagatgttcttgggtgtgactgcaactgtaaccaattgggatgccgagggtacaagctgcagctttatattggaggacaatcctcttgttgattttgttgagctccctgacacttgccaaggccttcagtattgcaatgtgttaagtggagtaatcaggggagcattggaaatggtgtctatgaagacagaggtgacatgggtccgtgacatgctccgtggggatgatgcctatgagatgcgtgtgaagcttatcaagcaagtccccgaggaatacccctacaaggacgatgactagtttgagtttaagcgaagttcctgcagcagggcgctagtttgcttgtctggatgttaattttgttgtggatatagtcctggtattacatgatgtcacaagagtaaactgttgattgcatttacaattgtcgtgtgtattactggtgtattgtagaaatattgcatatcttccatgccttgtggctttgaattaatccggtgaattacgggcatc

SEQ ID NO: 45364 - protein, 187 aa, Panicum virgatum; identical to SEQ ID NO: 18920
  misc_feature: Ceres CLONE 2024673
  misc_feature (24)..(174): Pfam Name: TRAPP_Bet3 Pfam Description: Transport protein particle (TRAPP) component, Bet3

SEQ ID NO: 45365 - DNA, 690 bp, Panicum virgatum
  misc_feature: Ceres CLONE 2024697
  misc_feature: Encodes the peptide sequence at SEQ ID NO. 45366
gcgggtcgcctcccattcccgtttcctccgccccccccccccccccatccccgcctcggatctgctgcccccaccggttcaaatccccacgcgagcggaaaaaccgagcgggcgaatcgaatcccgtcccgttcggcgagcaagcggcgtcccgccgggcagcacagcacctcgtcgtcggctgggggcctgggttcgggctcgctcgatcggatggcgcaccgggtggacgagtgcgactacctcttcaagatcgtgctcatcggcgactccggcgtcggcaagtccaacatcctctcccgcttcacccgcaacgagttctgcctcgagtccaagtccaccatcggcgtcgagttcgccacccgcaccctgcagattgatgggaagactgtcaaggcacagatatgggacactgctggacaggagagataccgtgcaatcactagtgcgtattacagaggcgctgttggagcgctcctagtctacgacataacaaagaagcaaacttttgacaacgttcagaggtggctccgggagctccgggatcatgcagatgccaacattgttgtcatgatggtcggtaacaagtcggacttgaaccacttgagatcggtcgctgaggaagacggccaagcattttcagagaaggaaggcctatccttcctcgagacatctgcgctggaggccggc

SEQ ID NO: 45366 - protein, 158 aa, Panicum virgatum
  misc_feature: Ceres CLONE 2024697
  misc_feature (13)..(158): Pfam Name: Ras Pfam Description: Ras family
  misc_feature (13)..(127): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50223
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50522
  misc_feature: Useful for making plants with modulated oxidative stress sensitivity
MAHRVDECDYLFKIVLIGDSGVGKSNILSRFTRNEFCLESKSTIGVEFATRTLQIDGKTVKAQIWDTAGQERYRAITSAYYRGAVGALLVYDITKKQTFDNVQRWLRELRDHADANIVVMMVGNKSDLNHLRSVAEEDGQAFSEKEGLSFLETSALEA

SEQ ID NO: 45367 - DNA, 491 bp, Panicum virgatum
  misc_feature: Ceres CLONE 2024703
  misc_feature: Encodes the peptide sequence at SEQ ID NO. 45368
aactaacgctaaaaaagtaacagtttctgtactttattgtctgcgttgtcgaagcaatgcgcaaggacgagtgcgaattctccaactacatcatgcaccctggcacgggtatgcgctatgtgcccttcgcgttcatctcgacgaagcccgtgctcgctttcgcgcgccccaagtgcctgagcctgtacatgcgcaagaagaacccccgcactgtgccgtggacccgcactttccgccgcctgcacaagaagcaggccgccgatgtcgttgtgaagcgccgctcccacaaggtgtcgcgcgtgtctcgcgccatcgtcggtgcggacctgtcgtacatccaggaggtccgcgccaagcgtgcccccaaggtggaccgcaccgccaagggcaaggccgttcgcgccgagatggctgagcgcaaggccgccaagaagtaagcactgctgcagacgctcagactgacccttctccgtaccccccttttaccaacc

SEQ ID NO: 45368 - protein, 126 aa, Panicum virgatum
  misc_feature: Ceres CLONE 2024703
  misc_feature (1)..(75): Pfam Name: Ribosomal_L24e Pfam Description: Ribosomal protein L24e
MRKDECEFSNYIMHPGTGMRYVPFAFISTKPVLAFARPKCLSLYMRKKNPRTVPWTRTFRRLHKKQAADVVVKRRSHKVSRVSRAIVGADLSYIQEVRAKRAPKVDRTAKGKAVRAEMAERKAAKK

SEQ ID NO: 45369 - DNA, 592 bp, Panicum virgatum
  misc_feature: Ceres CLONE 2024714
  misc_feature: Encodes the peptide sequence at SEQ ID NO. 45370
cccaacccatcccagctaagatcatcatgtcgaccgcgtccctcgaccagaaactcgcccttgccaagcgctgctcgagagaagctaccctcgcaggagccaaggcagcagctgtggcgaccgtcgcctccgcgatccccaccctggcgagcgtgcggatgctgccatgggcgaaggccaacatcaaccccaccggccaggcactcatcatctccactgtcgccgggatggcctacttcatcgcggcggacaaaaagatcctctcgctggcgaagcgccactcgttcgagaacgcccccgagcacctcaggaacacctcctaccagggcaccggccgtccccacccggccttcttcaggccatgatcggctcgcaagcaaagacccgtgctgccctgcgctctagccacatatgtacaccgtgtatgcttggagcaacaataataagctggcccctgcagagcagggccagcaggtagctgctctaagcttctgcagtgtgcagtagtctttgaatatatgcgtccatgccgtttactattactctgtctcagcaacatctatcgtggtactgaatactactagttcttgtc

SEQ ID NO: 45370 - protein, 112 aa, Panicum virgatum
  misc_feature: Ceres CLONE 2024714
  misc_feature (8)..(86): Pfam Name: ENOD93 Pfam Description: Early nodulin 93 ENOD93 protein
MSTASLDQKLALAKRCSREATLAGAKAAAVATVASAIPTLASVRMLPWAKANINPTGQALIISTVAGMAYFIAADKKILSLAKRHSFENAPEHLRNTSYQGTGRPHPAFFRP

SEQ ID NO: 45371 - DNA, 619 bp, Panicum virgatum
  misc_feature: Ceres CLONE 2024720
  misc_feature: Encodes the peptide sequence at SEQ ID NO. 45372
aataaaatcccagcttaatcattcatctgcttcgagcttgtggtcaagcaactgttgctgcgcagcaatggcaggcaaggcctcggtcgcgctgttcctggccgtcaacctggtcgtgttcgccgtggccagtgccaccagcgccaactgccccccgccgccgtcgtccccgtcgacgccgaccccgacgccggcgtcgagaggcaagtgcccccgcgacgcgctgaagctgggcgtgtgcgccaacgtgctgggcctcatcaaggccaaggtcggcgtgccgcccacggagccctgctgcccgctgcttgaagggctcgtcgaccttgaggccgccttgtgcctctgcaccgccatcaagggcaacatcctcggcatcaacctgaacctgcccatcgatctcagcctcatcctcaaccactgcggcaagagcgtgcccactggattcaagtgcctctaagttactgatcgatgaatgagccgaccatgccagcattcttttgcttattatctgttcgtttagtgcaggcttatcggttactatgtacgcatgtaaccggtttggccagctttcgcttttcgatgattaatgtgcaagtccttgcatggactagtccct

SEQ ID NO: 45372 - protein, 130 aa, Panicum virgatum
  misc_feature: Ceres CLONE 2024720
  misc_feature (48)..(129): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50191
  misc_feature: Useful for making plants with modulated salt sensitivity
MAGKASVALFLAVNLVVFAVASATSANCPPPPSSPSTPTPTPASRGKCPRDALKLGVCANVLGLIKAKVGVPPTEPCCPLLEGLVDLEAALCLCTAIKGNILGINLNLPIDLSLILNHCGKSVPTGFKCL

SEQ ID NO: 45373 - DNA, 466 bp, Panicum virgatum
  misc_feature: Ceres CLONE 2024744
  misc_feature: Encodes the peptide sequence at SEQ ID NO. 45374
atctctcctctctctctctctctctctctctctcggccgccttctttcttctcctttccaagcggcgacgacaggggagtggcgccgcccttgccagtttcgtcgggcgcttcgccggccaagaactcgtagtcgctgatggggaaagcaaagcgggcctcaatcttcatcaggctggtttctgcagccggtactgggttcttctatgtgaagcgcaagaatcctcggcggatcactgagaagcttgaatttaggaagtatgatccccgtgtgaacaagcatgttctgttcacagaagcaaagatgaagtgagatcttctaccttcacaatgcagaacaggaataggttgtcagcattttgcaatcagaaatctctagtaccattaaggatgtcatgttctggtttccagtgttccatttggataactgtaatgggcatatgattaaggatttgatgtgctcttcc

SEQ ID NO: 45374 - protein, 57 aa, Panicum virgatum; identical to SEQ ID NO: 9772
  misc_feature: Ceres CLONE 2024744
  misc_feature (8)..(55): Pfam Name: Ribosomal_L33 Pfam Description: Ribosomal protein L33

SEQ ID NO: 45375 - DNA, 638 bp, Panicum virgatum
  misc_feature: Ceres CLONE 2024750
  misc_feature: Encodes the peptide sequence at SEQ ID NO. 45376
gtcatcgtctcgtctcgtcttccccgtcattttgcggatcagcgaacccaaacgaacagggacagggagcgagctcggacctcggaggccacgcgcgacgagatgccagggctcccggcgccgtccgactacgcggacgagccgccgcgccaccctgccctcacgatcaactccaaggagccgtttaatgctgagcctcaccggtcggcactagtcacatcttacattaccccggtggatttcttctacaagaggaatcatggacccattccaaaagtcgaggacctctcaagatacagtgtttacatttctggtcttgtcaacaagcctattcaactatccatggctgacatttgggctcttccaaagtacaatgtcactgcaactttacagtgtgctggaaacaggagaactgcaatgagtaaggtacggaaagtgagaggtgttggttgggacatatctgctcttggaaatgcaacttggggaggagcaaaactatctgatgtccttgagttagttggaatacccaaactcagttcggttacatctttaggagggaagtatgttgagtttgttagtgttgacaagtgtaaagaggaaaaaggtggtccttatactgcatctattccattaaagca

SEQ ID NO: 45376 - protein, 178 aa, Panicum virgatum
  misc_feature: Ceres CLONE 2024750
  misc_feature (49)..(178): Pfam Name: Oxidored_molyb Pfam Description: Oxidoreductase molybdopterin binding domain
  misc_feature: SWISSPROT Homolog: EC 1.8.3.1 Sulfite oxidase
MPGLPAPSDYADEPPRHPALTINSKEPFNAEPHRSALVTSYITPVDFFYKRNHGPIPKVEDLSRYSVYISGLVNKPIQLSMADIWALPKYNVTATLQCAGNRRTAMSKVRKVRGVGWDISALGNATWGGAKLSDVLELVGIPKLSSVTSLGGKYVEFVSVDKCKEEKGGPYTASIPLK

SEQ ID NO: 45377 - DNA, 544 bp, Panicum virgatum
  misc_feature: Ceres CLONE 2024790
  misc_feature: Encodes the peptide sequence at SEQ ID NO. 45378
gagggaactgatagggattacaaatatcaagagctcctggacagagtgttcaacatccttcatgagaacaacccagatcttgctggggacaggcgtagaacagttatgatgccacctcaggttcttagggagggaacaaagaagactgtttttgttaattttatggacttgtgtaaaacgatgcataggcaacctgagcatgtgatgatgtttttgctcgctgaaatgggaacaagtggatcacttgatgggcagcaaaggttggtgattaaaggaagatttgctcccaaaaacttcgaagcaatcctgaggagatacattaatgagtatgtcatctgcaatggttgcaagagccctgataccattctatccaaggagaatctcctgttcttccttcgtagcgagcagtgtggatcttcaaggtctgttgctccaatcaaggctggattcgttgctcaagttggtcgccggatggcctgaacacaaaacttagctttggattgttagtcctatgagctgccatattggtgttagaatttgagct

SEQ ID NO: 45378 - protein, 159 aa, Panicum virgatum
  misc_feature: Ceres CLONE 2024790
  misc_feature (15)..(142): Pfam Name: eIF-5_eIF-2B Pfam Description: Domain found in IF2B/IF5
EGTDRDYKYQELLDRVFNILHENNPDLAGDRRRTVMMPPQVLREGTKKTVFVNFMDLCKTMHRQPEHVMMFLLAEMGTSGSLDGQQRLVIKGRFAPKNFEAILRRYINEYVICNGCKSPDTILSKENLLFFLRSEQCGSSRSVAPIKAGFVAQVGRRMA

SEQ ID NO: 45379 - DNA, 662 bp, Panicum virgatum
  misc_feature: Ceres CLONE 2024807
  misc_feature: Encodes the peptide sequence at SEQ ID NO. 45380
atcgcctcgccgccgcctcctcccccacactcctcgcttcacctcaaccctgcgagctccagcgcctcccaccacccacccagccacacgcgccgcccgcatggccgccaccgccatctccgtccgcctccacccggccgccgcgcgccacgtcaccgcggcgcggcgcgcccgcctcggcgtcgtccgcgcgctgtccgcgccgccggcggcggcgctgacgcaggacgacctcaagcgcctggcggcggtgcgcgcggtggagtcggtgcagagcgggatggtgctggggctcgggacgggctccacggccgccttcgccgtcgccgagatcggcgcgctcctcgcctccggcaagctcgagaagatcgtcggcgtgcccacctctaagcgcaccttcgagcaggcgcagtcgctcggcatcccgctctccacgctcgacgaccacccgcacatcgacctcgccatcgacggcgccgacgaggttgacccagatcttaaccttgtgaaagggcggggtggtgcccttcttcgtgagaagatggttgaggctgcatcagacaagtttattgttattgttgatgagacaaaacttgttgctggattaggaggaagtggtctagccatgccagtggaggttgtgcagttctgctggaagtaca

SEQ ID NO: 45380 - protein, 187 aa, Panicum virgatum
  misc_feature: Ceres CLONE 2024807
  misc_feature (90)..(187): Pfam Name: Rib_5-P_isom_A Pfam Description: Ribose 5-phosphate isomerase A (phosphoriboisomerase A)
  misc_feature: SWISSPROT Homolog: EC 5.3.1.6 Ribose-5-phosphate isomerase
MAATAISVRLHPAAARHVTAARRARLGVVRALSAPPAAALTQDDLKRLAAVRAVESVQSGMVLGLGTGSTAAFAVAEIGALLASGKLEKIVGVPTSKRTFEQAQSLGIPLSTLDDHPHIDLAIDGADEVDPDLNLVKGRGGALLREKMVEAASDKFIVIVDETKLVAGLGGSGLAMPVEVVQFCWKY

SEQ ID NO: 45381 - DNA, 1067 bp, Panicum virgatum
  misc_feature: Ceres CLONE 2024819
  misc_feature: Encodes the peptide sequence at SEQ ID NO. 45382
atcatcaaattacaaaaaatggcaacacaagcccaaactcctaactttacttccaaaaccaacgccaaagaaattgtagatgcatttggaactggacaatatctttctggaaaaacagcagttgttacaggtgggaatgttggaattggacttgaaacagtaaaagctcttgcgtctgctggagcaagagttattttggcttctcgttcgattgaaaacggagtcaaagcgattgaagaagaaatcaaaaaaccaggacatggtggttattcagtcacagatacttcaaaaatcgttgttaaacaacttgaacttggcagccttaaatccatcaaagccttcgcagaagatctcatcaaaacggaagaaagaattgatctcctaattttcaacgcaggagtttttcaagctgaattcgaatacacagttgatggttttgaaaaacacattggtgttaatcattttgggcatttttatttatatcaactcttggaatcaaaacttcaaaaacaagattttcattctcgtgttgttgtggttgcaagtcttgctcatcgtcgaggaacaattgaccatgaagatctccattataaaaacaaaagagaaacattcgacggaattgtggcctatggtcattcaaaactcgcaaacatcctcttcgcaagggaagttgctgatagaaataaaacaacaaaagttaatgctttttcacttcatccgggagtgattagaactaatcttgttagaacagaggcaactaaggctcaccctgtaatagctgtgcttgaaacaatgattgataaagatatacctcaaggtgctgcaacgacaatttatgttgctcttgctcctgaacttaatgaggagaaatatcggggattatattttgctgattctgctgttcaagagccaaatactgaggaagcaattgatgcagatggaactggacgtaaaaagctctgggaagtgactgaaaagcaaatccaagacgctcttaaaaacattagttaaattcgtaaatattcttttcgactgaaaacctgaaaaacaataaattttttttcagc

SEQ ID NO: 45382 - protein, 330 aa, Panicum virgatum
  misc_feature: Ceres CLONE 2024819
  misc_feature (32)..(186): Pfam Name: adh_short Pfam Description: short chain dehydrogenase
  misc_feature: SWISSPROT Homolog: EC 1.3.1.33 Protochlorophyllide reductase
MATQAQTPNFTSKTNAKEIVDAFGTGQYLSGKTAVVTGGNVGIGLETVKALASAGARVILASRSIENGVKAIEEEIKKPGHGGYSVTDTSKIVVKQLELGSLKSIKAFAEDLIKTEERIDLLIFNAGVFQAEFEYTVDGFEKHIGVNHFGHFYLYQLLESKLQKQDFHSRVVVVASLAHRRGTIDHEDLHYKNKRETFDGIVAYGHSKLANILFAREVADRNKTTKVNAFSLHPGVIRTNLVRTEATKAHPVIAVLETMIDKDIPQGAATTIYVALAPELNEEKYRGLYFADSAVQEPNTEEAIDADGTGRKKLWEVTEKQIQDALKNIS

SEQ ID NO: 45383 - DNA, 647 bp, Panicum virgatum
  misc_feature: Ceres CLONE 2024838
  misc_feature: Encodes the peptide sequence at SEQ ID NO. 45384
aatgggaagcaagggtcttcagagtgtaatcatgtgtgtgctgatactaggaataatcttggaagtagagggaaagagttgttgcaagaccaccctggcaagaatctgctacaacgtatgtcgtcggaggtttcccccgccagtttgtgcactaggatgtcgctgtaaaatcgtaaaaggcaacaaatgcccgcctggctatcctaaattgaaccttcttccgaactccgcaggtgaaccagctgatgccatttcgtcgtactgcaacttgggatgtgtgtcttctatgtgcgacaacatcagcaatgctccagaatttgtcggcgaagagacgaacatcgacatggaacgttgcagtgatgcatgtgaccgtatttgcaatggggatgccagcatcgcgtccgttgctgcataatcatgcatgtgcatgacatcggatagtacgtgttccacaaaaaggatctcatgggtcagatccaagccagtgtttcatcttatatatgtatacgtgtgctcttttttttctttgttacaataaaggtaaccacacgagggatgccatgttcctacctgtatgtgcccatctctatcgagatgtatccgtgtacccttggccagttaatataattaatcactataaattatat

SEQ ID NO: 45384 - protein, 137 aa, Panicum virgatum
  misc_feature: Ceres CLONE 2024838
  misc_feature (25)..(69): Pfam Name: Thionin Pfam Description: Plant thionin
MGSKGLQSVIMCVLILGIILEVEGKSCCKTTLARICYNVCRRRFPPPVCALGCRCKIVKGNKCPPGYPKLNLLPNSAGEPADAISSYCNLGCVSSMCDNISNAPEFVGEETNIDMERCSDACDRICNGDASIASVAA

SEQ ID NO: 45385 - DNA, 640 bp, Panicum virgatum
  misc_feature: Ceres CLONE 2024842
  misc_feature: Encodes the peptide sequence at SEQ ID NO. 45386
ctcgcacatttaaccctagagaccgctcgagccgtcctccgccgccgctcccactcatcttctcctcgggcgctctccctcccggatccaggatgaagtttgtcgctgcatatctacttgctgtcctcgctgggaaccccagcccttctgcggaggatctgtcggccatactggaatcagttggctgtgaaatcgacagtgaaaagatggagctcctgctgtcccaactgagcggcaaggacattacggagctcattgctgctggcagggagaagttcgcttcagtcccttgcggtggtggtggtgtggctgtcgcggccgctgcaccagctgctggtggcgctgctcctgcagctgaggcgaagaaggaagagaaggtggaggagaaggaagaaagcgatgatgacatgggcttcagcctcttcgactaggcttctgcagtcatcagagctgtctcatttgagtaggaaaaccaagagtcgatgtttggatttgaaccctgttttattttgccaatcaccagaaagacttattatcttgatatgtagtaattcagctgtaggttgctatgttggttgtggtatgcttgtgaaccagagttttcactatcctatatatatatccgatgaattggttgccg

SEQ ID NO: 45386 - protein, 112 aa, Panicum virgatum; identical to SEQ ID NO: 41920
  misc_feature: Ceres CLONE 2024842
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 45387 - DNA, 701 bp, Panicum virgatum
  misc_feature: Ceres CLONE 2024852
  misc_feature: Encodes the peptide sequence at SEQ ID NO. 45388
atcaattctccctcccctcaagcaaggcctcaggcctcaattcgtaatttcgtccatggatgcgagcgagggctccgacccgccggcgaggtgagacgatgagcctcacggcggccttccgagccgcgaaaatcccccgcaccctccctcccaaatgtggcgaggctgccgccgcctctgtgtctggggattcgtcggcgggggccgcgaagtcgaaggcgccgccgccgtggtgcgtgtacctgatagcctcctcccggatcccccgtacctacgtcggcgtcaccaccgacttccctcgccgattgcgacaacataatggtgagttaaaaggtggtgcaaaagctgcctctgctggaaggccttggaatgtcgcatgccttgttgaaggctttgccaacagaagtgaagcttgtgagtttgaatcgaagtggaaaaatatctcccggaaaatggcatggaaaaggactgagcctagtgtggagtcagtgttgcgacatcgacaggcagcattgagcaaagtggaaacctgtatggattgtagccacctacaaatcaaatggaactcaagctgagattatttatttgcactgtgcaggctgcgggcatctaactgtgaaatataactgcttaaccataaattgtataaaataattcccatgttagctcattgtgcagacaatacttagggttgctgccag

SEQ ID NO: 45388 - protein, 158 aa, Panicum virgatum
  misc_feature: Ceres CLONE 2024852
  misc_feature (44)..(126): Pfam Name: GIY-YIG Pfam Description: GIY-YIG catalytic domain
MSLTAAFRAAKIPRTLPPKCGEAAAASVSGDSSAGAAKSKAPPPWCVYLIASSRIPRTYVGVTTDFPRRLRQHNGELKGGAKAASAGRPWNVACLVEGFANRSEACEFESKWKNISRKMAWKRTEPSVESVLRHRQAALSKVETCMDCSHLQIKWNSS

SEQ ID NO: 45389 - DNA, 587 bp, Panicum virgatum
  misc_feature: Ceres CLONE 2024864
  misc_feature: Encodes the peptide sequence at SEQ ID NO. 45390
taattcctttttcccaatttctcgcccttctggctcccccgggggccggaacttaaaaggttgggtttcccctggcattcgattcctccagtcccccctccccacccaaattgatggggggcgaaggggaataaaaaaatatccccctccaaaactccgaacgggaagaatttgagggggaagaagggggccccctggaatcccaaaacctccctcacatgattgaagaacaatggccccaacacgggcttccccttcccaacgttaacttcaagattcttttcaagggaattcaatactggaaccagcaccttcaccccgggggcgccgcgggcgccgggttcaagggccggttccaagaacctgggggaaccctcccccaccaccacgcttccttcggggaaaaacttaagaactgggacccccaattcctccagggcgattcgggcccccttgtccaacttcttttggctggcaactatcttcacattcagggggtgctggaactgacgtggcagaatggtgctgaacttatccagggccagaattctgaagaaattcgccagaacttccaccttaagaaccac

SEQ ID NO: 45390 - protein, 122 aa, Panicum virgatum
  misc_feature: Ceres CLONE 2024864
  misc_feature (64)..(122): Pfam Name: Skp1 Pfam Description: Skp1 family, dimerisation domain
MIEEQWPQHGLPLPNVNFKILFKGIQYWNQHLHPGGAAGAGFKGRFQEPGGTLPHHHASFGEKLKNWDPQFLQGDSGPLVQLLLAGNYLHIQGVLELTWQNGAELIQGQNSEEIRQNFHLKN

SEQ ID NO: 45391 - DNA, 644 bp, Panicum virgatum
  misc_feature: Ceres CLONE 2024873
  misc_feature: Encodes the peptide sequence at SEQ ID NO. 45392
ctttatgccagctgaatggtttgcgcttgcccccgtgcttgatggctctgcctgctgagctgaagactaaggtcttggatcttttacctggggatgatcttgcaagggttgagtgcacttgcaaggaaatgaggaatcttgcagcagatgatagtctttggaagaagtttatagcgaagtacaaaaattatggtgagggttctagaggggccatgagcgcgaaggccatgtttggagaagcttggctggccaataagaggcggcagaagaggccccatccaaccttttggaactatggctggggaaacaatccttatagccgtccacttaggcagccgttgattggtgaggactcagacagactaccttttattggtaatcacggttctgttgggcgtaactttggaaatcaacgaaggaacatcgtgccgaactgcattcttgatggtcaccgccataacttcctttgaagtttctttgggttttcttgtatgccaagagtattttgtaagaaggggtgcgtagacggatagaccgtcttgttaatatcttcaagttgcagacttatgcatgcacagagcacccttgtccttatatatctttttagtatcttagatcctgtcttttctgtttttgtttttatg

SEQ ID NO: 45392 - protein, 155 aa, Panicum virgatum
  misc_feature: Ceres CLONE 2024873
  misc_feature (11)..(58): Pfam Name: F-box Pfam Description: F-box domain
LCQLNGLRLPPCLMALPAELKTKVLDLLPGDDLARVECTCKEMRNLAADDSLWKKFIAKYKNYGEGSRGAMSAKAMFGEAWLANKRRQKRPHPTFWNYGWGNNPYSRPLRQPLIGEDSDRLPFIGNHGSVGRNFGNQRRNIVPNCILDGHRHNFL

SEQ ID NO: 45393 - DNA, 673 bp, Panicum virgatum
  misc_feature: Ceres CLONE 2024874
  misc_feature: Encodes the peptide sequence at SEQ ID NO. 45394
acccgcccattccgcacgaagccgacgagccgccgccgcgcaagagcttacttgtgaggggcttcggaggaaggcagggtagggcgagatgcagatcttcgtgaagactctgacggggaagaccatcaccctcgaggtcgagagcagcgacaccatcgacaatgtcaaggccaagatccaggacaaggaaggcatcccgccggaccagcagcgcctgatcttcgccgggaagcagcttgaggatggccgcacccttgctgactacaacatccagaaggagtccaccctccacctcgtcctccgcctccgcggtggcatcattgaaccctctcttcaggcgctcgcccgcaagtacaaccaggacaagatgatctgccgcaagtgctatgcacgtcttcaccccagggcagtcaactgccgcaagaagaagtgtggccacagcaaccagctgaggcccaagaagaagatcaagaactgagtcatggcgtatcggttccatgggtcgtccggatcaactagagggtcggagttttaagtttttgctgccgcataatactgcctctgttttgagtcagaacttagtggtctttctgttcagggtcttcagcatctatttgctggcataaatttgtgacagaaatttgggtttatattatatggtagattaactctg

SEQ ID NO: 45394 - protein, 129 aa, Panicum virgatum; identical to SEQ ID NO: 41506
  misc_feature: Ceres CLONE 2024874
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: SWISSPROT Homolog: EC 3.1.2.15 Ubiquitin thiolesterase
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time

SEQ ID NO: 45395 - DNA, 660 bp, Panicum virgatum
  misc_feature: Ceres CLONE 2024875
  misc_feature: Encodes the peptide sequence at SEQ ID NO. 45396
ggaccccgatttgtttcgttccccatcctcgcggccgctccatcgccgccgccgccgccgccgccctccgctccggtcgccgaagtccccgattcagatccagggcccgagagatggacgcgagcaggcgccagagcgggatccagcagctgctggccgcggagcaggaggcgcagcagatcgtcaatgcggctagggctgctaagtcggcaaggcttaagcaagcgaaagaggaggctgagagggaaatagctgaataccgtaaacagatggaggctgaattccagaggaaggttgcagagagcagcggtgactctggtgcaaatgtcaagcgtctcgagctggagacggcggcgaagatcgaacagctcaaccaacaggctgcaagcatctccccagaagtcatccagatgcttctgaggcatgtcaccaccgtgaagaactgagccttgctgtgcctgaaaatatgattggaagcttgtatcatctgtccatttattatttcggagagcgtggtgagaaataatttgacttatggctgtaattccttgaccacggaacggaataagctgctgcagtagagcagcaaccgtactggtactgtcagatcttgccttgtttggtatattggtaaatattttcttcatgttcaaattttgt

SEQ ID NO: 45396 - protein, 110 aa, Panicum virgatum; identical to SEQ ID NO: 28693
  misc_feature: Ceres CLONE 2024875
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase

SEQ ID NO: 45397 - DNA, 681 bp, Panicum virgatum
  misc_feature: Ceres CLONE 2024878
  misc_feature: Encodes the peptide sequence at SEQ ID NO. 45398
aagacatcgatcagatcgatagagtagctcttgcctcgctcggttccgtgtcaccccatctcctgtagctcaaaagcaaacgagcaggttgcaagaaagtagttgagcgagtctctctgcttgtcctgccatctagctagctagtgtgtgctagtagcttgtccggccatctagctagtgtgagcagggaggtagctagggatcgatggggctgagggagattgagtccacattgccgccggggttcaggttctaccccagcgacgaggagctggtctgccactacctctacaagaaggtgaccaacgagcgcgccgcgcaggggacgctggtcgaggtcgacctgcacgcgcgcgagccgtgggagcttccagacgcggccaagctgacggcgagcgagtggtacttcttcagcttccgggaccgcaagtacgcgacggggtcgcgcacgaaccgcgccaccaagacgggctactggaaggccaccggcaaggaccgcgaggtgcgccgccccggcccggcggcggcgtcgcgcgccgtcgtcggcatgaggaagacgctcgtcttctaccagggccgcgcccccaacggcgtcaagtcctgctgggtcatgcacgagttccgcctcgactcgccgcagacgccgcccaaggaggactgggtgctctgcagggtgttcca

SEQ ID NO: 45398 - protein, 158 aa, Panicum virgatum
  misc_feature: Ceres CLONE 2024878
  misc_feature (10)..(142): Pfam Name: NAM Pfam Description: No apical meristem (NAM) protein
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 476 in the 10/666,642 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Functional homolog of the protein sequence given in SEQ ID NO 51050
  misc_feature: Useful for making plants with altered lignin content
  misc_feature: Functional homolog of the protein sequence given in SEQ ID NO 50639
  misc_feature: Useful for making plants with altered terpenoid content
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Functional homolog of the protein sequence given in SEQ ID NO 50327
  misc_feature: Useful for making plants with modulated light quality sensitivity
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Functional homolog of the protein sequence given in SEQ ID NO 50732
  misc_feature: Useful for biocontainment applications
  misc_feature: Useful for making plants with altered cell wall content and/or composition
  misc_feature: Useful for making plants with modulated biomass
  misc_feature: The sequence is a functional homolog of SEQ ID NO 1729 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Functional homolog of the protein sequence given in SEQ ID NO 50907
  misc_feature: Useful for making plants with altered carbohydrate content
  misc_feature: The sequence is a functional homolog of SEQ ID NO 853 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 854 in the 10/374,780 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 612 in the 11/435,388 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 854 in the 11/435,388 US patent application
  misc_feature: The sequence is a functional homolog of SEQ ID NO 890 in the 10/374,780 US patent application
  misc_feature: The sequence is a functional homolog of SEQ ID NO 344 in the 10/666,642 US patent application
  misc_feature: The sequence is a functional homolog of SEQ ID NO 1012 in the 11/435,388 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
MGLREIESTLPPGFRFYPSDEELVCHYLYKKVTNERAAQGTLVEVDLHAREPWELPDAAKLTASEWYFFSFRDRKYATGSRTNRATKTGYWKATGKDREVRRPGPAAASRAVVGMRKTLVFYQGRAPNGVKSCWVMHEFRLDSPQTPPKEDWVLCRVF

SEQ ID NO: 45399 - DNA, 420 bp, Panicum virgatum
  misc_feature: Ceres CLONE 2024879
  misc_feature: Encodes the peptide sequence at SEQ ID NO. 45400
tgaagatcgatcttttttaaaagcggatttctccctaaaatatcatcatcgtctttgtgaaagtatggaattctcaccaagagctgcggaacttacgactctattagaaagtagaatgaccaacttttacacgaattttcaagtggatgagatcggtcgagtggtctcagttggagatgggattgcacgtgtttacggattgaacgagattcaagcaggagaaatggtggaatttgccagcggtgtgaaaggaatagccttgaatcttgagaatgagaatgtaggtattgttgtctttggtagtgataccgctattaaagaaggagatcttgtcaagcgcactggatctattgtggatgttcctgcgggaaaggccatgttaggccgtgtggtcgacgccttgggagtacctattgatgg

SEQ ID NO: 45400 - protein, 118 aa, Panicum virgatum
  misc_feature: Ceres CLONE 2024879
  misc_feature (26)..(94): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MEFSPRAAELTTLLESRMTNFYTNFQVDEIGRVVSVGDGIARVYGLNEIQAGEMVEFASGVKGIALNLENENVGIVVFGSDTAIKEGDLVKRTGSIVDVPAGKAMLGRVVDALGVPID

SEQ ID NO: 45401 - DNA, 912 bp, Panicum virgatum
  misc_feature: Ceres CLONE 2024880
  misc_feature: Encodes the peptide sequence at SEQ ID NO. 45402
ctctttccctgcacatacaactatgtctcgtgttccttcagttctcaaccccaccgaggaggatatccaactccttttgagtgctcaatgccacattggtaccaagaatgccaacacccgtatggctccttatatccacaagcgtcgtgctgatggtatcaacttgatcaacatcggtaagacctgggagaagctcatcttggctgctcgtatcattgcttccatcgagaaccctcaagacatcgttgttgtctctgctcgtccttacggtcaccgtgccgctcttaagttcgccagatacattggtgctgaagctattgttggtcgttatactcctggtactttcaccaattacatcacccgttctttccgtgaacctcgtttggttatctgtaccgatcctcgttctgatttccaagctatcctcgaagcttcttacgttaacgtccccgttatctctcttgccgatactgatgcttccctcaagttcgttgatgttgctatccccaccaacaacaaggccaagcacgctattggtttgatctactggctcttggctcgtgccgtcctccgtctccgtggtactctcgactacgagaccgcttgggacgtcatggtcgatatgttcttctaccgtgatcctgaggagatcgagaaggagaacgctgaagccgaggttgaggagggtgactttgccaccactgaagctgccactggtgaatgggctgttgaaggtgaggccactgaaggtgttgctggtattgctgccgctgccgactggtccgctcaacgtaccaccgactgggctgatgagactgaagctcccgccaactcttcttgggaagcttaaatataatcagcttgtttttttctcatagaaataaaaaaagtttttatatgatactttttatc

SEQ ID NO: 45402 - protein, 275 aa, Panicum virgatum
  misc_feature: Ceres CLONE 2024880
  misc_feature (18)..(186): Pfam Name: Ribosomal_S2 Pfam Description: Ribosomal protein S2
MSRVPSVLNPTEEDIQLLLSAQCHIGTKNANTRMAPYIHKRRADGINLINIGKTWEKLILAARIIASIENPQDIVVVSARPYGHRAALKFARYIGAEAIVGRYTPGTFTNYITRSFREPRLVICTDPRSDFQAILEASYVNVPVISLADTDASLKFVDVAIPTNNKAKHAIGLIYWLLARAVLRLRGTLDYETAWDVMVDMFFYRDPEEIEKENAEAEVEEGDFATTEAATGEWAVEGEATEGVAGIAAAADWSAQRTTDWADETEAPANSSWEA

SEQ ID NO: 45403 - DNA, 652 bp, Panicum virgatum
  misc_feature: Ceres CLONE 2024883
  misc_feature: Encodes the peptide sequence at SEQ ID NO. 45404
aaaaaaaaaaaaaaaaaaaaatagcctccccaactcactccgttcgccgtcccggccgccgcacgctcctcctctcgccttcgtccaccgccgccgcggcgccgcctccctccctcccctggccgccaccccaggttgttgcggcgcggaggcccatcccgtctacccggagttggatcggctgctcgagttgccgtgaacacttcaaaccagggaatggcaatgtcttggacaagaggattaaagtatgttgttgttccaaggcatgcggctcaactggtagagagtagaggtcttgccattgcaagcaaggcaaaaaagggtggaaaaggtggcgcagctgatgccgctaaaactccggcactcagcaaagagcttaagagtacaacagtgtttggggcaaacatcctcaaggagggttctgatccgaaaattcaaccagactctgagtatcccgagtggctgtggcacctgctcgacaagcgtcctgtgctaagtgagctgcggaggagagatcccaagacacttccttacgaagacctgaagcgttttgtcaagttggataaccgatctcggatcaaggaaaacaatgctctcactgctaagaactgacctggagagtctcatcaagaaacaggggctgttattttgt

SEQ ID NO: 45404 - protein, 131 aa, Panicum virgatum
  misc_feature: Ceres CLONE 2024883
  misc_feature (22)..(130): Pfam Name: Ribosomal_L37 Pfam Description: Mitochondrial ribosomal protein L37
MAMSWTRGLKYVVVPRHAAQLVESRGLAIASKAKKGGKGGAADAAKTPALSKELKSTTVFGANILKEGSDPKIQPDSEYPEWLWHLLDKRPVLSELRRRDPKTLPYEDLKRFVKLDNRSRIKENNALTAKN

SEQ ID NO: 45405 - DNA, 507 bp, Panicum virgatum
  misc_feature: Ceres CLONE 2024886
  misc_feature: Encodes the peptide sequence at SEQ ID NO. 45406
aagaacaccaaggccgagcagctcgaggcggcccagcagtacgccgagaaggtgctcgccaccctcggcgaagccaccaccgagaaggttcacgtgggccagctcgacgtcggctccaacgtcatcgcgctgaccaacgccatcaaggccatccgcgccaagcacccgcacctggccgtgctcctcctcagccccgaggaggtcaagggcaagggcaagatcaccatcgtcagccaggtctccgacgagctcgtcgcggccggactcaaggcgaacgagtgggccggtgctgtcgccgcggtcctcggcggcaagggtggcggcaagccgcagaccgcccagggctccggatcggacctgaccaaggtggaggacgccctcgccctcgcgcgctctttcgtcggcaaggccctccagtgaggcatgattgagatccgacaacatgtttttaactcccattcaatccccccccccatcggatcgatcaacaataaaacctaaacacgg

SEQ ID NO: 45406 - protein, 139 aa, Panicum virgatum
  misc_feature: Ceres CLONE 2024886
  misc_feature (57)..(132): Pfam Name: DHHA1 Pfam Description: DHHA1 domain
  misc_feature: SWISSPROT Homolog: EC 6.1.1.7 Alanine--tRNA ligase
KNTKAEQLEAAQQYAEKVLATLGEATTEKVHVGQLDVGSNVIALTNAIKAIRAKHPHLAVLLLSPEEVKGKGKITIVSQVSDELVAAGLKANEWAGAVAAVLGGKGGGKPQTAQGSGSDLTKVEDALALARSFVGKALQ

SEQ ID NO: 45407 - DNA, 693 bp, Panicum virgatum
  misc_feature: Ceres CLONE 2024909
  misc_feature: Encodes the peptide sequence at SEQ ID NO. 45408
ccacctcgcccacacccacacgaaccccctcctcgacatctccgccgtcgtcgacgacgccttcctcacgaagtatgacatcaagctcaacaatgccattctggccgaggagaagcacttgcctatgtatgatgagttggccagcaagagcaaagttgaatatattgccggaggagccacccagaactctatcagggttgcccaatggatgcttcaaactcctggtgcaacgagttacatgggatgcatcggaaaggacaaatttggtgaggagatgaagaagaatgctcaagctgcaggagttactgctcactactatgaggatgagactgctcctacaggcacatgtgctgtatgtgttgttggcggtgaaaggtcattgattgcaaatctgtcggcggcaaactgttacaaatctgagcatctaaagagaccagagaactgggcactagttgagaaggcaaaatacatctacattgctgggtttttccttaccgtgtcgcccgaatctattcagctagttgctgagcatgctgctgcaaacagcaaggtgttcctgatgaacctttctgctcccttcatctgtgagtttttccgtgatgcccaagagaaggttctcccgtatgttgactacatcttcggaaacgaaactgaggcaaagatcttcgccaaagtccgtggatgggagactga

SEQ ID NO: 45408 - protein, 230 aa, Panicum virgatum
  misc_feature: Ceres CLONE 2024909
  misc_feature: SWISSPROT Homolog: EC 2.7.1.20 Adenosine kinase
HLAHTHTNPLLDISAVVDDAFLTKYDIKLNNAILAEEKHLPMYDELASKSKVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPESIQLVAEHAAANSKVFLMNLSAPFICEFFRDAQEKVLPYVDYIFGNETEAKIFAKVRGWET

SEQ ID NO: 45409 - DNA, 884 bp, Panicum virgatum
  misc_feature: Ceres CLONE 2024916
  misc_feature: Encodes the peptide sequence at SEQ ID NO. 45410
tgggcaccttgtgatttttaacacagatgcaaaacatctttcgtcagagctcaaggttagccactccacgttatggaatgagatttgttcattctaaaacaccagccaaaaatccattctttgctagggtacttgatccaacaaatgccaaagtctgtgtagttgtaggtgttggtcctggcgttggtgcatctgttgctaaaaaatttgccgctgaaggttattatgttgctatgattgctagaactgaagattaccttcgttcaacccaccgtgaaatcagcgaaatgggaaaagattcaatttatttttcttgtgacatgagtgaccctgaagaagtcaaaaaagcctttgttagaataaactttcaattgggcatacctcattgtttagtttacacagcaaatgttaatgttaaagatcatattacagatttaaaaacaactgattacgactctggtattcaaggaaatattggtgcagctgtatggtcaacaaaagaatgctcgacccatatgcttactctcggccgaggaaccatcatttacactggaaatgatctgtcaacaagaggaatcgagcttcaaacagtcggttccattggtaaatttggcttgagaggatttgctcaaacaatttctcgtgagttaggaaagaaaggattacacattgcacatgttgttattgatagtgttgtaaataatccagacacagatcatagaagaccaaacacaaaatcagaagaactaattgatccggataaagttgctgaatctatcttctacatacataaccagaaaaaatcaagtgggtggatacatgaacttgatcttaggaccaacattgaaaggtggtaacaattcagtaaaatcatttttacttgt

SEQ ID NO: 45410 - protein, 276 aa, Panicum virgatum
  misc_feature: Ceres CLONE 2024916
  misc_feature (42)..(209): Pfam Name: adh_short Pfam Description: short chain dehydrogenase
  misc_feature: SWISSPROT Homolog: EC 1.1.1.140 Sorbitol-6-phosphate 2-dehydrogenase
MQNIFRQSSRLATPRYGMRFVHSKTPAKNPFFARVLDPTNAKVCVVVGVGPGVGASVAKKFAAEGYYVAMIARTEDYLRSTHREISEMGKDSIYFSCDMSDPEEVKKAFVRINFQLGIPHCLVYTANVNVKDHITDLKTTDYDSGIQGNIGAAVWSTKECSTHMLTLGRGTIIYTGNDLSTRGIELQTVGSIGKFGLRGFAQTISRELGKKGLHIAHVVIDSVVNNPDTDHRRPNTKSEELIDPDKVAESIFYIHNQKKSSGWIHELDLRTNIERW

SEQ ID NO: 45411 - DNA, 657 bp, Panicum virgatum
  misc_feature: Ceres CLONE 2024918
  misc_feature: Encodes the peptide sequence at SEQ ID NO. 45412
gggtcgcagtgaccaggcccgggcgactgtttaccaaaaacacaggtctccgcaaagtcgtaagaccatgtatgggggctgacgcctgcccagtgccggaaggtcaaggaagttggtgaactgatgacagggaagccggcgaccgaagccccggtgaacggcggccgtaacaataacggtcctaaggtagcgaaattccttgtcgggtaagttccgacccgcacgaaaggcgtaacgatctgggcactgtctcggagagaggctcggtgaaataaggaggagcagattccttcctcccttcccccccacccctacccctcctcgtcgaaaccctagccccgcctcgccgccggcggtggtggccgcctgtccaacgcccagccctggttgttcgctgcacatactctcccccccaccgcgcgctgcctcccggagccgtcgcgaccgccgccggatccggatcggccggccgccatgtccaaggccagggtctacaccgacgtcaacgtgctgcgccccaaggagtactgggactacgaggcgctcaccgtccaatggggtgagcaggatgactatgaagttgtcaggaaagttggtagaggaaagtacagcgaagtctttgagggcatcaatgttaacaacaatgagaaatgcatc

SEQ ID NO: 45412 - protein, 60 aa, Panicum virgatum
  misc_feature: Ceres CLONE 2024918
  misc_feature: SWISSPROT Homolog: EC 2.7.11.1 Non-specific serine/threonine protein kinase
  misc_feature: Functional homolog of the protein sequence given in SEQ ID NO 50314
  misc_feature: Useful for making plants with modulated flowering time
  misc_feature: The sequence is a functional homolog of SEQ ID NO 1 in US patent 7038110
MSKARVYTDVNVLRPKEYWDYEALTVQWGEQDDYEVVRKVGRGKYSEVFEGINVNNNEKC

SEQ ID NO: 45413 - DNA, 647 bp, Panicum virgatum
  misc_feature: Ceres CLONE 2024925
  misc_feature: Encodes the peptide sequence at SEQ ID NO. 45414
agctatcgcgaatcccgtgattgatcgcagattcacagtaacccgagctagaggcccagagcctagcggtagctcgagaaagagcaaccagccagcaaacatgcaggccgggaagagcgcgatggaggcgaccaaggaggccgcgacgaacctgggcgcgtcggcgaacgccggcatgcagaagacccgcgccaccgtgcaaggccaggtggagaaggccacggcgcacaacgcgtcggacaaggccgcggcggaggcgacccagcgggagcgtgtgcgcgacgcggaggaggagaagcaggccgccatgcgcgcgcacgcggccgccaaggagcgtgccgccggcgcgcacccgtcgcagggcgcgccgggcatcgtggacgacgcccgccagcagggccacggggctgcccccgcgggtgggcacgtcgaggccggcgtcggcgagaccaggcccatcgcgaggggcaccggtacgacgcggcccagcgcggcgcacaacccgcacgtcgggagcgacttctcccagccgcgcggcaccggcgggcagtaccagtgagctcaggctcaggcgcttaactatgttgtgtgtacacgtattcattccgtatgcgtgtgcgtgttctatcatcagcatatgacatacg

SEQ ID NO: 45414 - protein, 152 aa, Panicum virgatum
  misc_feature: Ceres CLONE 2024925
  misc_feature (8)..(80): Pfam Name: LEA_1 Pfam Description: Late embryogenesis abundant (LEA) group 1
MQAGKSAMEATKEAATNLGASANAGMQKTRATVQGQVEKATAHNASDKAAAEATQRERVRDAEEEKQAAMRAHAAAKERAAGAHPSQGAPGIVDDARQQGHGAAPAGGHVEAGVGETRPIARGTGTTRPSAAHNPHVGSDFSQPRGTGGQYQ

SEQ ID NO: 45415 - DNA, 973 bp, Panicum virgatum
  misc_feature: Ceres CLONE 2024929
  misc_feature: Encodes the peptide sequence at SEQ ID NO. 45416
tttcattccgcctccccagatcgatcaccacccggccggagagcgagtgggatcacacgcccacaggggccagcgcctgacctgattgcgccgcgcactagcttcggctggctggttttaaggcgcgcgacggccgccctcggcatgcgccgtcctgctcgcccgggaaatggcgcccgcagctgcagcttcgaccctctccgccacctccgccggcgccgccgatgcttccaagcgtccgcccgcttccgacgctgagccgaccggctcccccgtgctccgccacctgcaggtcagccatgaggacggcgacgaggccgcgcgcaaggctggcctgggccaccagcagctcccgaggcagcagcagcagctcgagtgcccgcgctgccactccaccaacaccaagttctgctactacaacaactacagcacggcgcagccgcgccacttctgccgcgcctgccgccgctactggacgcacggcggcacgctgcgggacgtgcccgtcggcggcgcctcccgccgcgccgccaagcgccgcagggtcgacgacgcccagccctcgccgccgcagaccacggcgcgcgcggaggacgcctaccgcctcatgcaggacctctcggccttcccgtgcctcagcgacggcagcttcctgccgcagctcgacctcggcgctgccccggcgccgacgttctcgtcgtggcagcactcggtcgtcccggacttttacgacgggctcgcgccgtgggacggcgggacggctggcgtgacgggcgcgtgggatgacatcgccggcctcgagctcagctggccccctccggggaactgatcatggcagccgggcgccgttgtgaggctccggttttagcagtgcggcctcatcaggttcaggtagtgcttccgagttcctagtatgcagtgccagcatgttttgatgagctattcagctaccaatgcaagcggctcaattccc

SEQ ID NO: 45416 - protein, 219 aa, Panicum virgatum
  misc_feature: Ceres CLONE 2024929
  misc_feature (63)..(125): Pfam Name: zf-Dof Pfam Description: Dof domain, zinc finger
MAPAAAASTLSATSAGAADASKRPPASDAEPTGSPVLRHLQVSHEDGDEAARKAGLGHQQLPRQQQQLECPRCHSTNTKFCYYNNYSTAQPRHFCRACRRYWTHGGTLRDVPVGGASRRAAKRRRVDDAQPSPPQTTARAEDAYRLMQDLSAFPCLSDGSFLPQLDLGAAPAPTFSSWQHSVVPDFYDGLAPWDGGTAGVTGAWDDIAGLELSWPPPGN

SEQ ID NO: 45417 - DNA, 665 bp, Panicum virgatum
  misc_feature: Ceres CLONE 2024945
  misc_feature: Encodes the peptide sequence at SEQ ID NO. 45418
gagaacaatctcaggttcctccctcccccattcgcgtgccttcggtttctcgatgtttgcctgttcgttcgtcagatcaaccaatccttcgcatccgatttgcgtctccttttctatctggaattgggtcaagagatctggttgcttaaacacgattaagaattagatataagatatttataggttacttgttccgatctgatctgttatagcgacgccgtgtggcggattcaggaggcgggtgcagatctgtctggttatgctgcggatttgctgcgcgtctcccctaacctgttgctgactgtatggcgcggtgtgtgattttgacaggtttcgttggtgatggcgagctcagggttctcgtggacgctgccggaccacccgaagctccccaaggggaagccggtggccgtcgtcgtgctggacggatggggcgaggccaacgccgaccagtacaattgcatccatgtcgctcagacgcccgtcatggattccctcaagaatggtgctccagagaggtggagactcgtgaaggctcatggaactgctgtgggtctcccatctgatgatgatatgggcaacagtgaagttggccacaatgctcttggagctggtcgcattttcgcccaaggcgctaagctcgtggaccaagctcttgcctccgg

SEQ ID NO: 45418 - protein, 107 aa, Panicum virgatum
  misc_feature: Ceres CLONE 2024945
  misc_feature: SWISSPROT Homolog: EC 5.4.2.1 Phosphoglycerate mutase
MASSGFSWTLPDHPKLPKGKPVAVVVLDGWGEANADQYNCIHVAQTPVMDSLKNGAPERWRLVKAHGTAVGLPSDDDMGNSEVGHNALGAGRIFAQGAKLVDQALAS

SEQ ID NO: 45419 - DNA, 686 bp, Panicum virgatum
  misc_feature: Ceres CLONE 2024956
  misc_feature: Encodes the peptide sequence at SEQ ID NO. 45420
ggggagaagtcgtctggtgctgttcctttcaccacgatgtttgccttggttctcctttggtttggtatctctgttcctcttgtatttgttggtagctatctgggcttcaagcaacctgccattgaggctccagtgaagactaacaagatcccaagacaggtccctgagcaggcttggtacatgaaccctgccttcaccattcttattggtggcattcttccatttggggcagtcttcattgagctcttcttcatcctcacgtcaatttggcttcaccagttctactacatctttggcttccttttcctggtgttcattatcctcatcatcacctgtgctgagattacgatcgtgctgtgctatttccaactgtgcagtgaggactataactggtggtggaggtcctatctcacctcgggatcatctgcaatctacctcttcctgtatgccgggttctacttcttcacaaagctgcagatcaccaaactggtgtcaggcatactgtactttggctacatgcttctggcctcgtttgcgttctgtgtgctcaccggtacaatcgggttctgcgcctgcttctggttcacgagattgatatactcatctgtgaagatcgactaggtttgctgacatgagactgcagagagtttgctgtgcggttatcatgaaaactgtattttaggtgt

SEQ ID NO: 45420 - protein, 206 aa, Panicum virgatum
  misc_feature: Ceres CLONE 2024956
  misc_feature (1)..(164): Pfam Name: EMP70 Pfam Description: Endomembrane protein 70
  misc_feature: Functional homolog of the protein sequence given in SEQ ID NO 50367
  misc_feature: Useful for making plants with altered cell wall content and/or composition
GEKSSGAVPFTTMFALVLLWFGISVPLVFVGSYLGFKQPAIEAPVKTNKIPRQVPEQAWYMNPAFTILIGGILPFGAVFIELFFILTSIWLHQFYYIFGFLFLVFIILIITCAEITIVLCYFQLCSEDYNWWWRSYLTSGSSAIYLFLYAGFYFFTKLQITKLVSGILYFGYMLLASFAFCVLTGTIGFCACFWFTRLIYSSVKID

SEQ ID NO: 45421 - DNA, 683 bp, Panicum virgatum
  misc_feature: Ceres CLONE 2024970
  misc_feature: Encodes the peptide sequence at SEQ ID NO. 45422
aatgcagcaacctatgccaatgggtggtcagcaacagatgttccctagaggtgggcgtggctaccgctatcccactggtcgcggaatgcctgatcctggcatgcatggtgttggggctgtgataccagctccatacgagatgggtgggatgccaattagagatgctggcgtgtcacaacctgttccaattggagcactagccactgcgcttgccaacgccccaccggatcagcagaggctgatgcttggtgagaacctgtatcctctagttgatcagctggagcatgagcaggctgccaaggtgactggcatgcttttggagatggaccagacggaggtcctgcacctgctggagtcgccagatgcgctcaaggccaaggttgctgaagccatggaggtcctccgctccgcccagcatctccagcagacctccccggagcagcagctggctaatctgtccctgaacgatggcgtcgtctccagctgaatgtgtccgatgacttgatcggaggctgctggcaatttttgcttatacttatcctatctagagtgcaatgacttggtttgctttgtttattggagttttagcttgctctataattagctgaactagggttggtctagttttgtcctggattggttgttttgatcgtatggatatgttgtttcgttgtcgggttgtc

SEQ ID NO: 45422 - protein, 155 aa, Panicum virgatum
  misc_feature: Ceres CLONE 2024970
  misc_feature (57)..(128): Pfam Name: PABP Pfam Description: Poly-adenylate binding protein, unique domain
MGGQQQMFPRGGRGYRYPTGRGMPDPGMHGVGAVIPAPYEMGGMPIRDAGVSQPVPIGALATALANAPPDQQRLMLGENLYPLVDQLEHEQAAKVTGMLLEMDQTEVLHLLESPDALKAKVAEAMEVLRSAQHLQQTSPEQQLANLSLNDGVVSS

SEQ ID NO: 45423 - DNA, 694 bp, Panicum virgatum
  misc_feature: Ceres CLONE 2024983
  misc_feature: Encodes the peptide sequence at SEQ ID NO. 45424
actacacccccgcttcatccatctccttccttcttcctcaaagtcgtgacgtcagcagccatggtgacggcctaccccacggtgagcgaggactacctcaaggcggtcgagaaggccaagcgcaagctccgcggcctcatcgccgagaagaactgcgccccactcatgctccgcctcgcctggcactccgcaggcaccttcgatgtcgccaccaagaccggggggcccttcggcaccatgaagaaccccgctgagcaggcgcacggagccaacgccggtctcgacatcgccgtcaggctgctcgagcccatcaaggagcagttccccatcctatcctacgctgatttctaccaggagtcgtggccgttgaggtcaccggcggccctgaggtcccctttcacccagggaggcaggacaagcctgagcctccaccggaaggccgccttcctgatgccacccaagggaagatgccacaaggataggtctggctttgagggagcctggacttccaaccctttgatctttgacaactcttacttcaaggagcttcttagtggtgagaaggaaggccttctgcagctgccaagtgacaaagcactcctctctgacccatccttccgcccgcttgttgagaaatatgcagcggatgaggacgccttctttgctgactatgctgaggcccacctgaagcttt

SEQ ID NO: 45424 - protein, 211 aa, Panicum virgatum
  misc_feature: Ceres CLONE 2024983
  misc_feature (19)..(196): Pfam Name: peroxidase Pfam Description: Peroxidase
  misc_feature: SWISSPROT Homolog: EC 1.11.1.11 L-ascorbate peroxidase
MVTAYPTVSEDYLKAVEKAKRKLRGLIAEKNCAPLMLRLAWHSAGTFDVATKTGGPFGTMKNPAEQAHGANAGLDIAVRLLEPIKEQFPILSYADFYQESWPLRSPAALRSPFTQGGRTSLSLHRKAAFLMPPKGRCHKDRSGFEGAWTSNPLIFDNSYFKELLSGEKEGLLQLPSDKALLSDPSFRPLVEKYAADEDAFFADYAEAHLKL

SEQ ID NO: 45425 - DNA, 783 bp, Panicum virgatum
  misc_feature: Ceres CLONE 2024987
  misc_feature: Encodes the peptide sequence at SEQ ID NO. 45426
aacctactccgccgccgccgccgccgccgcgccgtgtctcccttccctgctcgtgcttccatccccgcgaagcaaatccgcctcccttgctccgtcgaaaaagggggtggtgcggatgaaggcggggaggaagaacctgcggcgggcgtgcgatgagggcgccgccgtcacgctcgccgagggcgagagcatcatgcaggtcctcacgctgcgcggctccaacatcatcgaggtgatggacggcgagggcgtcaagtctctggcattgttcccggccaagtttcagaagagcttctggatcaagagcgggagtttcgtggttgtggatgctagtgggagggatcaggccctggaatcagggagcaagattgcgtgtgttgtctcgcaagtcctcttccacgagcaagttcgagctctggacaagtctggtaactggccagctattttcaagtcaataccaaataaaggttcagaggcgggagcacaagcccaaactgcccaggctgatgctggaggacaagcacaaaccgtgcagactgatgagggggcagattctgatgaagatgacgatctgccaccgctagaagcaaacacgaacaggaatagaccgtatgaactgtattctgactcagacagtggttctgattcctaaacaaattagatagtaacatgccattgatgttgtggtattcagtgtctgtttccgaaacaactcaggcttggatgaaatccacttgcaccaaatattcctattatgctgtggcatttgcatgcttttgctct

SEQ ID NO: 45426 - protein, 178 aa, Panicum virgatum
  misc_feature: Ceres CLONE 2024987
  misc_feature (21)..(92): Pfam Name: eIF-1a Pfam Description: Translation initiation factor 1A / IF-1
MKAGRKNLRRACDEGAAVTLAEGESIMQVLTLRGSNIIEVMDGEGVKSLALFPAKFQKSFWIKSGSFVVVDASGRDQALESGSKIACVVSQVLFHEQVRALDKSGNWPAIFKSIPNKGSEAGAQAQTAQADAGGQAQTVQTDEGADSDEDDDLPPLEANTNRNRPYELYSDSDSGSDS

SEQ ID NO: 45427 - DNA, 709 bp, Panicum virgatum
  misc_feature: Ceres CLONE 2024988
  misc_feature: Encodes the peptide sequence at SEQ ID NO. 45428
ctttctcgctcgcgttggtgcatcgctttcctggtcgatttcgtacttttcgaagtcatccacaccctcgcctctcctcttctagccctactccaaacttgccaacatgccccccaagcttgaccccaacgctattgttgagctcatcgtccgcgtgaccggtggtgaggccggaggtgttgcctcgctcgcccccaaggtcggtcctctcggtctgtcccccaagaagatcggtgacgacattgccaagtcgacccaggaatggaagggcatgaagatcactgtcaagctcatcatccagaacagacaggccaaggtcgaggttgttcccagcgctgcctcgctgctgatcaaggccctcaaggagccccctgccccgaccaaccagaagaaggagaagggcgcccctggacccaagcacgatggcaacctcaccttcgatgacgtcatcgaggtggccaagagcatgcgcgccaggagcatggccaggactttcgccggcaccgtcaaggagatgctcggtacctgtgtgtccctcggctgcaccatcgacggcaggggtgcccgcgacatgcagaaggctgttgatgacggtgagttcgatgaccgtcttgctcagttcgactaagtcagagtatctgctacgatcggggggtgtggacaccgccgacgtttaaaatcaaaaataaatctaaaaacaaacagatct

SEQ ID NO: 45428 - protein, 173 aa, Panicum virgatum
  misc_feature: Ceres CLONE 2024988
  misc_feature (12)..(70): Pfam Name: Ribosomal_L11_N Pfam Description: Ribosomal protein L11, N-terminal domain
  misc_feature (73)..(148): Pfam Name: Ribosomal_L11 Pfam Description: Ribosomal protein L11, RNA binding domain
MPPKLDPNAIVELIVRVTGGEAGGVASLAPKVGPLGLSPKKIGDDIAKSTQEWKGMKITVKLIIQNRQAKVEVVPSAASLLIKALKEPPAPTNQKKEKGAPGPKHDGNLTFDDVIEVAKSMRARSMARTFAGTVKEMLGTCVSLGCTIDGRGARDMQKAVDDGEFDDRLAQFD

SEQ ID NO: 45429 - DNA, 751 bp, Panicum virgatum
  misc_feature: Ceres CLONE 2024992
  misc_feature: Encodes the peptide sequence at SEQ ID NO. 45430
aagcccagaccgatctatcccgcttcggcgacatggtctggggcaaggtgaagtcccacccgtggtggccgggccacatctacagcgtcgacctcaccgacgacgcggaggtccacagcggacgccgcgacgggctcgtccttgtcgccttcttcggcgactccagctacggctggttcgatccgcaggagctggtcccattcgaggaccacttcgccgagaaggcggcccagggcggcacctcccgcagcagcttcgccgccgccgtcgcggaagccgtcgacgaggtcgcccgccgcagcgcgcttgcgctgctctgcccgtgtcgggaacccgatgcgttccgtccccaccccagcgacggcagattcttcctggtcgacgtcccgggattcggcaccgacgcagactaccaccccgtgacgcagcgcaacgcggcggaagtcgccgcgcgcaccgtgccgggtatggagatggccgggctgttcatggcgtaccgccgcacagtgtttgcgccgcgcgacgacacctacgccgaggcgttcggggtggatccggagaaggtgcttgaagccgaaaagcaagcggcagctgaccgagctcagcgaggtatcaacactcgcatgcccaatcccagtagttgcgccattaactgttctttttttgtgatgtacttgaattcaatggctagacattgttaccgccgctcttatagatctagcaataattgttttgatgatctgattcaagt

SEQ ID NO: 45430 - protein, 249 aa, Panicum virgatum
  misc_feature: Ceres CLONE 2024992
  misc_feature (7)..(79): Pfam Name: PWWP Pfam Description: PWWP domain
  misc_feature: SWISSPROT Homolog: EC 2.1.1.37 DNA (cytosine-5-)-methyltransferase
AQTDLSRFGDMVWGKVKSHPWWPGHIYSVDLTDDAEVHSGRRDGLVLVAFFGDSSYGWFDPQELVPFEDHFAEKAAQGGTSRSSFAAAVAEAVDEVARRSALALLCPCREPDAFRPHPSDGRFFLVDVPGFGTDADYHPVTQRNAAEVAARTVPGMEMAGLFMAYRRTVFAPRDDTYAEAFGVDPEKVLEAEKQAAADRAQRGINTRMPNPSSCAINCSFFVMYLNSMARHCYRRSYRSSNNCFDDLIQ

SEQ ID NO: 45431 - DNA, 668 bp, Panicum virgatum
  misc_feature: Ceres CLONE 2024996
  misc_feature: Encodes the peptide sequence at SEQ ID NO. 45432
ctccaagggaatgttgatgatatgatggctcaaaggttaggagctgttttcatgcctcatggtcttggccacttacttgggattgacacccatgatccaggaggctaccctgagggattagagagaccaaaggagccaggactgaactctttgcggaccacaagagaactcaaagaaggcatggttattacagtggagccaggctgctatttcatcgacactttgctgactaaagcgaggaatgatccgatttcctcaaattttttcaactggcatgagatcaaaaagtacaaaagctttggtggtgttcggattgaaagtgatgtgtatgtgacggctcaaggatgccggaacctcacaaactgcccccgagagacgtgggaaatcgaggctgtcatggccggcgcgccatggcctccgcgggcttccacttccccagcagcagcagcagcagcagagtcgggtgtctaaagcatcgccttaattttcaacttcattcttcatggtgcccggcgtagattcggtgtactcaataaatagcttgtcaccactggcacgaacttgtttccagtttgatgatcaaataaccatgtcgttaagctggagtattctcagattacaggtaggctattctgttgtgtggtcgaggtgaattgaggaaatgttac

SEQ ID NO: 45432 - protein, 156 aa, Panicum virgatum
  misc_feature: Ceres CLONE 2024996
LQGNVDDMMAQRLGAVFMPHGLGHLLGIDTHDPGGYPEGLERPKEPGLNSLRTTRELKEGMVITVEPGCYFIDTLLTKARNDPISSNFFNWHEIKKYKSFGGVRIESDVYVTAQGCRNLTNCPRETWEIEAVMAGAPWPPRASTSPAAAAAAESGV

SEQ ID NO: 45433 - DNA, 705 bp, Panicum virgatum
  misc_feature: Ceres CLONE 2025011
  misc_feature: Encodes the peptide sequence at SEQ ID NO. 45434
gttccccctccctccctagctccctctccctgccactcccgccgcctctcgccgtcggcgacggcgcacgggctcgttccgccggaattccagtcgagcggcggcgggtaaccctcctgctcgtccccgcctgccctctgctctcctgcgcccgtcaccggccgcgcagatccggtggaagcagccatggatgagtggattcgccaggccgagttgtgggggcgccaggccgaggcctggatccgtcagcagcccccggagcagatctacgtcgcggccgcggtggtcgccctcaccatcctggtgcttgtcgcagcatcttgtctgaaatcctcgaaaccaaacaccatagtgctatctgggcttagtggcagtggcaaaactacactcttctaccagcttcgggatggatcatcacatcaaggaactgtgacttcaatggaagaaaacaatgatacgtttgtgctgcattcggagcaagaaaggaaaggcaaagtaaaacctgtgcatattgttgatgttcctggtcatgcaaggctcaaacccaagcttgatgaagtcctgcctaaagcagctggggttgttttcgttgttgatgctcaagatatcttgtctagcatgcaagcttctgcagagtatctgtatgacattctgacaaaagcaactgtagcgaagaaaaggggttctatgcttatattctgcaac

SEQ ID NO: 45434 - protein, 172 aa, Panicum virgatum
  misc_feature: Ceres CLONE 2025011
  misc_feature (53)..(160): Pfam Name: MMR_HSR1 Pfam Description: GTPase of unknown function
  misc_feature: Functional homolog of the protein sequence given in SEQ ID NO 51666
  misc_feature: Useful for making plants with modulated cold sensitivity
MDEWIRQAELWGRQAEAWIRQQPPEQIYVAAAVVALTILVLVAASCLKSSKPNTIVLSGLSGSGKTTLFYQLRDGSSHQGTVTSMEENNDTFVLHSEQERKGKVKPVHIVDVPGHARLKPKLDEVLPKAAGVVFVVDAQDILSSMQASAEYLYDILTKATVAKKRGSMLIFC

SEQ ID NO: 45435 - DNA, 666 bp, Panicum virgatum
  misc_feature: Ceres CLONE 2025014
  misc_feature: Encodes the peptide sequence at SEQ ID NO. 45436
tcgggtcagatcgggccatcggggggactctgggaggcgaaggccgaaggagctcgcgccgcgatggacgaggaggagcacgaggtgtacggccaggagatcccggaggacggcgacatggacggcgccgacgtcgatatggccgccggcggggacgacgcggcgaagctgcaggagctcgacgagatgaagcgcaggctgaaggagatggaggaggaggctgtcgccctccgcgatatgcaggccaaggtcgccaaggagatgcaaggaggtgaccctagtgcatctacagctgaggcgaaggagcaggtggatgcccgctctgtgtatgttggaaatgttgattatgcgtgtacaccagaagaagtacagcagcacttccaagcttgtggaactgtcaatcgggtgacaatcttgaccgacaagtttgggcagccaaaaggttttgcttatgttgaatttctggaacaagaagctgtccaggaggctcttaatttgaatgaatcagagttgcatggtcgccaaattaaggttgcaccgaagaggactaatgtccctgggatgaagcagcgtccaccacgcgggtataacccgtaccatggctacccatatagatcatacggagcaccatacttccccccatatggttatggggggggctccaag

SEQ ID NO: 45436 - protein, 200 aa, Panicum virgatum
  misc_feature: Ceres CLONE 2025014
  misc_feature (88)..(157): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDEEEHEVYGQEIPEDGDMDGADVDMAAGGDDAAKLQELDEMKRRLKEMEEEAVALRDMQAKVAKEMQGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGGGS

SEQ ID NO: 45437 - DNA, 680 bp, Panicum virgatum
  misc_feature: Ceres CLONE 2025019
  misc_feature: Encodes the peptide sequence at SEQ ID NO. 45438
attcagaggcacagcgcacacaagcaaggcggctagctacagacgcggctagtggcgcgagtaaacacagccacgcccagtgcgaagcttgctggtgcatgcggcaatggcggcttcgcttgggctaaaccctgaagctctcttcagctcccactcgtcgtcatactcctcgcccttcatgtccggctacgcgccgcagagattcccggcggccgataacaccgtcgtcgacgacgcggcggccttctcctcagagctcgatgatctttgccagcttgagtactcgccggcaccgctcatcgccggcgccggcggcggggctggggacgatcgcgacgagaagccgatgtggtgtggggggcgagatgagaagagacccaggagcagtggaaggattgggttcagaacgagatcggaggtggagatcttggacgacggattcaaatggaggaagtacgggaagaaagctgtcaagaacagccctaatccaaggaactactaccggtgctcgtcggagggctgcggcgtgaagaaacgcgtggagagggaccgcgacgacccccgctacgtcatcaccacctacgacggcgtccacaaccacgccagccccggcgccgccgccatcatccagtacggcggaggcggcttctacagcccgcagcacagcggctcgccgtcgg

SEQ ID NO: 45438 - protein, 191 aa, Panicum virgatum
  misc_feature: Ceres CLONE 2025019
  misc_feature (108)..(167): Pfam Name: WRKY Pfam Description: WRKY DNA -binding domain
  misc_feature: The sequence is a functional homolog of SEQ ID NO 206 in the 10/714,887 US patent application
  misc_feature: The sequence is a functional homolog of SEQ ID NO 206 in the 11/435,388 US patent application
  misc_feature: The sequence is a functional homolog of SEQ ID NO 148 in the 10/714,887 US patent application
  misc_feature: The sequence is a functional homolog of SEQ ID NO 148 in the 11/435,388 US patent application
  misc_feature: The sequence is a functional homolog of SEQ ID NO 210 in the 10/714,887 US patent application
  misc_feature: The sequence is a functional homolog of SEQ ID NO 210 in the 11/435,388 US patent application
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 158 in the 10/714,887 US patent application
  misc_feature: The sequence is a functional homolog of SEQ ID NO 158 in the 11/435,388 US patent application
  misc_feature: The sequence is a functional homolog of SEQ ID NO 132 in the 10/714,887 US patent application
  misc_feature: The sequence is a functional homolog of SEQ ID NO 132 in the 11/435,388 US patent application
  misc_feature: The sequence is a functional homolog of SEQ ID NO 144 in the 10/714,887 US patent application
  misc_feature: The sequence is a functional homolog of SEQ ID NO 144 in the 11/435,388 US patent application
  misc_feature: The sequence is a functional homolog of SEQ ID NO 1611 in the 10/412,699 US patent application
  misc_feature: The sequence is a functional homolog of SEQ ID NO 971 in the 10/666,642 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MAASLGLNPEALFSSHSSSYSSPFMSGYAPQRFPAADNTVVDDAAAFSSELDDLCQLEYSPAPLIAGAGGGAGDDRDEKPMWCGGRDEKRPRSSGRIGFRTRSEVEILDDGFKWRKYGKKAVKNSPNPRNYYRCSSEGCGVKKRVERDRDDPRYVITTYDGVHNHASPGAAAIIQYGGGGFYSPQHSGSPS

SEQ ID NO: 45439 - DNA, 647 bp, Panicum virgatum
  misc_feature: Ceres CLONE 2025063
  misc_feature: Encodes the peptide sequence at SEQ ID NO. 45440
aacaaaatgaccggtgcttccagaacctacagtaagacatccactgtcccccgtcgtcccttcgagtctgctcgtcttgatcaagaactcaagttgatcggtgagttcggtctcaagaacaagaaggaaatctggagagtcggattgactctttccaagattcgtcgtgctgctcgtgagcttttgaagcttgatgagaaggatcctcgtcgtcttttcgaaggtaacgcccttatccgtcgtcttgtccgtattggtgtccttgatgaatcccgtatgaagctcgattacgttttggccttgaagattgaagatttcttggaacgtcgtcttcaaacccaagtcttcaagttgggtctcgccaagtctatccatcatgcccgtgtcttgatccgtcaacgtcacatccgtgttggtaagcaaatcgtcaacgttccctctttcattgttcgtttggactctcaaaagcacattgatttcgctttgacctctcccctcggtggtggtcgtgctggccgtgtcaagagaaagagagctgctgccggtgctggtggtgatgacgctgaggatgatgaagagtaaatcttttctctccattgcaatcaattcatttatcataaataaattcaatttattcttatggttct

SEQ ID NO: 45440 - protein, 191 aa, Panicum virgatum
  misc_feature: Ceres CLONE 2025063
  misc_feature (5)..(106): Pfam Name: Ribosomal_S4 Pfam Description: Ribosomal protein S4/S9 N-terminal domain
  misc_feature (107)..(154): Pfam Name: S4 Pfam Description: S4 domain
MTGASRTYSKTSTVPRRPFESARLDQELKLIGEFGLKNKKEIWRVGLTLSKIRRAARELLKLDEKDPRRLFEGNALIRRLVRIGVLDESRMKLDYVLALKIEDFLERRLQTQVFKLGLAKSIHHARVLIRQRHIRVGKQIVNVPSFIVRLDSQKHIDFALTSPLGGGRAGRVKRKRAAAGAGGDDAEDDEE

SEQ ID NO: 45441 - DNA, 644 bp, Panicum virgatum
  misc_feature: Ceres CLONE 2025065
  misc_feature: Encodes the peptide sequence at SEQ ID NO. 45442
gtgattttgtcccagctatctatgatacaacagtggtaatccctaaagaatcacctgcaccaacaatgctgcgtgttctcaagggacagtcatcggtagttcatgtccgcataaaacgtcatgcaatgagtgatatgcctaaatccgatgaagatgtttcaaaatggtgcaaggacatatttgtggcaaaggatgcattattggacaagcatatagcaactggtacttttgatgaggaaattagaccgattggtcgtccaataaagtctttgctggtggttctgtcttggtcatgcctcctgctatatggtgcctacagattcttacagtggactcagctcctgtcaacatggaaaggcattatcctctttgttgctggattggggctggtgactggcatcatgcatgtcttcatcatgttctcgcagtcagagcgctcgagctctgccagagcagcgaggaatcgagttaagaaaggttgagggactcccaattcgttgtgcgtgaccaattatgtagacacaagcgtgatgggacaatttttctcagtttttgtgctctttaggaactgaaaaaggtttttcctgtggcaagaattgtcatctccgaccccttcttgtacttgtatgaaaacaatcgtagat

SEQ ID NO: 45442 - protein, 159 aa, Panicum virgatum
  misc_feature: Ceres CLONE 2025065
  misc_feature: SWISSPROT Homolog: EC 2.3.1.51 1-acylglycerol-3-phosphate O-acyltransferase
DFVPAIYDTTVVIPKESPAPTMLRVLKGQSSVVHVRIKRHAMSDMPKSDEDVSKWCKDIFVAKDALLDKHIATGTFDEEIRPIGRPIKSLLVVLSWSCLLLYGAYRFLQWTQLLSTWKGIILFVAGLGLVTGIMHVFIMFSQSERSSSARAARNRVKKG

SEQ ID NO: 45443 - DNA, 1356 bp, Panicum virgatum
  misc_feature: Ceres CLONE 2025067
  misc_feature: Encodes the peptide sequence at SEQ ID NO. 45444
ctcctccccgcgttgaaccattccaccatcctcctcctcctcctcctccgcggctacaaagccccgtacggcccgctccggctcgtcgtcttccccccgcccccggtccccgcgcacatggacgcgtcgtcgggcgaccgctcgtcgccgcgcagccggcagctgcagggcccgcgcccgccgcggctcgccgtcagcaaggactcgcacaaggtcaggaagccgcccgtcgcgccgcagcggcaccaccacctggatcagcagcagcagcaggtcgtccaccaccagcagcagcagcgccagcacccgcaccagtaccagcagcaggcgcggcagccggtcatcatctacgacgcctcgcccaaggtcatccacgccaagccgggggacttcatggcgctcgtccagcgcctcaccggcccgggctccacctcccaggcccaattcgacgccgccgccgcgggcccgtcgtcctccgacgcgccgctgcagcccgcgtccgcgatggagctagagccgcgggaattcctgctctcgcccaccgccgcgctctccccggccgcgcgccttgccgccatcgagcggtccgtgcgcccgctcccgccgcacgcgcacgcgccggctcccgtcccgccctactacggcggcgcggccgacgacgacctcttcctcctccccggcccggcctccgcggacctggacggcttcgcggcgggcttccggcccgggatcctctcgcccgccgctctcccgccggcggcctcgacggggctgttctcgccgatgccgttcgacccgagctgcctgtcgtggctgagcgagctgagcccgttcctcccctccgccggcacccgcgcggagcaggcgccgccgttcgcgcccagcccgcgcagcagcctgctgctggccacgcccaccatgccgtcgccggccaccttctccgtgctcgagttcttcagcagcaacttcgcggaccagtaaatccctgttgatcattaacgacacaccagctcccctgattccattaattgcttcttcgccctcgtccggtgcaattgacgcgagaaatcgtcggaccaccatccgttccgtgccctgacagccgggttaatccgatcacttttaccgtctcggtaatttgggcgatgaacaagaatcaaatcggttgatgagacgagatcaatcgggttccatttatttattcgttctattcttgttataaattattagattttcttttttactcttgtgttggccgggtcagcaagtgtgtgtgagagagcaagttggccttggccagtagtggtagctactgattcattaattaactggctggagtaggaatttttccttgtc

SEQ ID NO: 45444 - protein, 287 aa, Panicum virgatum
  misc_feature: Ceres CLONE 2025067
  misc_feature (78)..(108): Pfam Name: VQ Pfam Description: VQ motif
MDASSGDRSSPRSRQLQGPRPPRLAVSKDSHKVRKPPVAPQRHHHLDQQQQQVVHHQQQQRQHPHQYQQQARQPVIIYDASPKVIHAKPGDFMALVQRLTGPGSTSQAQFDAAAAGPSSSDAPLQPASAMELEPREFLLSPTAALSPAARLAAIERSVRPLPPHAHAPAPVPPYYGGAADDDLFLLPGPASADLDGFAAGFRPGILSPAALPPAASTGLFSPMPFDPSCLSWLSELSPFLPSAGTRAEQAPPFAPSPRSSLLLATPTMPSPATFSVLEFFSSNFADQ

SEQ ID NO: 45445 - DNA, 1553 bp, Panicum virgatum
  misc_feature: Ceres CLONE 2025079
  misc_feature: Encodes the peptide sequence at SEQ ID NO. 45446
atccatcagaccatcacacacctgtccttccatactcccatccgcttcggcaccccagtcacactcgcgccacccgcgatgacgccggcggcgatctccggctccagcggccacctcatcctctcctccctccgcctccggcagccgctcaccctccctccgctcgccgcgcgcccaatcgccgccgcttcgcccgtggcccgccgcggggtcgcggccgccgccgtgtccactcccgccgcgtccgccgccacggggaaagatgtcaaacaggctcctaaggatttccttcatatcaatgattttgacaaggatacgatcatgaatatccttaatcgggcgcttgaggttaagacagcaataaaatctggagacaggagcttccaaccgttcaaagggaaatcaatggcgatgatttttgccaagccatcaatgaggacccgtgtttcatttgagacaggattcttcttacttggtggacatgctatctatttgggtcctgatgatatccaaatgggcaagcgtgaggagactcgtgatgttgctcgagtactctctggctataatgacatcattatggctagggttttcggtcaccaggatattctggacttggcgaagtatgcatctgtacctgtcataaatggtctcactgactataaccatccatgccagataatggctgatgcacttactatgcttgagcacattgatcgtattgaaaacaccaaggttgtctatgttggagatgggaacaatattgtgcactcatggcttctattggctgctgtgctccctttccactttgtatgcgcttgtcctaagggatttgagccagatgcaaagacagtggagatcgccaggagtgctggaatcagtaagattgaaataacaaatgatcccagggaagcagttaagggagcagatgttgtttacacagatgtctgggccagcatgggccaaaaggaagaagctgattatagaaaacagaagttccaaggattcacggtggatgaagccatgatggagattgctggtccacaggcctacctcatgcattgtttacctgcagagagaggggtggaggtgacagacggtgctattgaggctcccaactcaatcgtattccctcaggctgaaaaccggatgcacgctcagaatgccatcatgcttcatgtccttggtgcttaataccccttcggcacaccactattacacctttcttaaattctagggcattactgagggataaaggctgtttcagctttagcgctgaagctctagagtttctttggaggcatgagggtaacgtttttgaaacatgtcagtcactgtattacgatgaattggattgtccagcaacgtgatattttgcttgtctaggtggtagcttgttgtactgtaaaagggtggcaatcttgaataaaaacacaaatttctttggtgccaaatttgcaaatcgtgtaaagattggcgttttgtaacttgtaagaggtccaaaagccttgaacataatctgaaatagcaaaacgctaggcatgtgtgctacgttt

SEQ ID NO: 45446 - protein, 370 aa, Panicum virgatum
  misc_feature: Ceres CLONE 2025079
  misc_feature (214)..(367): Pfam Name: OTCace Pfam Description: Aspartate/ornithine carbamoyltransferase, Asp/Orn binding domain
  misc_feature (68)..(210): Pfam Name: OTCace_N Pfam Description: Aspartate/ornithine carbamoyltransferase, carbamoyl-P binding domain
  misc_feature: SWISSPROT Homolog: EC 2.1.3.3 Ornithine carbamoyltransferase
  misc_feature: Functional homolog of the protein sequence given in SEQ ID NO 50960
  misc_feature: Useful for making plants with modulated nitrogen use efficiency
MTPAAISGSSGHLILSSLRLRQPLTLPPLAARPIAAASPVARRGVAAAAVSTPAASAATGKDVKQAPKDFLHINDFDKDTIMNILNRALEVKTAIKSGDRSFQPFKGKSMAMIFAKPSMRTRVSFETGFFLLGGHAIYLGPDDIQMGKREETRDVARVLSGYNDIIMARVFGHQDILDLAKYASVPVINGLTDYNHPCQIMADALTMLEHIDRIENTKVVYVGDGNNIVHSWLLLAAVLPFHFVCACPKGFEPDAKTVEIARSAGISKIEITNDPREAVKGADVVYTDVWASMGQKEEADYRKQKFQGFTVDEAMMEIAGPQAYLMHCLPAERGVEVTDGAIEAPNSIVFPQAENRMHAQNAIMLHVLGA

SEQ ID NO: 45447 - DNA, 492 bp, Panicum virgatum
  misc_feature: Ceres CLONE 2025083
  misc_feature: Encodes the peptide sequence at SEQ ID NO. 45448
acagccacaccacgcacagagagacgcagcagcagcagggcactacgactcgtactagctagctagctagctactcgtagcagctgctagctgcaggtaaccatggcgaagaagaaaaccgccgtggtcgccacgctcctggccctgaacctcctcttcttcgccttcgccaacgcctgcggctgccagtgcggcgcctgccctagtccaggcggcggcggaaggggaggaggaggaggcagtgggggtggtggatctggcggcgggggaggcagcggtggtggtggcggcggcagcggaggcgggggaggcagcggtggaggcggcagcggcagcggcggaggaggaggaggcagtgggggtggtggatctggcggcgggggaggcagcggtggtggtggcggcagcagcggaagcgggggaggcagcggcggcggcggcggagggagctgcggcggaggaggaggctgtccaggcggcggcggatgaaga

SEQ ID NO: 45448 - protein, 128 aa, Panicum virgatum
  misc_feature: Ceres CLONE 2025083
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50702
  misc_feature: Useful for making plants with altered lignin content
  misc_feature: Functional homolog of the protein sequence given in SEQ ID NO 51707
  misc_feature: Useful for making plants with modulated biomass
MAKKKTAVVATLLALNLLFFAFANACGCQCGACPSPGGGGRGGGGGSGGGGSGGGGGSGGGGGGSGGGGGSGGGGSGSGGGGGGSGGGGSGGGGGSGGGGGSSGSGGGSGGGGGGSCGGGGGCPGGGG

SEQ ID NO: 45449 - DNA, 642 bp, Panicum virgatum
  misc_feature: Ceres CLONE 2025090
  misc_feature: Encodes the peptide sequence at SEQ ID NO. 45450
agatgcgcaaacacctaatcgccggaccggtcgctgccctgctcgccctcgccctcaccctcaccctcaccctcaccctctcgctcacccgcagcgcgcaagaggagccgctcatggccgaccgcgagccgctggctggcggcgtcacggacgcgccgcagaacgacaacgacatccacctccaggagctcgcccgcttcgccgtcgacgagcacaacaagaagaccaatgctctcctggagttcgagaagcttgtgaaggcgaagacgcaagtggttgctggaaccatgtactatctcactgttgaggtgaaggatggggaaaccaagaagctctatgaagctaaggtctgggagaagccatgggagaacttcaaggagctgcaggaattcaagcctgtggaagagagtgctagcgcttaaggatccctcgtcttccacgtgcaattgctgcctgaagcgctaaacagacttgcagaataaggagctggatcggatgtaatagttgtgtcgttgtgagctccgttgtgtaatatcgtatgaacaccttgccctttgtgtaatatcatgaatgacagtgccctttgtgtataactaaataactgcgctgagttttcatcagtacagtcgcgacggaattctc

SEQ ID NO: 45450 - protein, 139 aa, Panicum virgatum
  misc_feature: Ceres CLONE 2025090
  misc_feature (46)..(134): Pfam Name: Cystatin Pfam Description: Cystatin domain
MRKHLIAGPVAALLALALTLTLTLTLSLTRSAQEEPLMADREPLAGGVTDAPQNDNDIHLQELARFAVDEHNKKTNALLEFEKLVKAKTQVVAGTMYYLTVEVKDGETKKLYEAKVWEKPWENFKELQEFKPVEESASA

SEQ ID NO: 45451 - DNA, 676 bp, Panicum virgatum
  misc_feature: Ceres CLONE 2025091
  misc_feature: Encodes the peptide sequence at SEQ ID NO. 45452
aacaaacgctaaaaaagtaacagtttctgtactttattgggttcgatcacacaatggtcaagatcctgtcgtcggagtccctcaagatcccgaagggcgtcaaggtcgaggtcgcgaaccgcgtcgtcaccgtcaccggcccgcgcggcaagctcacgaaggacctgcgccacctcatgctggacttccgcgtcaagaacaagggcacgaacttcaccgtgacccgctggttcggcaagcgcaccgacgtggcgtgcatcaactccgccaaggccgtcgtccgcaacatgatcaacggtgtgaccaagggcttccgcttcaagctccgcttcgcgtacgctcacttccccatcaacgtctccgtggacggccagacggtcgagatccgcaacttcctcggcgagaagcgcgtgcgtcgccagacgctgcccaagtcgatcaaggtgtaccgcacggaccaggcgaaggtgaaggatgagctcgtgctcgagggcaacgacctcatcgaggtgtcccactgcgccgcgcagctccacgagcagtgcctcgtgaagaacaaggatatccgtatgttcctcgacggtatctacgttcagacgaaggagttcgtccaggacgcctgagcccgattgacgactgcgaacccacaaccgcattccgcatctctcccgttttg

SEQ ID NO: 45452 - protein, 189 aa, Panicum virgatum
  misc_feature: Ceres CLONE 2025091
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MVKILSSESLKIPKGVKVEVANRVVTVTGPRGKLTKDLRHLMLDFRVKNKGTNFTVTRWFGKRTDVACINSAKAVVRNMINGVTKGFRFKLRFAYAHFPINVSVDGQTVEIRNFLGEKRVRRQTLPKSIKVYRTDQAKVKDELVLEGNDLIEVSHCAAQLHEQCLVKNKDIRMFLDGIYVQTKEFVQDA

SEQ ID NO: 45453 - DNA, 641 bp, Panicum virgatum
  misc_feature: Ceres CLONE 2025118
  misc_feature: Encodes the peptide sequence at SEQ ID NO. 45454
accagcacttgcttgtcattcccaagcaaacgcgttcatccagcaccggccgcactcagctcgtcaagctaagttcacattcacgcacaatccaagcaatggctcgcgctcatcaggtcgtggctatcgccgtcgtgctgctcgccgccgcggcgaccaccaccgaggccgccgtgacctgcgggcaggtgagctcggccatcgggccctgcatcgcctacgcccgcggcaccggctccggcccctcggcagcctgctgcagcggcgtgaggagcctcaactcggcggccaggagcaccgccgacaggcgcgccgcatgcaactgcctcaagtccgccgccggcagggtgagtggcctcaaccttggaaacgccgcaagcatcccgtccaagtgcggagtcagcatcccctacaccatcagcccaaacgtcgactgctccagggtgagctaaacgacgaccagtaccgtcgctacctatctacttaattatcgtctatgatcgagttcgatgatgatgaataaaaatctctccggcgtcacgtgcactgtcgtcatgcgctagctcatctcgcgtggtacgtcgtcgctcagcatgtgatgagcgatcgagagacggagtcctctccgatccttgtgtcct

SEQ ID NO: 45454 - protein, 117 aa, Panicum virgatum
  misc_feature: Ceres CLONE 2025118
  misc_feature (28)..(113): Pfam Name: Tryp_alpha_amyl Pfam Description: Protease inhibitor/seed storage/LTP family
MARAHQVVAIAVVLLAAAATTTEAAVTCGQVSSAIGPCIAYARGTGSGPSAACCSGVRSLNSAARSTADRRAACNCLKSAAGRVSGLNLGNAASIPSKCGVSIPYTISPNVDCSRVS

SEQ ID NO: 45455 - DNA, 702 bp, Panicum virgatum
  misc_feature: Ceres CLONE 2025125
  misc_feature: Encodes the peptide sequence at SEQ ID NO. 45456
gtcaacaaagaaaccccaccgtgcccaagccccccaaaacctcaaaccacccgcccgcccgccatggcgttccggctgagcaacaacctcatcggcgtcctcaacttcgtcaccttcctgctctccgtcccgatcctgggcgccggcatctggctgggccaccgcgccgacggcaccgagtgcgagcgctacctctccgcgcccgtcatcgccttcggggccttcctcctcgccgtctccctcgcgggcctcgtcggcgcctgctgccgcgtcacctggctgctctgggtctacctcctcgccatgttcgccctcatcgtcgccctcttctgcctcaccgtcttcgccttcgccgtcaccaaccgcggcgccggggaggccgtctccggccgcggctacaaggagtaccgcctcggggactactccaactggctgcagaagcgcgtcgagagcaccaagaactggaacaggatcaggagctgcctccaggactccaaggtctgcaagagcttgcaggacagcagggagacgttcgcggacttcatacgctccgacctctcacccatccaggtatgcatgctgtgtagtatcatttctttaatttttccccctctttttaacatgcatgcatgctcttctttttcttcatcttcagtttcagtttgtgcgtgccaaaaaatcaactcaccaaaagctaataag

SEQ ID NO: 45456 - protein, 212 aa, Panicum virgatum
  misc_feature: Ceres CLONE 2025125
  misc_feature (5)..(204): Pfam Name: Tetraspannin Pfam Description: Tetraspanin family
  misc_feature: Functional homolog of the protein sequence given in SEQ ID NO 50853
  misc_feature: Useful for making plants with modulated nitrogen use efficiency
MAFRLSNNLIGVLNFVTFLLSVPILGAGIWLGHRADGTECERYLSAPVIAFGAFLLAVSLAGLVGACCRVTWLLWVYLLAMFALIVALFCLTVFAFAVTNRGAGEAVSGRGYKEYRLGDYSNWLQKRVESTKNWNRIRSCLQDSKVCKSLQDSRETFADFIRSDLSPIQVCMLCSIISLIFPPLFNMHACSSFSSSSVSVCACQKINSPKAN

SEQ ID NO: 45457 - DNA, 698 bp, Panicum virgatum
  misc_feature: Ceres CLONE 2025134
  misc_feature: Encodes the peptide sequence at SEQ ID NO. 45458
acttgttcaaagtttcaaacatacatacacatacagggaaagagtgtcaggctgaaggctgaagccatggctgctgctcggtgctccccggtggctctcatgctgctactgctggcctgcagcgtcgccgcggacgaggcgctgacgcacctccacttctacttccacgaggtcgacggcggcgcgcccaacgccaccgtcgtcaacgtcgccagcctgcacaggaacgcgtcgacgttcggcgacctgaacgtgttcgacaacgcgctgcgggaggggccggacccggcgtcgcggctcatcggcagggcgcaggggctcgccgtgcacgcgtcgctggacgagtccggcgggctcacggccatcaccttcaccttctccgactacggggagtacagcggcagcacgctggcgacgctggggcacctcaccgcgtcgggcccgtcggagcgcagcatcgtcggcggcaccggcaggctccggttcgcgcgcgggtacatgaccagcagcctcgtcagctccaagggcagctccatcgtcgtcgtcttcgacatgtacttcgccctggctcactgatctctccttgcacttgtgagttcgacacgatcgaacagaaaatgagcaccactttcagatttatatctttgtacaactctggtaattgttcgaataaaacacgtcggcatttgtacggagcc

SEQ ID NO: 45458 - protein, 169 aa, Panicum virgatum
  misc_feature: Ceres CLONE 2025134
  misc_feature (9)..(167): Pfam Name: Dirigent Pfam Description: Dirigent-like protein
MAAARCSPVALMLLLLACSVAADEALTHLHFYFHEVDGGAPNATVVNVASLHRNASTFGDLNVFDNALREGPDPASRLIGRAQGLAVHASLDESGGLTAITFTFSDYGEYSGSTLATLGHLTASGPSERSIVGGTGRLRFARGYMTSSLVSSKGSSIVVVFDMYFALAH

SEQ ID NO: 45459 - DNA, 734 bp, Panicum virgatum
  misc_feature: Ceres CLONE 2025141
  misc_feature: Encodes the peptide sequence at SEQ ID NO. 45460
aactgttcttcttccgcagcaagatagcagaggcgtgttcgcgtagccgtggatcccaactcccaagaaccgtagcagcctgctaccgctctcttcttccccggcaagcagcggcgctcgctgccccctcatatatagataatctaatcgccgcctccttgccaacgccgattcgattagatcgatagagaggggagccgcgaggggacgggatgccgacgctgacgaagctgtacagcatgaaggaggccaccctccacaacacccccgaggactgctgggtcgtcgtcgacggcaagatttatgatgtgaccaagtatttggaagaccatcctgggggtgctgatgttctgctcgaagcaacgggtaaggatgctaaggaagaatttgatgatgcggggcacagcaagagtgccattgagctaatgcaagactacttcattggggagttggacccgactactgagattcctgagatggaggttttcaggaaggagcaggacaccagatttgccagcaagctgatggacagtgcggtgcggtactgggcaatcccagcagctgcagttgggatatcggttgttgttgccgtattgtatgcgcgaaggaagtgaagttcactgtttttgagcaaccattttgagagggatcacccatatttacctggagcatggacggatatatgtcctgctgttcagaaccaaatacactatgaaattcaattcttagacact

SEQ ID NO: 45460 - protein, 133 aa, Panicum virgatum
  misc_feature: Ceres CLONE 2025141
  misc_feature (9)..(81): Pfam Name: Cyt-b5 Pfam Description: Cytochrome b5-like Heme/Steroid binding domain
MPTLTKLYSMKEATLHNTPEDCWVVVDGKIYDVTKYLEDHPGGADVLLEATGKDAKEEFDDAGHSKSAIELMQDYFIGELDPTTEIPEMEVFRKEQDTRFASKLMDSAVRYWAIPAAAVGISVVVAVLYARRK

SEQ ID NO: 45461 - DNA, 828 bp, Panicum virgatum
  misc_feature: Ceres CLONE 2025150
  misc_feature: Encodes the peptide sequence at SEQ ID NO. 45462
atttatcgcctcgcccgccgcactactgccaccgctgcggctgcgtggtagcttctgcctcacctgactgacctccctccccggcgagcatcaccagccagcctctctctgtcccgccgccgcccgccgatccgagagcatggcgcactccctcgccaccgccgccgccgcgtccttctcgccggccgccgcacggcgccaggtgacgaatgttttttcaagccggagttcagtttccttccagagccacaggatgacttctgtgtccattcgttcaagaccaagttctcttcggcttaagatttgctgttcggctaaacaagagacaatcgataaggtttgtagtatagtgaaggagcagctagctctccccgatgggactgctctcagcggcgaatcaaaattcgctgaacttggtgccgattcactggatacggttgagattgttatgggccttgaggaggcattcaacatcactgtcgatgaaacgagcgcacaagacattgcaaccgtgcaggatgcggcggacctcattgagaagcttgtgctcgagaaggctgcataagcaccttaagtggacgatccaaaaccaagggtagtctggacccttcgaccctgtgatcaatgactttgcattcgatcgctgtttttgttcaagttacccatttgttgttccttgatcattcaagatgagattttgtattgaattattgatgttgttgaggtaaattagatgctccaaagactacatgaagcaaatgaaaacgatgtatttcactttccatttgtatgttgttctattagtatagagaaaccaataaactggcg

SEQ ID NO: 45462 - protein, 141 aa, Panicum virgatum
  misc_feature: Ceres CLONE 2025150
  misc_feature (65)..(132): Pfam Name: PP-binding Pfam Description: Phosphopantetheine attachment site
MAHSLATAAAASFSPAAARRQVTNVFSSRSSVSFQSHRMTSVSIRSRPSSLRLKICCSAKQETIDKVCSIVKEQLALPDGTALSGESKFAELGADSLDTVEIVMGLEEAFNITVDETSAQDIATVQDAADLIEKLVLEKAA

SEQ ID NO: 45463 - DNA, 751 bp, Panicum virgatum
  misc_feature: Ceres CLONE 2025165
  misc_feature: Encodes the peptide sequence at SEQ ID NO. 45464
ataatttcaaaacaaagcttgatttttttagctaatcacaactccccaaatgaacactaaagcccttcttatcattttcgccattgtcgcagtttcttctgccaactttgtcgatgattgcctctattatcacaaccaagtcagatccggacttggccttaatagattcacctggtccaactcccttgcttctgcttcagctgcatatgctaacgtccttgctggaaccaatcatcttaagcacagtaccaacagacataatattggcgagaacctctcaatgggaactaagaacacctatgacaccaaggcactcatctacttgtggatcaacgaaaagagacattatatctctggcaaaaagttccccaatacttccaccaccggaaactggaaagacactgcccattacactcaaatgatttggagaactaccacccaagtcggatgcggtgtcgccaccaacagtaaatggagatttttggtctgtagatacaagagacaaggtaacatcgctggccaatatccttactaagggcttttttaatgaagagctaattaagacataatcaagctgagaaattccgaaagtaaacatgaggaatttttttttatacaagtttctttatatatttgtatgaatgataaaattcatttttactttatttttttcattcgtctgatmtatatctctgaaactcctattgcatacacacatttttaattttgcaagaatacttgctcccattat

SEQ ID NO: 45464 - protein, 161 aa, Panicum virgatum
  misc_feature: Ceres CLONE 2025165
  misc_feature (25)..(149): Pfam Name: SCP Pfam Description: SCP-like extracellular protein
MNTKALLIIFAIVAVSSANFVDDCLYYHNQVRSGLGLNRFTWSNSLASASAAYANVLAGTNHLKHSTNRHNIGENLSMGTKNTYDTKALIYLWINEKRHYISGKKFPNTSTTGNWKDTAHYTQMIWRTTTQVGCGVATNSKWRFLVCRYKRQGNIAGQYPY

SEQ ID NO: 45465 - DNA, 656 bp, Panicum virgatum
  misc_feature: Ceres CLONE 2025170
  misc_feature: Encodes the peptide sequence at SEQ ID NO. 45466
accagaacaagaagctgaaccggctccccctcccccttccttccattcacaccggcgagcacagcgaaacgcgggagcagagagagagcagagagaggagagagagagagagagagacccgccccctcctccctccgtccggtccccgatggcggctcgcgtcgcggccctcgccgcgctcctcgccctggccgccgccgccgcgcgggcgtccaacgacgagggcgacgcgctctacgcgctgcggcagcggctcagggaccccaacggcgtgctgcagagctgggaccccacgctcgtcaacccctgcacctggttccacgtcacctgcaaccaggccagccgcgtcgaacgcctggacttggggaactccaatatctccggctccctcggccctgagctcgggcgccttgtgaacctcaaatacctggagctgtacagggacaatttcgatggcgagatcccaaaggaattgggtaagctgaagaatctgatcagcttggatttgtacgccaacaagctcaccggagaaatccccaagtcactttccaagctcaactcactcagattcatgcgcttgaacaacaacaagcttaccgggatcattccaagggagcttgccaagctttccaacctcaaagtcattgacctgtcta

SEQ ID NO: 45466 - protein, 169 aa, Panicum virgatum
  misc_feature: Ceres CLONE 2025170
  misc_feature (22)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARVAALAALLALAAAAARASNDEGDALYALRQRLRDPNGVLQSWDPTLVNPCTWFHVTCNQASRVERLDLGNSNISGSLGPELGRLVNLKYLELYRDNFDGEIPKELGKLKNLISLDLYANKLTGEIPKSLSKLNSLRFMRLNNNKLTGIIPRELAKLSNLKVIDLS

SEQ ID NO: 45467 - DNA, 1021 bp, Panicum virgatum
  misc_feature: Ceres CLONE 2025181
  misc_feature: Encodes the peptide sequence at SEQ ID NO. 45468
aaaaaaccttttcttttttcgctttgatggctgctgttttctcggctgctggctgtcgcttgtcggcggcccttcgccaacagcagctgcatcccttctctcttttatgctcagctcaggtatcgaccctttctcacttctccactccttcacctttgatccgagtcgagaggagaagcatgaccacagcgagtcttccccatcagggctttttcgatcagctccgtcgccgttttatcgaacccgaaacaccggcggacaccgaacaacaccgaaagagcaatccatctgcgggactctgggaccaaaagcccgaaaagccccgatccgatgaacctgaaatcatccgatttgacctcgaggaggaggaagaagaagaggcagtgctcttccccaagcctgaaacaccacccgagtccttcgccgtcgttgtcgttggcaacaagcagtacaaagtgtccgcaggcgaccgaatcatggtcgatcatcttgtcggcaccgacttaggcgactcaatcgtcctgaagaaagtgctcttggtcggttcgcaacacgtcactgccatcggcagaccgctcgttcagtcctgtcgcgtcgttgctgatgtagaagagcaggcccggacggaaaagctgatcatcttcaagaagaagcggaggaagaactaccgccgtcgcaacggttttcgatcaacggtcactgtcttgagagtgaccgagctcacgttctcgcagtcaagcgaagtggcacccaccgtacttgcctatcatcaaccccggcctgtctctgatagactggttgaatgggacttggaagataacaggcgaagagaccttgctcgtgctatcggtcggaaggtcagtcaggagaggaaacggagaagaaggggatatgagtaacggagatgggaaataatcctctccacattcaaaacaacaaccaaaaaaacgattgatttgcacgaaacaaacaaccaaccgacccgaactctactcaaaaagcacatcttcgcaatccatcc

SEQ ID NO: 45468 - protein, 290 aa, Panicum virgatum
  misc_feature: Ceres CLONE 2025181
  misc_feature (131)..(227): Pfam Name: Ribosomal_L21p Pfam Description: Ribosomal prokaryotic L21 protein
MAAVFSAAGCRLSAALRQQQLHPFSLLCSAQVSTLSHFSTPSPLIRVERRSMTTASLPHQGFFDQLRRRFIEPETPADTEQHRKSNPSAGLWDQKPEKPRSDEPEIIRFDLEEEEEEEAVLFPKPETPPESFAVVVVGNKQYKVSAGDRIMVDHLVGTDLGDSIVLKKVLLVGSQHVTAIGRPLVQSCRVVADVEEQARTEKLIIFKKKRRKNYRRRNGFRSTVTVLRVTELTFSQSSEVAPTVLAYHQPRPVSDRLVEWDLEDNRRRDLARAIGRKVSQERKRRRRGYE

SEQ ID NO: 45469 - DNA, 607 bp, Panicum virgatum
  misc_feature: Ceres CLONE 2025185
  misc_feature: Encodes the peptide sequence at SEQ ID NO. 45470
ataatacaaattttaacaacaacaaaaaactattcaaaacaacattaacaatgcccggaacttttatctttagaccaattgaagctaagcttgctcacggtgacttgctcggcaaacttgatccctactgcaagttcaccattggttggcattcaggagaaagcgccgttgccaaagatcaaggcaagaaccctcattggaatgacaccatttctcttgaaagaaaacatgatgaacatagtgccaagcttgtagtcaaagacaaggaccatttgagtcttgatgataaccttggagagacagaaatcaaccttgattcggttctttctcaaggaagatcaactcaatggtatgagttgatccatcattcgaaaccagcaggacaagttctcattgatattgagtatgttggaggatactaactcaataagagaaatggatttctcagacaagaaaattgatttaatataaataaataattttagctccataataatatttacggttatggttttatattgtctgaaatcaaatctcagtacgttaatatctaagtacgataactaattataattatttctgtggcgtatttaagtcaaatcatttc

SEQ ID NO: 45470 - protein, 123 aa, Panicum virgatum
  misc_feature: Ceres CLONE 2025185
  misc_feature (5)..(85): Pfam Name: C2 Pfam Description: C2 domain
MPGTFIFRPIEAKLAHGDLLGKLDPYCKFTIGWHSGESAVAKDQGKNPHWNDTISLERKHDEHSAKLVVKDKDHLSLDDNLGETEINLDSVLSQGRSTQWYELIHHSKPAGQVLIDIEYVGGY

SEQ ID NO: 45471 - DNA, 641 bp, Panicum virgatum
  misc_feature: Ceres CLONE 2025190
  misc_feature: Encodes the peptide sequence at SEQ ID NO. 45472
cggtaagacccatgtcaaaaaaaaaaaaaaactccggtaagaccgatgctgccgatgaggtccgccgccgccgcgccgtgctcgctggcagcgctgctgctccgccgcctctcctcccactcgtcctcttctgtctattccgtcagccgccacgccccctctgccttatcctctcagccctcggcctcctacctcaccaccagccccccttgccccctttccagcagccgcaggaccaggggattcgcggcctgggcctcggcgccggggccggcggggcccgccgaatcccccgccacgaaggtgctagaggccaagatcaaggagcagctggaagccgacgcggtcacggtcgtcgatacctccggggacggccgccacgtctgcatagatgtggtttccaaggcattcgagggaaaatctgcagtaaataggcagagaatggtttacaaggctatatgggaggagcttcagagcactgtgcatgccgtggaccaaatgactaccaagacgccagacgaagctgctgcgaacaagtaattcaatatcatgcctgtggaggcagttatgctctcctttgaagatcaggccctttccttcaccaagtttctgtttttttttcctgaatgatcaataattcg

SEQ ID NO: 45472 - protein, 164 aa, Panicum virgatum
  misc_feature: Ceres CLONE 2025190
  misc_feature (83)..(160): Pfam Name: BolA Pfam Description: BolA-like protein
MLPMRSAAAAPCSLAALLLRRLSSHSSSSVYSVSRHAPSALSSQPSASYLTTSPPCPLSSSRRTRGFAAWASAPGPAGPAESPATKVLEAKIKEQLEADAVTVVDTSGDGRHVCIDVVSKAFEGKSAVNRQRMVYKAIWEELQSTVHAVDQMTTKTPDEAAANK

SEQ ID NO: 45473 - DNA, 609 bp, Panicum virgatum
  misc_feature: Ceres CLONE 2025209
  misc_feature: Encodes the peptide sequence at SEQ ID NO. 45474
actctaggtgttcgacggatagccccacgggactaggaggtgggagccggcggcccgcccatgtcgactcggcgcgtacggatccgcgctcgcccccccggccctcgacccgatgccgggcccggaaccaaaccgggagccgcccgtgacacaggctccggagccagccccgaaccgcgaggcggtggcattgcacatggatgcgccagcgccggcgccacaacttgaggccgtggccttgcagatggacgcccccgagccggcgcctcaccatgaggtggtggcgttgcggatggaggcgctggcccccgctctgcatcatgaggtggtggcgttgctgacggacgcgccggtgccggcggttaccatcatgatctcgcgaccaggggacgaggttcaggcgcccaactcaaagggcgtctccccagctgtcctccccgcaggccagtggcggcaaggccacagccgcctcggtgtccgtgactgctgctgtagacgcaaaggatgccgacctggcgaggtccgacagcttcgaccactacgagcaatgcacattttgtcaccagaagacagaacagcctctggtagatcttgcatgcatgagtcgtg

SEQ ID NO: 45474 - protein, 165 aa, Panicum virgatum
  misc_feature: Ceres CLONE 2025209
  misc_feature: SWISSPROT Homolog: EC 2.7.1.107 Diacylglycerol kinase
MPGPEPNREPPVTQAPEPAPNREAVALHMDAPAPAPQLEAVALQMDAPEPAPHHEVVALRMEALAPALHHEVVALLTDAPVPAVTIMISRPGDEVQAPNSKGVSPAVLPAGQWRQGHSRLGVRDCCCRRKGCRPGEVRQLRPLRAMHILSPEDRTASGRSCMHES

SEQ ID NO: 45475 - DNA, 676 bp, Panicum virgatum
  misc_feature: Ceres CLONE 2025211
  misc_feature: Encodes the peptide sequence at SEQ ID NO. 45476
aaactatatcctacgcacacagcaacatctcccagtccgcagcagaagcgagcgtaggcggtgcaggaaatggacagcgcgagcagcctcgtggtggacgacaccagcggcggcggcgcgtgcacggacaagctcagggcgctggccgccgagggggcgacgctggagcgcatgggcagcggcgccagcgcggtcgtggacgcggccgagccgggcgccgaggcggactcgggctccgcgggccacgccggcgcgggcgggaagctgccgtcgtccaggtacaagggcgtggtgccgcagcccaacgggcggtggggcgcgcagatctacgagcgccaccagcgcgtgtggctcggcaccttcgcgggggaggccgacgccgcgcgcgcctacgacgtcgccgcgcagcgcttccgcggccgcgacgccgtcaccaacttccgcccgctcgcggacgccgacccggacgccgccgccgagctccgcttcctcgcgtcgcgctccaaggccgaggtcgtcgacatgctccgcaagcacacctacttcgacgagctcgcccagaacaagcgcgccttcgccgccgcgacctcgtcgctcgccggcgcccactccccctctttcgcgcccccctctcccgcgcgggcgcgggagcacctgttcgacaagacggtcactc

SEQ ID NO: 45476 - protein, 202 aa, Panicum virgatum
  misc_feature: Ceres CLONE 2025211
  misc_feature (69)..(118): Pfam Name: AP2 Pfam Description: AP2 domain
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 50 in the 10/838,616 US patent application
  misc_feature: The sequence is a functional homolog of SEQ ID NO 48 in the 10/838,616 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: Functional homolog of the protein sequence given in SEQ ID NO 50662
  misc_feature: Useful for making plants with altered alkaloid content
  misc_feature: Useful for making plants with altered lignin content
  misc_feature: Functional homolog of the protein sequence given in SEQ ID NO 50664
  misc_feature: Useful for making plants with altered protein content
  misc_feature: Useful for making plants with altered terpenoid content
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: The sequence is a functional homolog of SEQ ID NO 46 in the 10/838,616 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 44 in the 10/838,616 US patent application
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: The sequence is a functional homolog of SEQ ID NO 42 in the 10/838,616 US patent application
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
  misc_feature: The sequence is a functional homolog of SEQ ID NO 20 in the 10/838,616 US patent application
MDSASSLVVDDTSGGGACTDKLRALAAEGATLERMGSGASAVVDAAEPGAEADSGSAGHAGAGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAATSSLAGAHSPSFAPPSPARAREHLFDKTVT

SEQ ID NO: 45477 - DNA, 668 bp, Panicum virgatum
  misc_feature: Ceres CLONE 2025217
  misc_feature: Encodes the peptide sequence at SEQ ID NO. 45478
atctcactccagagtccagacttccagagccagccagccgcttaatttgatttgaacaacccgcagcttaatttgattaagcgatcgatctatctcagttggagctctgcgagcgaacgcgcgtcgtgggcccacgtacgttcaacggacagctgctcggagagatcatggacggcaagctgggcgtgcaccacgggcaccaccacagcggcatctccaagccgccggcgcaccaccaccacggcggcaagaggggcgccaggaggcacgccggcagcggcggaggggggagtaataaggggatcaaggtggtgtacatctccagccccatgaagctcaccgccagcgccgaggagttccgcgccgtcgtgcaggagctcaccggccgcgactccaacgtcgccgaccacgacctcgccggcgcctacgcgccgtcgtcgtcctcgtcctcgtcctcatcctcgtacgcatcgttcgggcgcgtctccccgacgggggccggcgcggcaggcggcgccgcacgcgctctgtcgccgacgatggccacgggggcgagcgtcggcgcgggacgggcggccgagtacggcgccgcgatggccgcgccgccgccgttccagggcatgtacgactacactgccgggagcttgctttacggccaggactactgg

SEQ ID NO: 45478 - protein, 166 aa, Panicum virgatum
  misc_feature: Ceres CLONE 2025217
  misc_feature (50)..(80): Pfam Name: VQ Pfam Description: VQ motif
MDGKLGVHHGHHHSGISKPPAHHHHGGKRGARRHAGSGGGGSNKGIKVVYISSPMKLTASAEEFRAVVQELTGRDSNVADHDLAGAYAPSSSSSSSSSSYASFGRVSPTGAGAAGGAARALSPTMATGASVGAGRAAEYGAAMAAPPPFQGMYDYTAGSLLYGQDY

SEQ ID NO: 45479 - DNA, 964 bp, Panicum virgatum
  misc_feature: Ceres CLONE 2025219
  misc_feature: Encodes the peptide sequence at SEQ ID NO. 45480
cttctctcaccagcagaccacgccgcataactaactctcgcacccgaccgacacacacgcacaaactaacatgacgaccgaacgcgaggccaacatctacgaagccaagctcgccgagcaggccgagcgctacgacgagatggtggcggctatcaagaaggtcgctgcctcgctcaaggccaacgagggtctctcggtggaggagcgcaacatcttcagcgtcgcctacaagaacgtgatcggctcgcgcagagcgacgtggcgcatcgtctcgtccatcctcaagaaggaggaggaccgaccggagaagatcgagatgaggatcaagcacgctcgcgccctggccaacaaggtcgagggcgagatgaactccatctgtaacgactgcctcaaggtcatcgacgaccacctcctcccctcggccgcctctgacgccgagagcaagaccttctactacaagatgaagggcgactaccacaggtacatggccgagtactcgtccggcgagggtcgccagaaggcctccgaggcctcgctccagtcctaccagtccgccgccgacgtcgccaaggagctgccgtcgacgcaccccatccgcctgggccttgccctcaacttctcggtgttctactacgagatcctgtcgtcgcccgagaaggcgtgccagatcgccaagcaggcgttcgacgaggccatcaaccacctcgacggcatcggcgaggaggagtacaaggacgcgacgctcatcatgcagctcatcagggacaacctcacgctctggacttctgatatgcaggagggagacgaagacgatgacgacgaaggccaggagaagaaggaggagcaggactagattcccccttgaggagcatgcacgcgcgcgcggagaggtcacagctgctgttggggtgggaagacaccccacagccacgcttggggaatgtaaaaacattaaaaacattac

SEQ ID NO: 45480 - protein, 260 aa, Panicum virgatum
  misc_feature: Ceres CLONE 2025219
  misc_feature (5)..(245): Pfam Name: 14-3-3 Pfam Description: 14-3-3 protein
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 793 in the 11/479,226 US patent application
  misc_feature: The sequence is a functional homolog of SEQ ID NO 801 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 809 in the 11/479,226 US patent application
  misc_feature: The sequence is a functional homolog of SEQ ID NO 1777 in the 11/479,226 US patent application
MTTEREANIYEAKLAEQAERYDEMVAAIKKVAASLKANEGLSVEERNIFSVAYKNVIGSRRATWRIVSSILKKEEDRPEKIEMRIKHARALANKVEGEMNSICNDCLKVIDDHLLPSAASDAESKTFYYKMKGDYHRYMAEYSSGEGRQKASEASLQSYQSAADVAKELPSTHPIRLGLALNFSVFYYEILSSPEKACQIAKQAFDEAINHLDGIGEEEYKDATLIMQLIRDNLTLWTSDMQEGDEDDDDEGQEKKEEQD

SEQ ID NO: 45481 - DNA, 1131 bp, Panicum virgatum
  misc_feature: Ceres CLONE 2025235
  misc_feature: Encodes the peptide sequence at SEQ ID NO. 45482
aagcagaagcgaaaaccagaaagcgctttcacagtaactagaaagagtgagtgtttgtttacaaaagcgattatttcaacatgccgatcagaaacatcgctgtaggaactcctcaagaggcaactcacccagacaccttgaaagctggtttggctgagttcatctcaaccttcatctttgtcttcgccggttcaggttccggtatcgcatacaacaagcttaccaacgacggtgctgccacccctgccggtctcatctctgcctccatcgcccatgcattcgctctctttgttgctgtctccgttggtgctaacatctccggtggacatgtcaaccccgctgtcaccttcggtgccttcgttggtggtaacatcaccctcctccgtggtatcgtttacatcatcgctcaactcctcggatccatcgttgcttccgccctcctcgtctttgttaccgcttcgtctgttccagcgttcggactatcagagggagttggagttggaccagctttggtgttggagattgtgatgacctttggattggtgtacacagtgtatgctacagccgttgacccaaagaagggtaacattggaattattgcaccaattgctattggtttcattgttggtgctaacattttggttggtggagcctttaccggagcatccatgaacccagcagtgtcattcgggcctgctgttgtgagctggagctggtccaaccactgggtctactgggctggcccacttatcggtggtggaattgctgggcttgtctatgaggttctattcatcaacagcacccatgagcagctcccaactactgactactagatgggaaatgaaatttgaaattgtgtattaatgaatctcgatgatttctttttctgtgaatgtaatttcctttgttgtgtccttttttaattattgagggttgtttcttttgtgttgaaaaatggtggccgttgatctttggttgtacgttggttagtgatgatggaatggttaaattattttgtacatgcttggcctagcaggttcttagtcagcaggtccaccactgaatcaatgttataatttcgggtctgcttggttgtatgattgattcaacttctttgtttttcctcccttc

SEQ ID NO: 45482 - protein, 250 aa, Panicum virgatum
  misc_feature: Ceres CLONE 2025235
  misc_feature (13)..(233): Pfam Name: MIP Pfam Description: Major intrinsic protein
MPIRNIAVGTPQEATHPDTLKAGLAEFISTFIFVFAGSGSGIAYNKLTNDGAATPAGLISASIAHAFALFVAVSVGANISGGHVNPAVTFGAFVGGNITLLRGIVYIIAQLLGSIVASALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 45483 - DNA, 690 bp, Panicum virgatum
  misc_feature: Ceres CLONE 2025251
  misc_feature: Encodes the peptide sequence at SEQ ID NO. 45484
tgacaggcacttagcactaatcgatttatttctgctttaatttgtgcgtgtggtccgcagagcaaaatggcagggaaggcctcggtcgcgctgttcctggccgtcaacctggtcgtgttcgccatggccagcgcctgcggtggcgactgccccacgccgtcgaccccgtcgactcctaccccgacgtcggcctccaaaggcaagtgcccccgcgacgcgctgaagctgggcgtgtgcgccaacgtgctgggcctcatcaaggccaaggttggcgtgccgcccgcggagccctgctgcccgctgttggaggggctcgtcgacctcgaggccgccgtgtgcctctgcaccgccatcaagggcaacatcctcggcatcaacctgaacctgcccatcgatctcagcctcatcctcaactactgcggcaagaccgtgcccactggcttcaagtgcctctaagctaccagacgcataggcatatatgcatccatcgtggtttggtttgctatgtgtgtgctataaatgctggctatcggaagctttgcatgcattgtggagaggcaaaggacgtgcgcacacatgcgttcgatttgcttctgttgttccgttgtcttatttattctcgcatgtccctctccgagctatgtgggttattgttcatttgcattttgcactggattgtatggacaaaat

SEQ ID NO: 45484 - protein, 129 aa, Panicum virgatum
  misc_feature: Ceres CLONE 2025251
  misc_feature (47)..(128): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 50191
  misc_feature: Useful for making plants with modulated salt sensitivity
MAGKASVALFLAVNLVVFAMASACGGDCPTPSTPSTPTPTSASKGKCPRDALKLGVCANVLGLIKAKVGVPPAEPCCPLLEGLVDLEAAVCLCTAIKGNILGINLNLPIDLSLILNYCGKTVPTGFKCL

SEQ ID NO: 45485 - DNA, 456 bp, Panicum virgatum
  misc_feature: Ceres CLONE 2025263
  misc_feature: Encodes the peptide sequence at SEQ ID NO. 45486
tggtcctgagtttaagaaggttgccaacttccttgcccggttcaagtccatccccagcattgtcgagcttgacagcttgaaggtttctggtgatgtctggttcggctctggaattacactcaagggcaaggtaaccatcaccgccgagcccggagtgaagttggagattccagatggagctgttcttgagaacaaggacatcaatggcccccaggatctctgagcgatgcttaccgttgtcaccagtttttctgaggacctttcgcaggagccgccgccctaatcactcccgctgagctttatcttttgtaattgttatgtgcattaccgctgtgagggtgttgtgagcccgctacagaataattgtaatcccatttggtgcttctgtacttctgtttttgacgcgccagggacgaatagaatattttgctgaaatgatacttaccatagagtacc

SEQ ID NO: 45486 - protein, 73 aa, Panicum virgatum
  misc_feature: Ceres CLONE 2025263
  misc_feature: SWISSPROT Homolog: EC 2.7.7.9 UTP--glucose-1-phosphate uridylyltransferase
GPEFKKVANFLARFKSIPSIVELDSLKVSGDVWFGSGITLKGKVTITAEPGVKLEIPDGAVLENKDINGPQDL

SEQ ID NO: 45487 - DNA, 688 bp, Panicum virgatum
  misc_feature: Ceres CLONE 2025272
  misc_feature: Encodes the peptide sequence at SEQ ID NO. 45488
accctagacatcccaagccccagcgccgccagcgagccagccactccaccactcccgacccgagccctcaggcggtcaggccccagcgcggcggcggcggcggcaagatggcggtgggcaagaacaagcggatcagcaaagggaagaagggtggtaagaagaagatcgtcgatcccttcgcgaagaaggattggtatgatatcaaggcgccctccatcttctccgtgcgcaacattggaaagacgctcgtgtccaggacacagggtactaagattgcttctgagggtctgaagcaccgtgtctttgaggtctccctagctgatcttcagagtgatgaagaccaagcctacaggaagatcaggctccgtgccgaagatatccagggtcgtaatgtccttaccaacttctggggtatggattttactacagacaagctgcggtcgctggtcaggaagtggcagaccttgattgaggcccattttgatgttaagaccactgatagctacatgctgcggctcttctgcatcgggtttacaaagaggagacccaaccaagtgaagcgtacttgctatgcacaggcctcccagatccgtcagatacgccggaagatggttgagatcatggccaaccaggcctctacctgtgacctgaaggagttggtgtccaagtttattcctgaggtcattgg

SEQ ID NO: 45488 - protein, 193 aa, Panicum virgatum
  misc_feature: Ceres CLONE 2025272
  misc_feature (11)..(193): Pfam Name: Ribosomal_S3Ae Pfam Description: Ribosomal S3Ae family
MAVGKNKRISKGKKGGKKKIVDPFAKKDWYDIKAPSIFSVRNIGKTLVSRTQGTKIASEGLKHRVFEVSLADLQSDEDQAYRKIRLRAEDIQGRNVLTNFWGMDFTTDKLRSLVRKWQTLIEAHFDVKTTDSYMLRLFCIGFTKRRPNQVKRTCYAQASQIRQIRRKMVEIMANQASTCDLKELVSKFIPEVI

SEQ ID NO: 45489 - DNA, 646 bp, Panicum virgatum
  misc_feature: Ceres CLONE 2025292
  misc_feature: Encodes the peptide sequence at SEQ ID NO. 45490
gcatcagcgtagcaggcaacagcaatctcgaggagcaggtagtagagcgctaagcttccggtgcgtggagcgaatagcggaagcggaagcgaagatggtgaagctcgcgttcgggagcgtcggcgactccttcagcgccacctccatcaaggcctacgtggccgagttcatcgccaccttgctcttcgtcttcgccggcgtcggttccgccatcgcctacgggcaactgacccatggcggcgcgctcgaccctgccggcctggtggcgatcgcgatcgcccacgcgctggccctcttcgtcggcgtctccatcgccgccaacatctccggcggccacctgaaccccgccgtgaccttcggcctcgccgtcggcggccacatcaccatcctcaccggcctcttctacaccgtgtacgccaccgccgccgaccccaaggagggctccctcggcaccatcgcccccatcgccatcggcttcatcgtcggcgccaacatcctcgccgccgggcccttcagcggcggctccatgaaccccgctcgctccttcggccccgccgtcgccgcgggcaacttcgccggcaactgggtctactgggtcggcccgctcatcggcggtggcctcgctggcctcatctacggcgacgtg

SEQ ID NO: 45490 - protein, 183 aa, Panicum virgatum
  misc_feature: Ceres CLONE 2025292
  misc_feature (11)..(181): Pfam Name: MIP Pfam Description: Major intrinsic protein
MVKLAFGSVGDSFSATSIKAYVAEFIATLLFVFAGVGSAIAYGQLTHGGALDPAGLVAIAIAHALALFVGVSIAANISGGHLNPAVTFGLAVGGHITILTGLFYTVYATAADPKEGSLGTIAPIAIGFIVGANILAAGPFSGGSMNPARSFGPAVAAGNFAGNWVYWVGPLIGGGLAGLIYGD

SEQ ID NO: 45491 - DNA, 632 bp, Panicum virgatum
  misc_feature: Ceres CLONE 2025294
  misc_feature: Encodes the peptide sequence at SEQ ID NO. 45492
tgatgagatatgcgtttcagactgacactttggcatacttcttatcggttctgaaagaccagtttccagacgggatcagagtgctatccatctacagtggaattggaggtgctgaagtaacattccatcggctaggtattcctttgaagtgtgtggtgtctgttgaggaatctgatgtgaataggaaaattctgagaaggtggtggctgaaaactgaacagactggagagctgaggcagttgcatggaattgggaagctgaaaactcaagtgattggagacttgatcaatgagttcggtggttttgacctgattattggtgggaattatacttcttgtaaaggtggtacaacagtaaatacaacaatgggcatggattccagccgcttctttgaatatgcccgtgttgttaagagagtgaggactgaagtcggacttaattaacaacggacatgattcaatgttttgcatctttagtgagttctcgccttagcaaattggcatgaactgccttctagcattttgtgatctacaaatgtaggatggtacaagtaaactttgacatattccttagctttttcattgtggacaagtgtagaattttaaatgcagtgggttaatatttcttctgcc

SEQ ID NO: 45492 - protein, 146 aa, Panicum virgatum
  misc_feature: Ceres CLONE 2025294
  misc_feature: SWISSPROT Homolog: EC 2.1.1.37 DNA (cytosine-5-)-methyltransferase
MRYAFQTDTLAYFLSVLKDQFPDGIRVLSIYSGIGGAEVTFHRLGIPLKCVVSVEESDVNRKILRRWWLKTEQTGELRQLHGIGKLKTQVIGDLINEFGGFDLIIGGNYTSCKGGTTVNTTMGMDSSRFFEYARVVKRVRTEVGLN

SEQ ID NO: 45493 - DNA, 704 bp, Panicum virgatum
  misc_feature: Ceres CLONE 2025296
  misc_feature: Encodes the peptide sequence at SEQ ID NO. 45494
ttttgcatctctctgtctgtatcagagcctccgctccgctcctctcctctccgcctccgcctccaccccccccccccccaacctccaccccgcccccgccgccgcaggaaggaaggatggaggcccctggctccccctacgcctcctcgccggaatccgccccgaagcgcgccccacgctcccctccgcagcagcagcagcatcagcagcagccctccgaggaaggagatgacaaggagaagccaacacatttgaggttcctggtgtctaatactgcagcaggatgtattattggcaagggtggatcaaccatcaatgactttcagtcccagtctggggcccgaattcagttatcacgtagccatgagttcttccctggtacaaatgaccgtatcatcatggtttctggaatgtttgatgaagtaatgaaggccatggagctcattcttgagaaacttttggctgagggtgaagaattcaatgaagctgaagctaggcctaaagttagacttgtagttcctaacagctcttgtggtgggataattggtaaaggtggatcaacaataaagtcatttattgaagaatcgcatgctggaatcaaaatttcgccacaggataacaactatgctggtttgcatgacaggcttgttactgtcacaggaacttttgataaccagatgaatgcaatagatttgatattgaag

SEQ ID NO: 45494 - protein, 195 aa, Panicum virgatum
  misc_feature: Ceres CLONE 2025296
  misc_feature (45)..(110): Pfam Name: KH_1 Pfam Description: KH domain
  misc_feature (129)..(194): Pfam Name: KH_1 Pfam Description: KH domain
MEAPGSPYASSPESAPKRAPRSPPQQQQHQQQPSEEGDDKEKPTHLRFLVSNTAAGCIIGKGGSTINDFQSQSGARIQLSRSHEFFPGTNDRIIMVSGMFDEVMKAMELILEKLLAEGEEFNEAEARPKVRLVVPNSSCGGIIGKGGSTIKSFIEESHAGIKISPQDNNYAGLHDRLVTVTGTFDNQMNAIDLIL

SEQ ID NO: 45495 - DNA, 709 bp, Panicum virgatum
  misc_feature: Ceres CLONE 2025328
  misc_feature: Encodes the peptide sequence at SEQ ID NO. 45496
ctcggctgccttctttccaagcggcgacggtaggggagcggcgccgccttcttcgttggacgcttcgccggccgacaagatacagggaaaagtgttttgtgtgacactaccaaaacttgaaaatgaacaagggcaagatttttaagttagctaagggattcagaggaagggcaaaaaactgtataaggatagcaagggagagggtggaaaaggcactgcagtattcatacagggataggcgcaacaagaagagggacatgcgatctctttggattgagcgcatcaatgctggtacacgccttcatggggtgaactatggcaacttcatgcatggattgatgaaggagaatatccaacttaacaggaaggttctctctgagctgtccatgcatgagccatacagcttcaaggctcttgtcgatgtatctcgcaatgcatttcctgggaacaggcctgttcctgctaggaaggaggggctagcaagcattctgtaaccatttctcgcccaataatcaagcttgacggctacatcttcatctgaaagtaaccttttgtcttgtgacgtcgtgaagagcttgtctgtttgacgacctgccggacagacaatcgtagtacatgttttggaccccatgccaactacttttagttttctgaaaaatgtgttccctttactcttgaaagactttggaagattaattactggtcaggt

SEQ ID NO: 45496 - protein, 123 aa, Panicum virgatum
  misc_feature: Ceres CLONE 2025328
  misc_feature (5)..(98): Pfam Name: Ribosomal_L20 Pfam Description: Ribosomal protein L20
MNKGKIFKLAKGFRGRAKNCIRIARERVEKALQYSYRDRRNKKRDMRSLWIERINAGTRLHGVNYGNFMHGLMKENIQLNRKVLSELSMHEPYSFKALVDVSRNAFPGNRPVPARKEGLASIL

SEQ ID NO: 45497 - DNA, 639 bp, Panicum virgatum
  misc_feature: Ceres CLONE 2025365
  misc_feature: Encodes the peptide sequence at SEQ ID NO. 45498
cgtcacatggcaggacgctggcaaggttgagctggtggacgggtcgtcgtacctgggccagccgctgcccttctccatctcgacgctcatctggatcgaggtgctggtgatcgggtacatcgagttccagcgcaacgcggagctggacccggagaggaggatctaccccggcgggtccttcttcgacccgctgggcctcgcgtccgacccggagaagaaggagcggctgcagctggcggagatcaagcacgcgcgcctcgccatggtcgccttcctcggcttcgccgtgcaggccgcggccaccggcaagggcccgctcaacaactgggtcacccacctcagcgacccgctccacaccaccatcttcgacaccttctcctccggatcctcttaattaattaaggccatgtattattgcttgctgctccgatccgtccgtccatcgatgagaatgtgttcgagatgggtggatgaacgcgtgcgtcgtttgattttgtggtcagcgagagggtaatatggggacgatgatctttgttcatggtactggaggtctcaatctctggttaattaggagagctgctggaactttggtgatgtgtaatatatgaaccaatgatgaattaatgcattcacttgtac

SEQ ID NO: 45498 - protein, 130 aa, Panicum virgatum
  misc_feature: Ceres CLONE 2025365
  misc_feature (2)..(99): Pfam Name: Chloroa_b-bind Pfam Description: Chlorophyll A-B binding protein
  misc_feature: Functional homolog of the protein sequence given in SEQ ID NO 50114
  misc_feature: Useful for making plants with modulated water use efficiency
  misc_feature: Functional homolog of the protein sequence given in SEQ ID NO 50115
  misc_feature: Useful for making plants with modulated biomass
  misc_feature: Useful for making plants with modulated drought sensitivity
  misc_feature: Useful for making plants with modulated phosphate use efficiency
VTWQDAGKVELVDGSSYLGQPLPFSISTLIWIEVLVIGYIEFQRNAELDPERRIYPGGSFFDPLGLASDPEKKERLQLAEIKHARLAMVAFLGFAVQAAATGKGPLNNWVTHLSDPLHTTIFDTFSSGSS

SEQ ID NO: 45499 - DNA, 657 bp, Panicum virgatum
  misc_feature: Ceres CLONE 2025367
  misc_feature: Encodes the peptide sequence at SEQ ID NO. 45500
atcgtcctagctcccagaactcctcagtcctcactaccagcgctgcctctgctcactcgccgtccattcctcttccctctcgagcaagctcgtcagcatgtcgacggtgtcccttgaccagaagcttgccctcgccaagcgctgctcgagagaagccaccctcgctggagccaaggcagcagctgtagccaccgtcgcctccgcgatccccaccgtgagtccctcccatctcgttctctgctccctcagcgagtactgtaagattgtgatcacacacaccagcctgctgctgatatcgatcctctcgcacgcatgttcaattcagctggcgagcgtgcggatgctgccgtgggccaaggccaacatcaaccccaccggccaggcactcatcatctccacagtcgccggcatggcctacttcatcgcggcggacaagaagatcctctcgctggcgaggcggcactcgttcgagaacgcccccgagcacctcaggaacacctcctaccagggcaccggccgtccccacccggccttctccaggccctgatcggctcgcaagcacatttaagacccgtgctgccctgcgctctagcctcatctagatatgtataccgtgtgtgtatgcttgctgcaataataagcaggcctctgcagagc

SEQ ID NO: 45500 - protein, 149 aa, Panicum virgatum
  misc_feature: Ceres CLONE 2025367
  misc_feature (8)..(123): Pfam Name: ENOD93 Pfam Description: Early nodulin 93 ENOD93 protein
MSTVSLDQKLALAKRCSREATLAGAKAAAVATVASAIPTVSPSHLVLCSLSEYCKIVITHTSLLLISILSHACSIQLASVRMLPWAKANINPTGQALIISTVAGMAYFIAADKKILSLARRHSFENAPEHLRNTSYQGTGRPHPAFSRP

SEQ ID NO: 45501 - DNA, 576 bp, Panicum virgatum
  misc_feature: Ceres CLONE 2025391
  misc_feature: Encodes the peptide sequence at SEQ ID NO. 45502
acccaccatcaccgagctctgcatctctctcggcacgcgcgcgagctctccttactcgtcgaggtgccttgatggcgaccgaagtggctgacgctccggtgccgctgccggaggcgggccccgacaccgccgcggagggccctgccgcggacgccgccgcggccgccggcgacgcgaagccggcccaggccaagaaggccgcagcgccgcggaagcgcgcgaacccgacccacccgccgtacgccgagatgatctcggaggcgatcacgtcgctcaaggagaggacggggtcgagccagtacgcgatcgccaagttcctggaggacaagcacaaggacaagctgccgcccaacttccgcaagatgctgctcgtgcagctgaagaagctcgccgccgccggcaagctcaccaaggtcaagaactcctacaaggtgccgtcggggcgcgccccggccgccgacaagcccaagcccaaggccaaggccaagaagcctgctgccgccaagccgaagccgaagcccgctgcgaagaaatagagcgttcggcgtcagaggaatctaggctttcgttctcgtt

SEQ ID NO: 45502 - protein, 154 aa, Panicum virgatum
  misc_feature: Ceres CLONE 2025391
  misc_feature (53)..(123): Pfam Name: Linker_histone Pfam Description: linker histone H1 and H5 family
MATEVADAPVPLPEAGPDTAAEGPAADAAAAAGDAKPAQAKKAAAPRKRANPTHPPYAEMISEAITSLKERTGSSQYAIAKFLEDKHKDKLPPNFRKMLLVQLKKLAAAGKLTKVKNSYKVPSGRAPAADKPKPKAKAKKPAAAKPKPKPAAKK

SEQ ID NO: 45503 - DNA, 696 bp, Panicum virgatum
  misc_feature: Ceres CLONE 2025392
  misc_feature: Encodes the peptide sequence at SEQ ID NO. 45504
acactcgagtatccatccagtctccactgttcagtggccaacttgtcatgtcctcgtcggccactccatgctcggcggcaccggcgccgccgcacgtcgtcgaggactgcttcggcgtcgtgcagctgctcagcgacggcacggtgcggcggtccacggattactcggcgctcccgctcgtcggcggcgtgccgccggacctgcccgtggagtggaaggacgtcgtctacgacgacacgcacggcctccggctccggatgtaccggcccaccaccaccggcggcggcgggggcggggagaagcagaggaagctgccggtgctcgtgtacttccacggcggcggcttctgcctcgccagcttcgagctgatcaacttccacgccggcgcgctccggctcgccgccgagctcccggcgctcgtgctctccgccgactaccgcctcgcgctcgagcaccgcctccccgcggcgctcgacgacgccgagtccgccttctcctggctccgcgcccaggccaccgcgtcccccgccgccgccgacccgtggctcgccgagtcggccgacttcgggcgggtgttcgtgatcggcgactccgccggcggcaacatctcgcaccacatctcggtgcgccacggctccggccggctccccctaggcacggcgctgttcgaccagatgtgggcgcctggcgctgccg

SEQ ID NO: 45504 - protein, 216 aa, Panicum virgatum
  misc_feature: Ceres CLONE 2025392
  misc_feature (92)..(216): Pfam Name: Abhydrolase_3 Pfam Description: alpha/beta hydrolase fold
  misc_feature: SWISSPROT Homolog: EC 3.1.1.3 Triacylglycerol lipase
MSSSATPCSAAPAPPHVVEDCFGVVQLLSDGTVRRSTDYSALPLVGGVPPDLPVEWKDVVYDDTHGLRLRMYRPTTTGGGGGGEKQRKLPVLVYFHGGGFCLASFELINFHAGALRLAAELPALVLSADYRLALEHRLPAALDDAESAFSWLRAQATASPAAADPWLAESADFGRVFVIGDSAGGNISHHISVRHGSGRLPLGTALFDQMWAPGAA

SEQ ID NO: 45505 - DNA, 649 bp, Panicum virgatum
  misc_feature: Ceres CLONE 2025401
  misc_feature: Encodes the peptide sequence at SEQ ID NO. 45506
tagatcgatcgagcattctggttgacgcaagcagagtgacacacgacgatggccgcgccggcgccgcagcaggggcagacggtgatggtggcggtggacgagagcgagtgcagccgccgcgcgctggagtgggcgctgcggaacctggcgcccacgctggcgcccccgctgctgctgctcaccgtgcagccgctcgtcccccttggatacgtctccgcggcctccttcggcacccctcctccggagctcatcaagtcgatgcaggatcagcagagggagctcacgcaggcgctcctcagcaaggccaaggccatctgtgcggagcatggggttccagtagagacaattgttgaagtaggagatccgaaggagatgatatgtgaagcagctgagaaaaaaaatgtcgatctgctagtccttggaagccacagtcgtgggcctatacaaaggttgtttcttgggagcgttagtaactactgcgttcatcattgcaagtgtccagttcttgttgtgaagaatcaaggctgaggattcctgcataaatcaacttccaatgttgtcgtaattctgtttgggtatttatcaacatatatatatatatatatatatatatatatatatattgaatgctatcaacatatattgtaca

SEQ ID NO: 45506 - protein, 159 aa, Panicum virgatum
  misc_feature: Ceres CLONE 2025401
  misc_feature (9)..(156): Pfam Name: Usp Pfam Description: Universal stress protein family
  misc_feature: Functional homolog of the protein sequence given in SEQ ID NO 51517
  misc_feature: Useful for making plants with modulated biomass
MAAPAPQQGQTVMVAVDESECSRRALEWALRNLAPTLAPPLLLLTVQPLVPLGYVSAASFGTPPPELIKSMQDQQRELTQALLSKAKAICAEHGVPVETIVEVGDPKEMICEAAEKKNVDLLVLGSHSRGPIQRLFLGSVSNYCVHHCKCPVLVVKNQG

SEQ ID NO: 45507 - DNA, 714 bp, Panicum virgatum
  misc_feature: Ceres CLONE 2025402
  misc_feature: Encodes the peptide sequence at SEQ ID NO. 45508
attaatatcttcattcaaaaacaaacaactcaacacaatgccaggaactattattttcagacctcttcaagctaatttaaccagagatactgaagtcattggaagcatgaaccctttctgtgaaatcgatctcaatgggaataaggccaaaggtcctgtttgctcaaaaggtggtaaacacccttcttgggatgacaaaatcaccttgaaaagccatgatgaagcttcttgcatccttgaagtcaaaaacaaaaacttgatcctttctgatcatgttattgcaggatgcagaattcctttaaaagaagttgaaacttcaggaagagtcaccaaatggtaccctctttcttacaataaccatcctgcaggacaagtccttgttgaaatcacttattctgctgataatgttatccctgacttccaagaaactcatcaaactccagaaataattttcccacctcctcaggataatttctatcagaacccatccaatcaagatttcaatcaaaaccaatttaatcaaggattcccacaacaaagtttcccagaaagcaatcaacaaataaactatgctccaggtcctcatcatcatctccctcctggagaaaaccactttatcctcaatttgattgagtgttgtaagaactggtatattttgataaagaataatgctttgtaaatatttttatggatttattcatcaagtattttcat

SEQ ID NO: 45508 - protein, 213 aa, Panicum virgatum
  misc_feature: Ceres CLONE 2025402
  misc_feature (5)..(85): Pfam Name: C2 Pfam Description: C2 domain
MPGTIIFRPLQANLTRDTEVIGSMNPFCEIDLNGNKAKGPVCSKGGKHPSWDDKITLKSHDEASCILEVKNKNLILSDHVIAGCRIPLKEVETSGRVTKWYPLSYNNHPAGQVLVEITYSADNVIPDFQETHQTPEIIFPPPQDNFYQNPSNQDFNQNQFNQGFPQQSFPESNQQINYAPGPHHHLPPGENHFILNLIECCKNWYILIKNNAL

SEQ ID NO: 45509 - DNA, 508 bp, Panicum virgatum
  misc_feature: Ceres CLONE 2025450
  misc_feature: Encodes the peptide sequence at SEQ ID NO. 45510
ctctttttcatcatatagacaggatgaagttctctgctgacgtcagttcttctcgccgtaagagcagaaaggctcatttcgccgccacctccgatgttcgtcgtaagatcatgagtgctcctttgtccaaggaactccgtgagaagcacagcgttcgttccattcccgtccgtaaggatgatgaggttatggttgtccgtggtacctacaagggtcgtgagggtaagattgtccaagtctaccgtaagaagtgggttatccacattgatcgtgtctctcgcgagaaggtcaacggtgctactgctcccattggtatctccccctccaaggttgttgtcaccaacctcaagttggataagtctcgtcttgccatcctcgaacgtaagggtaagaaggatgccatgaagcaataaattgtgttgcatcaaggaatctctaattaccttttctaaataataaaaaatcgctttattcttgataataaaccatctttttatttgtcatgttt

SEQ ID NO: 45510 - protein, 129 aa, Panicum virgatum
  misc_feature: Ceres CLONE 2025450
  misc_feature (51)..(82): Pfam Name: KOW Pfam Description: KOW motif
  misc_feature: Functional homolog of the protein sequence given in SEQ ID NO 51460
  misc_feature: Useful for making plants with modulated biomass
MKFSADVSSSRRKSRKAHFAATSDVRRKIMSAPLSKELREKHSVRSIPVRKDDEVMVVRGTYKGREGKIVQVYRKKWVIHIDRVSREKVNGATAPIGISPSKVVVTNLKLDKSRLAILERKGKKDAMKQ

SEQ ID NO: 45511 - DNA, 672 bp, Panicum virgatum
  misc_feature: Ceres CLONE 2025451
  misc_feature: Encodes the peptide sequence at SEQ ID NO. 45512
agcctccctttttatctcgcgcgacgcctcaaccctctcctctgacacgaggaatcaatcgctttcggcgccgccgccgcatccaccgccgcgtcccgccacgccacgcgcaactccctccgccgcctctctccccatgaccacctcccgcgtcctccacttcctccgtggcccggcgacctcccccgcccccgcggaccgccgccggggccctcgccaaccgcagcgcctccgcttcgcgccggctggcgacgggatgcggcgcgtctccgtggcctgctcctcctcctcctcctccaccagcggtgaggacgagggcatgacgtacaagggcgccggcgtggacatcgacgccggcaccgagctcgtgcgccgcatccgcaagatggcgcccgggattggcggattcggcggcctctaccccttcggaaatcacttccttgttgctggcactgatggtgtagggacaaagctgaaacttgcctttgaaaccggtattcatgatactattggcattgacctggtggctatgagtgtcaatgacattgtaacttcaggtgctgaaccaatgttcttcctagattactttgctaccagcaagcttgatgtcgaccttgcagagaaggttatcaaggggattgtggatgggtgcgagcaatcagattgtgttct

SEQ ID NO: 45512 - protein, 178 aa, Panicum virgatum
  misc_feature: Ceres CLONE 2025451
  misc_feature (60)..(178): Pfam Name: AIRS Pfam Description: AIR synthase related protein, N-terminal domain
  misc_feature: SWISSPROT Homolog: EC 6.3.3.1 Phosphoribosylformylglycinamidine cyclo-ligase
MTTSRVLHFLRGPATSPAPADRRRGPRQPQRLRFAPAGDGMRRVSVACSSSSSSTSGEDEGMTYKGAGVDIDAGTELVRRIRKMAPGIGGFGGLYPFGNHFLVAGTDGVGTKLKLAFETGIHDTIGIDLVAMSVNDIVTSGAEPMFFLDYFATSKLDVDLAEKVIKGIVDGCEQSDCV

SEQ ID NO: 45513 - DNA, 587 bp, Panicum virgatum
  misc_feature: Ceres CLONE 2025451-R
  misc_feature: Encodes the peptide sequence at SEQ ID NO. 45514
ttatgttaagcaggtactcgagatcattagcaagggtggtgtgaaaggactggcccacattactggtggtggatttacagacaatattccgagagtgtttccttctggtcttggggcaaaaatttttactggatcatgggaagtgccacctgtcttcaagtggcttcaacaggttggaaacattgatgatgcagagatgcggcggacattcaatatgggcatcggaatggttcttgtagtaagcagagagtcagcagacagaattattgaagacacccatggatcaaatcctgcttatcgcattggagaggtgatcgagggagagggggttcactatgtctgacccgttaagcctcgatagcttgtagcagcttgaggcttcggctggacaaaggagtccagtttctgtaacagcataatcttatggggctatgttctgcagtgtagtggttctacattactactcccacaagaaacgtgggggtatccaaataatgtttaagtggttccatgagaacttgcccctaaacggctgatattattatttggatctacttgagtacttatgggaatgctcagatgtccag

SEQ ID NO: 45514 - protein, 113 aa, Panicum virgatum
  misc_feature: Ceres CLONE 2025451-R
  misc_feature (1)..(113): Pfam Name: AIRS_C Pfam Description: AIR synthase related protein, C-terminal domain
  misc_feature: SWISSPROT Homolog: EC 6.3.3.1 Phosphoribosylformylglycinamidine cyclo-ligase
YVKQVLEIISKGGVKGLAHITGGGFTDNIPRVFPSGLGAKIFTGSWEVPPVFKWLQQVGNIDDAEMRRTFNMGIGMVLVVSRESADRIIEDTHGSNPAYRIGEVIEGEGVHYV

SEQ ID NO: 45515 - DNA, 663 bp, Panicum virgatum
  misc_feature: Ceres CLONE 2025473
  misc_feature: Encodes the peptide sequence at SEQ ID NO. 45516
ggcctgtgaacgcactggtgatagtgtaatcatcagcaagaataatgcatgggaaatcaaagtgaacagtcgactgggaacaatagacagttggaaggtcaacggtgttgagcttatgagcaaggggatattcccatgcttttggcgcgcaccaactgacaacgacaaaggaggtttctacaccaagccctatgtttcgcgatggagagaagcctccctggataacgtctcgttctacagcagccatttctctgtaaaggaattgctggacaacactgtggagctctccaccgtctactatggtcttcctgggaacctacccaagcccgacgatgctgctctttcacaagctcccgagtccactcttttccaggtgaacatgctctgccggatatacgagtcaggcgatgtggttcttgagtacgaggtaaaccccaaagccgatctccctccccttccccgggtgggcgtcgtgttcaacaccgagaaatccctaagccatgtgacgtggtatgggagggggccgttcgagtgctaccccgaccgcaaagccgctgcgcatgtcggcgtgtacgagagcagcgtggatgacctgcacgtgccgtacatcgcccccgtcgagtgcggcggccgggcggacgtccggtggatggcgctccggaa

SEQ ID NO: 45516 - protein, 220 aa, Panicum virgatum
  misc_feature: Ceres CLONE 2025473
  misc_feature (10)..(220): Pfam Name: Bgal_small_N Pfam Description: Beta galactosidase small chain
  misc_feature: SWISSPROT Homolog: EC 3.2.1.23 Beta-galactosidase
ACERTGDSVIISKNNAWEIKVNSRLGTIDSWKVNGVELMSKGIFPCFWRAPTDNDKGGFYTKPYVSRWREASLDNVSFYSSHFSVKELLDNTVELSTVYYGLPGNLPKPDDAALSQAPESTLFQVNMLCRIYESGDVVLEYEVNPKADLPPLPRVGVVFNTEKSLSHVTWYGRGPFECYPDRKAAAHVGVYESSVDDLHVPYIAPVECGGRADVRWMALR

SEQ ID NO: 45517 - DNA, 602 bp, Panicum virgatum
  misc_feature: Ceres CLONE 2025501
  misc_feature: Encodes the peptide sequence at SEQ ID NO. 45518
gcggccttggcagcgggatcggccacggcgttggcggcggctttggcaagggcggcgggatcggcggcggcttcggcaagggcggcgggatcggccatggggtcggcggcggcttcggcaagggcggcggtcttggcggtggaggcggctacggcggtggtgccggcagcggcggcggcggcggcggcaagggcttcgggtttgggtttggcaacggcgccggcttcgacggtggaggcggcggcggcggcggcggcattggcggtcaccactgagagagatactacgccggcacgcgttctccgtagttccatcacttaagctctacatacctcagagcatgcagatcgtgcttttgcagtggtgagactttgcacttctgggttggtctcgttgtgtgtcctgtctgccctccggtttgttggagggatttgttcgtgcttgctttgtactcctactttgattgtatcttttttgttattaattccagtgatggtagtgatggtgatgccagtcacaatatgtacgtacgtatacatgatccctgcatgtaaggctcactgaatgattcgagaaatataaatgaagccatgctttggttg

SEQ ID NO: 45518 - protein, 90 aa, Panicum virgatum
  misc_feature: Ceres CLONE 2025501
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50142
  misc_feature: Useful for making plants with altered lignin content
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50180
  misc_feature: Useful for making plants with altered alkaloid content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50198
  misc_feature: Useful for making plants with altered terpenoid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50179
  misc_feature: Useful for making plants with modulated phosphate use efficiency
  misc_feature: Functional homolog of the protein sequence given in SEQ ID NO 51624
  misc_feature: Useful for making plants with modulated biomass
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
GLGSGIGHGVGGGFGKGGGIGGGFGKGGGIGHGVGGGFGKGGGLGGGGGYGGGAGSGGGGGGKGFGFGFGNGAGFDGGGGGGGGGIGGHH

SEQ ID NO: 45519 - DNA, 533 bp, Panicum virgatum
  misc_feature: Ceres CLONE 2025511
  misc_feature: Encodes the peptide sequence at SEQ ID NO. 45520
ccgagggcgggctcgactacctgggcaaccccaacctggtgcacgcgcagagcattctcgccgtgctcggattccaggtcatcctcatgggcctcgtcgagggcttccgcatcaacggcctcgacgaccccgtcaccttcgctgagctcaaggtcaaggagatcaagaacggccgcctcgccatgttctccatgttcggattcttcgtgcaggccatcgtcaccggcaaggggcccctcgagaacctgctcgaccacctcgacgaccccgtcgccaacaacgcctgggtctacgccaccaagttcgcgcccgggtcttaagctagacggcggcctcttcgtgccggaccaccattgtaggcattacgtttgtaccaccaccaatgaatgcaaatattgccatcgcaggattcaggattgtactggaggagttttggggtttgcattatgctctctgtcagttcagttggacatgtgtgctcctgaaacagatagtgtgcagtttgtgatgtatatatgcagctgcttctttgc

SEQ ID NO: 45520 - protein, 105 aa, Panicum virgatum
  misc_feature: Ceres CLONE 2025511
  misc_feature (1)..(72): Pfam Name: Chloroa_b-bind Pfam Description: Chlorophyll A-B binding protein
EGGLDYLGNPNLVHAQSILAVLGFQVILMGLVEGFRINGLDDPVTFAELKVKEIKNGRLAMFSMFGFFVQAIVTGKGPLENLLDHLDDPVANNAWVYATKFAPGS

SEQ ID NO: 45521 - DNA, 676 bp, Panicum virgatum
  misc_feature: Ceres CLONE 2025522
  misc_feature: Encodes the peptide sequence at SEQ ID NO. 45522
ccaactcgaattgtggatctgacgcccgagccgtgggacacaacgccgcggcccgcccgccccaaccccgaccgaaaacctagctagggttccgccgtcgccgaccccagccggcgtctcctcgcccgcccgcccacccgccgcgatgtacaacggcatcgggctccagaccgcgcgggggtcgggcaccaacgggtacgtccagaccaacaagttcttcatcaagccccgctccaccggcgggccgggcgggccccacaggccgccgctccccgacgccgccgccggggatggcgccgggctcggcgggatgcgcaagcccaacagggacatcctcgagcacgaccgcaagcgccaggtcgagctcaagctgctcgtgctcagggacaccctcgaggagcagggctacacggaggtcgagatcgagctgatggtcgaggatgcgcgctcggccgcggaggccgaggcggcggccgcggccgcggccgaggaggcggggggaggacgcccgtctctaccgggcaccagagggtttaccgacacacaaagccaccatgttgcggcacggaaggagaagcagcttgagactctgagggctgcttttggactggacgctgaggatgtaaagaagggggacgtagaaagtgatgtggaatctggggagcttgtacctggt

SEQ ID NO: 45522 - protein, 176 aa, Panicum virgatum
  misc_feature: Ceres CLONE 2025522
  misc_feature (57)..(101): Pfam Name: cwf21 Pfam Description: cwf21
MYNGIGLQTARGSGTNGYVQTNKFFIKPRSTGGPGGPHRPPLPDAAAGDGAGLGGMRKPNRDILEHDRKRQVELKLLVLRDTLEEQGYTEVEIELMVEDARSAAEAEAAAAAAAEEAGGGRPSLPGTRGFTDTQSHHVAARKEKQLETLRAAFGLDAEDVKKGDVESDVESGELVP

SEQ ID NO: 45523 - DNA, 669 bp, Panicum virgatum
  misc_feature: Ceres CLONE 2025536
  misc_feature: Encodes the peptide sequence at SEQ ID NO. 45524
tcggtcgcctcactgtgctgccgcttcgcataatgtactctggtctccggttcctcagcagctgcggttggatctcagatcggtgatcacataaacaatggtgaaggctgttgctgtgcttggtagcagcgagggtgtcaagggcaccatcaacttcacccaagagggtgatagccccaccactgtcaccggaagtgtctctggcctcaagcctggcctccatgggttccatgtgcatgcacttggtgacacaacaaatggctgcatgtcaactggaccgcattacaaccctgcgggcaaggagcatggagcaccagaagatgagaaccgccatgctggtgacctcggaaatatcacggtcggagatgacggtgttgctaacttcactattactgacagccagatcccactgactgggccaaactcaatcattggcagagctgttgttgttcatgctgatcctgatgatcttggaaagggtgggcacgagctgagcaagagcactggaaacgctggtggccgtgtcgcctgcgggatcatcggactagtgccgaaagcgtcgtcgtcgtcgccccccgccgtcaccactggaccagcctaagcatcctttggatacgtgaaataagagcgcctgatctatgatcggcgtgtttgtgttcgctcctgtag

SEQ ID NO: 45524 - protein, 167 aa, Panicum virgatum
  misc_feature: Ceres CLONE 2025536
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSEGVKGTINFTQEGDSPTTVTGSVSGLKPGLHGFHVHALGDTTNGCMSTGPHYNPAGKEHGAPEDENRHAGDLGNITVGDDGVANFTITDSQIPLTGPNSIIGRAVVVHADPDDLGKGGHELSKSTGNAGGRVACGIIGLVPKASSSSPPAVTTGPA

SEQ ID NO: 45525 - DNA, 651 bp, Panicum virgatum
  misc_feature: Ceres CLONE 2025539
  misc_feature: Encodes the peptide sequence at SEQ ID NO. 45526
atgggcaggactcgcggggaaggagcagcaagcaagcaacaaggtagtcagagcagtgaaaccaatcccaaattccattctcggggtcgaggagggagacaattctaaaggaatcatccaggacatcatagagacggtcaacaagcatcccgatgctgggcgcgcggcgcacgcttacggcatcaagaacgtgcccgtgctggtcttctatgcctcggcaggtccggcgctggtcgccctctatgcgaagcaagggaaggtcagcgctgcccggagagtgtttggttgcttggacgccgaggacgtggtgccctggaatgccatgatcgggggattcgctagtgccgggagggatattgaggcctggaattgcttccgggggatgcgcatggggggtgttcgagggaatgcccgcacagctgtggcagtgctgggtgcttgtgatttggagtccggcaggcaagtccatgggtacatgctgagaagccatggtggtggttccaaaacaattttgtggaatgcgctgatgagcatgtattctcgtgtcggctctgtcaacaatgcggagcaggtgttcatggagattgaacggaagaatgtcatgtcatggaacgtgatgattgggacatttgcgaagaaagggtatggagc

SEQ ID NO: 45526 - protein, 216 aa, Panicum virgatum
  misc_feature: Ceres CLONE 2025539
  misc_feature (103)..(137): Pfam Name: PPR Pfam Description: PPR repeat
WAGLAGKEQQASNKVVRAVKPIPNSILGVEEGDNSKGIIQDIIETVNKHPDAGRAAHAYGIKNVPVLVFYASAGPALVALYAKQGKVSAARRVFGCLDAEDVVPWNAMIGGFASAGRDIEAWNCFRGMRMGGVRGNARTAVAVLGACDLESGRQVHGYMLRSHGGGSKTILWNALMSMYSRVGSVNNAEQVFMEIERKNVMSWNVMIGTFAKKGYG

SEQ ID NO: 45527 - DNA, 699 bp, Panicum virgatum
  misc_feature: Ceres CLONE 2025540
  misc_feature: Encodes the peptide sequence at SEQ ID NO. 45528
ctctctttctcccctatccgcatcgcatcatgggcgcctacaagtatgtccaggaactctggaggaagaagcagtccgacgtgatgcgcttcctcgccaggctcaggtgctgggagtacaggcagtaccccatggttctgcgcgtcagcaggcccagccgccccgacaaggcccgccgtctcggctacaaggccaagcagggcttcgtcatctacagagtgcgcgtccgccgtggtggccgtaagaggaagatcaggaagggtcgcgtccacggtaagcccgccacccagggtgtcaacgccctcaagttccagaggtccctccgttccgtcgctgaggagcgtgctggccgtcgctgcggcaacctccgcgtcctgaactcttactgggttgcccaggatgccaccttcaagttcttcgagatcatcctcgtggatcccttccacaaggccgtccgtcgcgaccccaagatgaactggatcgccgcccccacccacaagcaccgcgagatgaggggtctgacctccgctggcaagaagtacaggggtctccgtggcaagggtcacaactacaccaagtccaggccctcgaggcgcgccgtctggaagaggaacaacaaggtctcgctcaggcgttaccgttaaacctcgtcgttgtagcttatgctgcttccaaccaccctggtgggatttgttgttg

SEQ ID NO: 45528 - protein, 204 aa, Panicum virgatum
  misc_feature: Ceres CLONE 2025540
  misc_feature (2)..(193): Pfam Name: Ribosomal_L15e Pfam Description: Ribosomal L15
MGAYKYVQELWRKKQSDVMRFLARLRCWEYRQYPMVLRVSRPSRPDKARRLGYKAKQGFVIYRVRVRRGGRKRKIRKGRVHGKPATQGVNALKFQRSLRSVAEERAGRRCGNLRVLNSYWVAQDATFKFFEIILVDPFHKAVRRDPKMNWIAAPTHKHREMRGLTSAGKKYRGLRGKGHNYTKSRPSRRAVWKRNNKVSLRRYR

SEQ ID NO: 45529 - DNA, 501 bp, Panicum virgatum
  misc_feature: Ceres CLONE 2025546
  misc_feature: Encodes the peptide sequence at SEQ ID NO. 45530
tctttctctcgccagcaccatcaccatcgcagcctcttgatcatcaccgtcgtctgctgctcggcaatcctgcccgactgacttgctagtagtctacttcagccgtctacaccccacgatgcgagtaccgagcttcttgttggccctgctgcttgtcctggccgccgtgtgcttggtggtctacgctgaacccgaggaggaggaccaaacggccttgtacgccgagctgctgggcccgagcaactgccgcatggccaagtaccctggcgtgcgcgagttccgcgagctggacctcgacgagtacaaggaactcaagttccgcggcggctacgtctcggtgcctcggctcgtgttctacaacaaggacgacatcccgatcgcgcgctacgagttcaccgaggacacgacggccgaggagatctcggagctgatgaagaagcacaacgtccaatagagcaagcgcgtgtgtgtgcatgtacacgcgtgagctactataccccc

SEQ ID NO: 45530 - protein, 111 aa, Panicum virgatum
  misc_feature: Ceres CLONE 2025546
  misc_feature (34)..(111): Pfam Name: Sep15_SelM Pfam Description: Sep15/SelM redox domain
MRVPSFLLALLLVLAAVCLVVYAEPEEEDQTALYAELLGPSNCRMAKYPGVREFRELDLDEYKELKFRGGYVSVPRLVFYNKDDIPIARYEFTEDTTAEEISELMKKHNVQ

SEQ ID NO: 45531 - DNA, 676 bp, Panicum virgatum
  misc_feature: Ceres CLONE 2025550
  misc_feature: Encodes the peptide sequence at SEQ ID NO. 45532
tggatctccttcttccaaaactccattgcatcagtgttcagctgtctcactccctgctcactctgctccaccatgaggcaagaagggagccctttggacctgaacaacttgccggaggagtacggcaagcaagcggtggagagctccacgaccaccgccacatcaagcgccgatgcagttcggatcaagaagaagagcggcggagggaaggatgatgctgccaaggtgtatgaatgccggttttgttccctcaagttctgcaagtctcaagcgctcggcggccacatgaaccggcatcgtcaaggcaagattatatcatacacaagaaccctagctaattgcgcctagcttggtcacatcttcttccaattttatgggtgattgatttctggggtttcttccagagagggagactgaaaccctcaaccgtgcccggcaactcgtcttcggcaacgagaccctcgccgccgtcggcgcgcagatgagtttcagggatgtcaatttgggaggccctgccccctcgaccatgctaggaggaggcttccggggagtcgccaccggcggcagcgtcatcggcgacccgtgcgtcccgttgcggccggttcatccgcggccgcagtaccattacctctacacggcggcgccaccatccacactgcacccaatgagctacccg

SEQ ID NO: 45532 - protein, 91 aa, Panicum virgatum
  misc_feature: Ceres CLONE 2025550
  misc_feature: Functional homolog of the protein sequence given in SEQ ID NO 51708
  misc_feature: Useful for making plants with altered lignin content
MRQEGSPLDLNNLPEEYGKQAVESSTTTATSSADAVRIKKKSGGGKDDAAKVYECRFCSLKFCKSQALGGHMNRHRQGKIISYTRTLANCA

SEQ ID NO: 45533 - DNA, 694 bp, Panicum virgatum
  misc_feature: Ceres CLONE 2025570
  misc_feature: Encodes the peptide sequence at SEQ ID NO. 45534
ggttctgaattcagaactcgggtgacgcctgaggctagcaagatggggttctccttcttcttcaccagtcgagccgctgctcggttcttggacgggatcgggcgccccggcgtctccaccgcagcactgctccttacagcagccagtggcggaggccttgtggcctatgctgattccgctgcagaaagtgctccggagccatcccaggatgcccccaagaagaaggtgctggttcttgggactggctgggctgggacgtcgtttctcaagaacctcgactgctcccgatatgaagtgaaggtcatatcgccccgtaactacttcgcgtttacacctctgcttccaagtgtcacatgtgggactgtcgaaccacgcagcattattgaacccataaggcggatgtttgagaagaaaagtaaggacgttacattttgtgaagccgagtgtttcaagattgatgcaagtaaaaaaattgtacactgtcgttcagctgttggaactaatcttgatgggaatggcgattttacgcttgattatgattacttagttgttgctcttggagctactgtaaatacatttaacactcctggagtcttggagcactgccacttcttgaaggaagtagaggatgctcagaagatacgaaggagtgtgatagactgctttgaaaaagcgtcacttccaaatattagtg

SEQ ID NO: 45534 - protein, 217 aa, Panicum virgatum
  misc_feature: Ceres CLONE 2025570
  misc_feature (61)..(217): Pfam Name: Pyr_redox_2 Pfam Description: Pyridine nucleotide-disulphide oxidoreductase
  misc_feature: SWISSPROT Homolog: EC 1.6.5.3 NADH dehydrogenase (ubiquinone)
MGFSFFFTSRAAARFLDGIGRPGVSTAALLLTAASGGGLVAYADSAAESAPEPSQDAPKKKVLVLGTGWAGTSFLKNLDCSRYEVKVISPRNYFAFTPLLPSVTCGTVEPRSIIEPIRRMFEKKSKDVTFCEAECFKIDASKKIVHCRSAVGTNLDGNGDFTLDYDYLVVALGATVNTFNTPGVLEHCHFLKEVEDAQKIRRSVIDCFEKASLPNIS

SEQ ID NO: 45535 - DNA, 602 bp, Panicum virgatum
  misc_feature: Ceres CLONE 2025573
  misc_feature: Encodes the peptide sequence at SEQ ID NO. 45536
aacaaacgctaaaaaagtaacagtttctgtactttattgagctgcccggcatgacgaagaagcacgagtcgaagtactacaagccccgtgccctcgacgttgcgcaccagacggagcgcgcgtaccagcgccagacggccgtgaatgagaactctcgcgccccggccaagaagttcctcaacaacgctggccgcatccgctacgtgaagagcgtcggcctgggcttcaagacgcccaaggccgccgttgagggcaagtacgtcgaccagaagtgcccgttcactggcaacgtgtcgatccgcggccgcatcatccgcgcccaggttcgctcgacgaagatgaagcgttccatcgtgatccgtcgcaactacctgcacttcatcaacaagtaccagcgttaccagaagcgccacaagaacttcactgttcactgctccccgtgcttcgagccggctgttggcgacagcgtgatcgtcggccagtgccgcccgctcagcaagaccatccgctacaacgtcctgcaggtcgtgtcgcgcaagggtggcaagaagttcgacaagaactgagtgtgttgagcagctttcaccgacctctctgcattg

SEQ ID NO: 45536 - protein, 171 aa, Panicum virgatum
  misc_feature: Ceres CLONE 2025573
  misc_feature (91)..(159): Pfam Name: Ribosomal_S17 Pfam Description: Ribosomal protein S17
MTKKHESKYYKPRALDVAHQTERAYQRQTAVNENSRAPAKKFLNNAGRIRYVKSVGLGFKTPKAAVEGKYVDQKCPFTGNVSIRGRIIRAQVRSTKMKRSIVIRRNYLHFINKYQRYQKRHKNFTVHCSPCFEPAVGDSVIVGQCRPLSKTIRYNVLQVVSRKGGKKFDKN

SEQ ID NO: 45537 - DNA, 438 bp, Panicum virgatum
  misc_feature: Ceres CLONE 2025575
  misc_feature: Encodes the peptide sequence at SEQ ID NO. 45538
agcagattagcacgcaacttcctatcctccggcgatggcgacgcaggatgacaaagatgctgctgctcccgcggaggagggccccgccgcggccgagccgtcggcgcctgcggcgagggtgaaggtgctcttcttcgcccgcgcgcgggacctgacgggcgtggcggagtcgtcggtggaggtgccggcgggaggcaccgcgggggaatgcctcgcccgggtgctggccaagttccccaagctggaggagatccgcggctccatggtgctcgcgctcaacgaggagtacgcgccagactccgccaaggtcgccgacggcgacgagctcgccgtcataccgcctatcagcggcggctgatgttgccacgaacgagttggagagaggaaaaaaagaaacaaagaataaaagaaaagaaaagaaaggttcattttgcttcc

SEQ ID NO: 45538 - protein, 107 aa, Panicum virgatum
  misc_feature: Ceres CLONE 2025575
  misc_feature (31)..(107): Pfam Name: ThiS Pfam Description: ThiS family
MATQDDKDAAAPAEEGPAAAEPSAPAARVKVLFFARARDLTGVAESSVEVPAGGTAGECLARVLAKFPKLEEIRGSMVLALNEEYAPDSAKVADGDELAVIPPISGG

SEQ ID NO: 45539 - DNA, 653 bp, Panicum virgatum
  misc_feature: Ceres CLONE 2025586
  misc_feature: Encodes the peptide sequence at SEQ ID NO. 45540
actccattgtccattccccctcgccttgctccagcttcgctctcctcgaagaagaagacgcctccgccttcgccgatggccatggcgacacaagcctccgccgcgacgcgccacctgctggcctggtcgccggccaaggcgccgcgtgcgccgtcccaggtcgcgctcccgtcttcttcccgcggtccggccccgctccgtgcggcggcggaggaggcggtgaccgaggaggcgcccaagggtttcgttcccccgcagctggaccccaacacaccgtccccgatcttcggcggcagcacggggggtctcctccgcaaggcgcaggttgaggagttctacgtgatcacgtggacgtcccccaaggagcaggtgttcgagatgcccaccggcggcgccgccatcatgcgggaagggcccaacctcctgaagctggcgcgcaaggagcagtgcctcgcgctgggcaccaggctccggtccaagtacaagatcaactaccagttctaccgcgtcttccccaacggcgaggtccagtacctccaccccaaggacggcgtctacccagagaaggtcaacgccggcaggcagggagtgggccagaacttccgcagcatcggcaagaacgtcagccccatcgaggtcaagttcaccggcaa

SEQ ID NO: 45540 - protein, 192 aa, Panicum virgatum
  misc_feature: Ceres CLONE 2025586
  misc_feature (60)..(192): Pfam Name: PsaD Pfam Description: PsaD
MAMATQASAATRHLLAWSPAKAPRAPSQVALPSSSRGPAPLRAAAEEAVTEEAPKGFVPPQLDPNTPSPIFGGSTGGLLRKAQVEEFYVITWTSPKEQVFEMPTGGAAIMREGPNLLKLARKEQCLALGTRLRSKYKINYQFYRVFPNGEVQYLHPKDGVYPEKVNAGRQGVGQNFRSIGKNVSPIEVKFTG

SEQ ID NO: 45541 - DNA, 703 bp, Panicum virgatum
  misc_feature: Ceres CLONE 2025587
  misc_feature: Encodes the peptide sequence at SEQ ID NO. 45542
aacgaacgctaaaaaagtaacagtttctgtactttattggtggagtaaaccatgtccgctgagggcaccgtgacgaagaaggacgcgaacccgatgcgcgagctgcaggtgcagaagctgtgcatcaacatctgcgtcggcgagtccggcgatcgcctcacccgtgcggcgaaggtgctcgagcagctgtgcggccagacccccgtgctgacccgcgccaagctgaccgtgcgtacgttcggcatccgccgtaacgagaagatcgcgtgctgctgcaccgtccgcggtgagaaggccgccgagctcctcgagaagggcctgaaggtcaaggagttcgagctccgcgcgtacaacttcgctcaggacggctcgttcggcttcggcatcaacgagcacatcgacctcggcatcaagtacgacccgtcgactggtatctacggtatggacttcttcgtcgtgctctcccgccgcggcggtcgcgtcgcgaagcgcaagcacgcgcgcgccaccgttggccgctcgcaccgcgtgacccgcgagcacgcgatcaactggttccagaagacgtacgacggcatcgtcttcccgggcagaagaagcgcacgagcagcggctggaagggcaagaaggggaagaagtaamgactttcctgactgcagccatgaacagctacccaccattctcgatcccccaagttctctcg

SEQ ID NO: 45542 - protein, 217 aa, Panicum virgatum
  misc_feature: Ceres CLONE 2025587
  misc_feature (70)..(169): Pfam Name: Ribosomal_L5_C Pfam Description: ribosomal L5P family C-terminus
  misc_feature (13)..(66): Pfam Name: Ribosomal_L5 Pfam Description: Ribosomal protein L5
  misc_feature (197)..(197): Xaa is any aa, unknown, or other
MSAEGTVTKKDANPMRELQVQKLCINICVGESGDRLTRAAKVLEQLCGQTPVLTRAKLTVRTFGIRRNEKIACCCTVRGEKAAELLEKGLKVKEFELRAYNFAQDGSFGFGINEHIDLGIKYDPSTGIYGMDFFVVLSRRGGRVAKRKHARATVGRSHRVTREHAINWFQKTYDGIVFPGRRSARAAAGRARRGRSXDFPDCSHEQLPTILDPPSSL

SEQ ID NO: 45543 - DNA, 648 bp, Panicum virgatum
  misc_feature: Ceres CLONE 2025641
  misc_feature: Encodes the peptide sequence at SEQ ID NO. 45544
gacgagaagaaggacccctacgcggacctgtacgtggtgcggtggacgtggctgatggtcacgcccatcatcatcatcctcgtcaacatcatcggctccgcggtggccttcgccaaggtgctcgacggcgagtggacgcactggctcaaggtggccggcggcgtcttcttcaacttctgggtgctcttccacctctaccccttcgccaagggcctcctcgggaggcacggcaagacccccgtggtggtgctcgtctggtgggccttcaccttcgtcatcaccgccgtgctctacatcaacatcccccacatccacgggcccggcggcaagcacggcgctcacggcggcaggcactcctcccaccaccacgccggcaacagcctgcacttcacggtctggccgtaggagggatgcgtcgagcacatacataccaggcccccaacattgattcatcgaccagaccgaccaccgtgaagagaagagtacgttccgttccgttccagtccattccgttccgttctgctgctgcttctgctgctgctggtgaagctagactgctacgtacaacatgcgaccgacgacgtacccgccaccacaatttgatttcttcttttttttctttctagttttgtccagaaattgaaaaga

SEQ ID NO: 45544 - protein, 134 aa, Panicum virgatum
  misc_feature: Ceres CLONE 2025641
  misc_feature: SWISSPROT Homolog: EC 2.4.1.12 Cellulose synthase (UDP-forming)
  misc_feature: Functional homolog of the protein sequence given in SEQ ID NO 50125
  misc_feature: Useful for making plants with modulated plant growth and development
  misc_feature: Functional homolog of the protein sequence given in SEQ ID NO 50743
  misc_feature: Useful for making plants with altered cell wall content and/or composition
DEKKDPYADLYVVRWTWLMVTPIIIILVNIIGSAVAFAKVLDGEWTHWLKVAGGVFFNFWVLFHLYPFAKGLLGRHGKTPVVVLVWWAFTFVITAVLYINIPHIHGPGGKHGAHGGRHSSHHHAGNSLHFTVWP

SEQ ID NO: 45545 - DNA, 747 bp, Panicum virgatum
  misc_feature: Ceres CLONE 2025653
  misc_feature: Encodes the peptide sequence at SEQ ID NO. 45546
aaaaaaaaaaaaactagctagacaacacaagcatcgtcatcaatggcggcgtcccgtgctgcctcttcggtgtcggtggtcctcttcctcgtcctcgccgccttcgctgccggcgccagcgcggccaccttcaacataaagaataactgcggctacacggtgtggccggcgggcatcccggtgggcggtggcacgcagctggacccaggccagacgtggaccgtcgacgtgcccgccggcacgagcggcaggttctggggccgcaccggctgctccttcaacggcgggagcggccactgcgacagcgccgactgcgccggggcgctgtcctgcacggtctccgggcagccgccggcgacgctggccgagttcaccgtcggcggcgcccaggacttctacgacatctcgctggtagacggcttcaaccaggccatggacttctcgtgcagcaccggcgtgaacctgcactgcggtggccctggatgccccgacgcctacctcttccccaacgatgacaccaagacccatgcgtgtgccggcaacagcaactaccaggtcaccttctgcccatgatcaggccgtcagctggtcgtcgaacgaacgatgcatatatacatgatgataatatatgtactactatatatagtggagaataattaagctgatgatgatgaataaggcgatcgatgtcgtgaaataaaagtcgtcgcccacgcgcgtgcatgcatgattgaaactggattatgt

SEQ ID NO: 45546 - protein, 176 aa, Panicum virgatum
  misc_feature: Ceres CLONE 2025653
  misc_feature (34)..(176): Pfam Name: Thaumatin Pfam Description: Thaumatin family
MAASRAASSVSVVLFLVLAAFAAGASAATFNIKNNCGYTVWPAGIPVGGGTQLDPGQTWTVDVPAGTSGRFWGRTGCSFNGGSGHCDSADCAGALSCTVSGQPPATLAEFTVGGAQDFYDISLVDGFNQAMDFSCSTGVNLHCGGPGCPDAYLFPNDDTKTHACAGNSNYQVTFCP

SEQ ID NO: 45547 - DNA, 652 bp, Panicum virgatum
  misc_feature: Ceres CLONE 2025656
  misc_feature: Encodes the peptide sequence at SEQ ID NO. 45548
ggacgccgttcacgcacgccgacgagatcacggcggacgcgcacggcacgctggtctccgagaacacgctcgccatctaccacgaccactacgtcacgtaccacctggacgtcgacgtcgacggcaccaacaactccttcgtcaagaacgtcatcaccaccaggcgcaacaccggggatcccgccaccagcggcgccgacacgccgaggcggagctactggacggtgcggcgcgaggtggccgagaccgaggcggacgggcaggtggacgtcgacgccgggcccgccgacctggtgttcgtgaatccgggcaagaagacccggctgggcaacgaggtcgggtaccggctcatcccggccggcgcgacggcggcgtccgtgctggccgacgacgactacccgcagcggcgggcgagctacacgaagaagcaggtgcgggtgacgccgtacagcaagccggagaagtgggcgcccgggctgtacgccgaccagagcaccggcgacgacggcctggccgcgtggagcgggaggaacagggggatcagggacgaggacctcgtgctgtggcacacgctggggctccaccacatcccgtaccaggaggacttcccggtgatgccgacgctcagcggcgggttcgagctccggccgtc

SEQ ID NO: 45548 - protein, 216 aa, Panicum virgatum
  misc_feature: Ceres CLONE 2025656
  misc_feature (2)..(216): Pfam Name: Cu_amine_oxid Pfam Description: Copper amine oxidase, enzyme domain
  misc_feature: SWISSPROT Homolog: EC 1.4.3.6 Amine oxidase (copper-containing)
TPFTHADEITADAHGTLVSENTLAIYHDHYVTYHLDVDVDGTNNSFVKNVITTRRNTGDPATSGADTPRRSYWTVRREVAETEADGQVDVDAGPADLVFVNPGKKTRLGNEVGYRLIPAGATAASVLADDDYPQRRASYTKKQVRVTPYSKPEKWAPGLYADQSTGDDGLAAWSGRNRGIRDEDLVLWHTLGLHHIPYQEDFPVMPTLSGGFELRP

SEQ ID NO: 45549 - DNA, 410 bp, Panicum virgatum
  misc_feature: Ceres CLONE 2025658
  misc_feature: Encodes the peptide sequence at SEQ ID NO. 45550
ggactccgttcccgcacgccgaccagatcacggcggacgcgcacggcacgctgggctccgagaacacgctcgccatctaccatgaccactacgtcacgtatcccctggacgccgacgtcgacggcaccaccaactccttcgtcaagaacgtcatcaccaccaggcgcaacgccggggatcccgccgccagcggcgccgacaccccgaggcggatctactggacggtgcggcgcgaggtggcccagaccgaggcggacgggccggtggacgtctaccccgggaccgcctacctgcggttcgatgaatccgggcaataagacccggctgggcaacgaagtcgggtacccgctcatcacggctggcgcgacggcggtcttccgtgctggccaaatgacaactacgcgcagcgg

SEQ ID NO: 45550 - protein, 104 aa, Panicum virgatum
  misc_feature: Ceres CLONE 2025658
  misc_feature: SWISSPROT Homolog: EC 1.4.3.6 Amine oxidase (copper-containing)
TPFPHADQITADAHGTLGSENTLAIYHDHYVTYPLDADVDGTTNSFVKNVITTRRNAGDPAASGADTPRRIYWTVRREVAQTEADGPVDVYPGTAYLRFDESGQ

SEQ ID NO: 45551 - DNA, 478 bp, Panicum virgatum
  misc_feature: Ceres CLONE 2025672
  misc_feature: Encodes the peptide sequence at SEQ ID NO. 45552
gctagcaatagcaatttagcaaagcttacaggagaagagaagaagacaaggcggcggcggcggcgcggggatgggtcgcggtggcgggatggggaaccccgtcaacgtgggcatcgccgtgcaggcggactgggagaaccgcgagttcatctccaacatctccctcaacgtccgccgactcttcgacttcctcctcagattcgaagctaccacgaagagcaagctggcatctttgaacgagaagctagacatcctagagaggaagctggaggtgcttgaagtccaagtgagcagcgcaacgaccaatccttcggtcttcaactagaagacacggtggtgtgctgcgtgaacgtgtatcatgtacgtacgtaagtaagagtggcatgtaaaacacactgctgctagtatcatgtgttttgtacaattgtaaaacacttgtgcatcgaagttgacttgcaagcagcttcgcgtttgcgtg

SEQ ID NO: 45552 - protein, 84 aa, Panicum virgatum
  misc_feature: Ceres CLONE 2025672
  misc_feature: Functional homolog of the protein sequence given in SEQ ID NO 51709
  misc_feature: Useful for making plants with modulated nitrogen use efficiency
MGRGGGMGNPVNVGIAVQADWENREFISNISLNVRRLFDFLLRFEATTKSKLASLNEKLDILERKLEVLEVQVSSATTNPSVFN

SEQ ID NO: 45553 - DNA, 689 bp, Panicum virgatum
  misc_feature: Ceres CLONE 2025673
  misc_feature: Encodes the peptide sequence at SEQ ID NO. 45554
gcgaccccaggtcagacgggatcacccgctgagtttaagcatataaataagcggaggagaagaaacttacaaggattcccctagtaacggcgagcgaaccgggaccagcccagagcttgccgaaaggaaacaatgcaaatcttcgtcaaaacccttacaggaaagactatcactcttgaggtcgaaccagccgacagtatcgataacgtcaaacaaaagatccaagacaaggaaggaattcctccagatcaacaacgtcttatttttgctggaaaacaattggaagatggtcgtactctctctgactacaacatccaaaaagaatcaactcttcacttggtcctcagattacgaggaggaatgcaaatcttcgtaaaaacccttaccggaaagaccatcacacttgaagttgaacctgctgattcaattgataacgtcaaacaaaaaatccaagataaagaaggaatcccaccagatcaacaaagattgatttttgctggaaaacaattagaagacggccgaactctttctgactacaacattcaaaaagagtcaactctccatttagttcttcgtcttcgaggaggaatgcaaatcttcgtcaagacattgactggaaaaaccatcactcttgaggtcgaaccagctgactcaattgataacgttaaacaaaagattcaagataaaga

SEQ ID NO: 45554 - protein, 185 aa, Panicum virgatum
  misc_feature: Ceres CLONE 2025673
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVEPADSIDNVKQKIQDKEGIPPDQQRLIFAGKQLEDGRTLSDYNIQKESTLHLVLRLRGGMQIFVKTLTGKTITLEVEPADSIDNVKQKIQDKEGIPPDQQRLIFAGKQLEDGRTLSDYNIQKESTLHLVLRLRGGMQIFVKTLTGKTITLEVEPADSIDNVKQKIQDK

SEQ ID NO: 45555 - DNA, 534 bp, Panicum virgatum
  misc_feature: Ceres CLONE 2025696
  misc_feature: Encodes the peptide sequence at SEQ ID NO. 45556
aaattccaatcaaacaaatttaaagctaaacaataaaatggctgctttccaccaacttgacaagcaaacccacgacgaatacgcccttaccttcgctgccctcctcctccacgacgaaggtctcgaaattaccgctgacaagctcaagaagttgatcgaagcctccggtaataaagtcgaatctttctggcctggtctctacgctaaggccctccaaggcagaaaaattgacgatatcctcagtggaggtggtgctgcccctgctcccgccgccggtgctgctgctggtggtgctgctgctgaaaagaaggctgaagcccccaagaaggaagaaaagaaagaagaagaagctgatgttggtcttggtggaggtcttttcggtgatgatgaggacttctaatcctgattttattcattcattggaatataatcttcatgttgtacaagagcatatatatatacactgagaaacgaacaactagaattaagacttgagcgatctcccattgatagagtttgttagctgcatgcctt

SEQ ID NO: 45556 - protein, 120 aa, Panicum virgatum
  misc_feature: Ceres CLONE 2025696
  misc_feature (30)..(114): Pfam Name: Ribosomal_60s Pfam Description: 60s Acidic ribosomal protein
MAAFHQLDKQTHDEYALTFAALLLHDEGLEITADKLKKLIEASGNKVESFWPGLYAKALQGRKIDDILSGGGAAPAPAAGAAAGGAAAEKKAEAPKKEEKKEEEADVGLGGGLFGDDEDF

SEQ ID NO: 45557 - DNA, 531 bp, Panicum virgatum
  misc_feature: Ceres CLONE 2025706
  misc_feature: Encodes the peptide sequence at SEQ ID NO. 45558
acgccgccactcctcccaaccctagctgagcggaggagcaacagcgcaggaatggggaagggtacgggcagcttcggcaagcgccggaacaagacgcacacgctctgcatccgctgcggccgccggagcttccacctccagaagagcacctgctcctcctgcggctaccccgccgcccgcatccgcaagtataactggagtgtgaaggccatccggcgcaagaccactggaaccgggaggatgaggtacctccgacacgtgcctcgccgtttcaagagcaacttcagagaaggtaccgaggctacccccaagaaggctgctgctgcttccaactaggtcttgatgttgccatcaagaaccgcagaagctagaaattggaaccttttttggctgagttgtacagtccgaactatttagacttactatggaagtattggtttgtcgttctttaaattcaagtcagacgaacatctgaatttgttgctccatggtttaatatatctttcttggtgagcagtgcatgcattacag

SEQ ID NO: 45558 - protein, 94 aa, Panicum virgatum; identical to SEQ ID NO: 15502
  misc_feature: Ceres CLONE 2025706
  misc_feature (2)..(55): Pfam Name: Ribosomal_L37e Pfam Description: Ribosomal protein L37e

SEQ ID NO: 45559 - DNA, 632 bp, Panicum virgatum
  misc_feature: Ceres CLONE 2025714
  misc_feature: Encodes the peptide sequence at SEQ ID NO. 45560
ctcttctccttgtagtctaaaatgggtattgatctcaaaaagcaccacgtcaagaactccaaccgtactgctcccaagtctgacaatgtctacttggccttgttggttaagctctaccgtttccttgctcgtcgtactgatgccaacttcaacaaggttgtcttgaagcgtctctttatgtctcgcgtcaaccgtcctcccgtcactgtttctcgcattgtcaagaacaacaaggaaggtaagaccgttgttgttgtcggttccgtcaccgatgactctcgtcttttggacctccccaagctctctgttgctgcccttcacttcaccaagaccgccaaggcccgtatcttgaaggctggtggtgaggttttgaccttggatcaattggctctccgtgcccccactggtgccaacaccatcctcgtccgtggtgctaagaactctcgcgagtccgtcaagcacttcggtatgggtccccataagaacaagaagcccttcgttcgttccaagggtcgcaagttcgaacgtgctcgtggtaagcgtgcttctcgtggtttcaaggtttaaacaaactacaaatctccctgcccctgttttttattgtttgaagaaaataaaaacaaatataaatc

SEQ ID NO: 45560 - protein, 181 aa, Panicum virgatum
  misc_feature: Ceres CLONE 2025714
  misc_feature (11)..(179): Pfam Name: Ribosomal_L18e Pfam Description: Eukaryotic ribosomal protein L18
  misc_feature: Functional homolog of the protein sequence given in SEQ ID NO 50173
  misc_feature: Useful for making plants with modulated nitrogen use efficiency
MGIDLKKHHVKNSNRTAPKSDNVYLALLVKLYRFLARRTDANFNKVVLKRLFMSRVNRPPVTVSRIVKNNKEGKTVVVVGSVTDDSRLLDLPKLSVAALHFTKTAKARILKAGGEVLTLDQLALRAPTGANTILVRGAKNSRESVKHFGMGPHKNKKPFVRSKGRKFERARGKRASRGFKV

SEQ ID NO: 45561 - DNA, 573 bp, Panicum virgatum
  misc_feature: Ceres CLONE 2025716
  misc_feature: Encodes the peptide sequence at SEQ ID NO. 45562
atccgtccagccatccatcaagccattcatcgcaccacttctaccccaacgtgtcgccgctggtgttccagctcctcatcaagccgctcctgggcggcgccccggaccccgtggtcgtcgacaagcacgcgcaccagctcgccaaggtgctcgacgtctacgaggcgcacctcgccggcaacaagtacctcgccggcgacgagttctcgctcgccgacgccaaccacatgtcctacctcttctgcctcagcaagacccccaaggcgggcctcgtcgacgagaggccccacgtcaaggcctggtgggaggacatcgccgcccgccccgccttcaagaagaccgtcgccgccatccccctgccgccgccgccgccgtccgcctgagctcaaagcttaattagctaggtggtggtacatcatccgttgaataaaaacaaaaactgcgcgttggattgggtgtgctcaattatgtgaaagagcgcggtgatgtggaatttgcctttaatttactcctcactcctcagatattattctcttcgtgctggcttctagtaattgttcgtgtgattagcgg

SEQ ID NO: 45562 - protein, 126 aa, Panicum virgatum
  misc_feature: Ceres CLONE 2025716
  misc_feature (13)..(108): Pfam Name: GST_C Pfam Description: Glutathione S-transferase, C-terminal domain
  misc_feature: SWISSPROT Homolog: EC 2.5.1.18 Glutathione transferase
PSSHPSSHSSHHFYPNVSPLVFQLLIKPLLGGAPDPVVVDKHAHQLAKVLDVYEAHLAGNKYLAGDEFSLADANHMSYLFCLSKTPKAGLVDERPHVKAWWEDIAARPAFKKTVAAIPLPPPPPSA

SEQ ID NO: 45563 - DNA, 415 bp, Panicum virgatum
  misc_feature: Ceres CLONE 2025722
  misc_feature: Encodes the peptide sequence at SEQ ID NO. 45564
gattcaacgcgtacatactcttcgccatctttgtggttggagttgctgctgctgtagcactgcattaccaccgtttgggtgccagcctataacactgaatcggcatacaccggcatgcttagttttagctgcagaggtctgtggtatcggcttgggcaattctataccagtaggatgtttggaacggtagtagcatcttcccgtcttcatccttgcagtagtttgttgacttcacttacttgcattgaactggaatagtaattgagttcctcagcttatgtcactggggttgctggctttttgtggacattggtgcaaccactgaccccagccgtctccaccagttttttttatggtgatgtacatatggagttctttctttttgttcggctagctactactatgtgtgcctatc

SEQ ID NO: 45564 - protein, 62 aa, Panicum virgatum
  misc_feature: Ceres CLONE 2025722
  misc_feature: SWISSPROT Homolog: EC 3.1.1.4 Phospholipase A(2)
IQRVHTLRHLCGWSCCCCSTALPPFGCQPITLNRHTPACLVLAAEVCGIGLGNSIPVGCLER

SEQ ID NO: 45565 - DNA, 660 bp, Panicum virgatum
  misc_feature: Ceres CLONE 2025726
  misc_feature: Encodes the peptide sequence at SEQ ID NO. 45566
acacaaccaaccacactagcactgagctagctagctagctaccagccaagatggcggccaagcgtctggcgcttgccatcctcgtcctccttagcgtaggcatggtggccgctgctgctggcacccgcaagctgggctatggtcccggaggaggaggaggcggtggcggtagcggtggaggcggagggggtggctatgggggatcaggctatgggtccgggtcagggtacggtgagggcggtggaagtgggggtgctgctggtgggtacggacatggcggtggcggcggaggcggcggcggtgagggcggcggtgctggcggctctgggtatgggtctggccaaggctctggctatgggtccggcagtggtggtgctggtgggtatggaagtggtggaggcggcggaggtggcggcggccaaggtgggtcgggtcatggctccggctccgggtacggatcaggtgaagggtatgggcagggtggagctcatggaggaggctatggcagtggcggcggtggtggcggcggcggcggccaaggtggtggctctggctatggctccggctccggctccgggtatggttctggtggtggacacaactaagctcagcttcagagccaactacagagtagctcagcttcggagccaactacagagt

SEQ ID NO: 45566 - protein, 184 aa, Panicum virgatum
  misc_feature: Ceres CLONE 2025726
  misc_feature (1)..(98): Pfam Name: GRP Pfam Description: Glycine rich protein family
  misc_feature: Functional homolog of the protein sequence given in SEQ ID NO 50431
  misc_feature: Useful for making plants with altered alkaloid content
MAAKRLALAILVLLSVGMVAAAAGTRKLGYGPGGGGGGGGSGGGGGGGYGGSGYGSGSGYGEGGGSGGAAGGYGHGGGGGGGGGEGGGAGGSGYGSGQGSGYGSGSGGAGGYGSGGGGGGGGGQGGSGHGSGSGYGSGEGYGQGGAHGGGYGSGGGGGGGGGQGGGSGYGSGSGSGYGSGGGHN

SEQ ID NO: 45567 - DNA, 543 bp, Panicum virgatum
  misc_feature: Ceres CLONE 2025758
  misc_feature: Encodes the peptide sequence at SEQ ID NO. 45568
aattttagatttaaaaaaggaaaaagcaagttacgttaatatttttgtttatttgcaatgccaggcactctgattttcaaaccgattcaggctcacttcaaaaaagatgatgatgatagtcaggataaaattgatccttatgtaaagtttaaagtggggcgtcattcaaaaaaaacatctgtcatcaaagatataccattaggatcccaagctgaatggatagaaccggtcaagtttgaaagaaaggatggtgaaaaaagagctaagctccaagttaaagaccatagacttctcaaagacagttttgttggagaagcagaaattgacttgagtttgcttggagcctcaaataagatgacgcaatggtttaaactggaagacgataaggaggtaacaggagaaattcttgttgaaattgagtatctaccccattcctaaaatatttggataatattattttctagttataagaagtttataaattaaattatataattaatacaagatatttcttgttatgcatactcaatatttttgagtggc

SEQ ID NO: 45568 - protein, 126 aa, Panicum virgatum
  misc_feature: Ceres CLONE 2025758
  misc_feature (5)..(88): Pfam Name: C2 Pfam Description: C2 domain
MPGTLIFKPIQAHFKKDDDDSQDKIDPYVKFKVGRHSKKTSVIKDIPLGSQAEWIEPVKFERKDGEKRAKLQVKDHRLLKDSFVGEAEIDLSLLGASNKMTQWFKLEDDKEVTGEILVEIEYLPHS

SEQ ID NO: 45569 - DNA, 414 bp, Panicum virgatum
  misc_feature: Ceres CLONE 2025767
  misc_feature: Encodes the peptide sequence at SEQ ID NO. 45570
aaatggtaccgttcgcatccaaggcaagtgtgctgggggtgaacgcagggttggaatttacaggatggagagaggcgtggacaaatggacagtcaattgctcttgtggagccacggatgatgatggtgagaggatgctatcttgtgactcttgccatgtgtggcggcacactaggtgtgctggtattagtgattttgatcaggtgccaaagcgatatgtatgtaaatcatgtaaatttctcaacaagcctaagaggcctaggccagtttatagtaatggccttaacaaaagatgtaagactggcacaggtgccttaagccttgcaggtgggggatttttgaagcctcacatcttttgagttttgacatgtacatatctgtaacaattgagtgaatatgagacatgtcaaatttt

SEQ ID NO: 45570 - protein, 118 aa, Panicum virgatum
  misc_feature: Ceres CLONE 2025767
  misc_feature (32)..(80): Pfam Name: PHD Pfam Description: PHD-finger
  misc_feature: SWISSPROT Homolog: EC 2.1.1.43 Histone-lysine N-methyltransferase
NGTVRIQGKCAGGERRVGIYRMERGVDKWTVNCSCGATDDDGERMLSCDSCHVWRHTRCAGISDFDQVPKRYVCKSCKFLNKPKRPRPVYSNGLNKRCKTGTGALSLAGGGFLKPHIF

SEQ ID NO: 45571 - DNA, 618 bp, Panicum virgatum
  misc_feature: Ceres CLONE 2025768
  misc_feature: Encodes the peptide sequence at SEQ ID NO. 45572
aattaatttataaattagtgttaactagagcctgtaaaaacccaagcaaatgacctaccaaaacttcgttgaaatcggcagagtcgcttatgtccacttcggcggtgaacgtggaaagctcgttgtcatcctcgatatcctcaatgaaaacagagtcctcgttgaaaacccccaagaaggtgtcgtcagacaaatcatcccagtcaagagactctctttgaccagattcaaggtccccatcgtcagagctcccagaactggaaccctccaagctgctcttgaaaagttcgacttgaagggcaagtgggctgctaccagcactgctaagaaaatcgctttgagaacacaaagagctagactcactgacttcgagagatttagagctgttgtccacaagagaagactcgctcacagcttaaagaagcacgtcggtgttgctctcagaggtgacaagaagggtggtgctaagaaggctactgacaagaaggccaagaagtaaaaatagataaaggctctatggacaacttagtattggattcttgcaaaaaatttatgaagtttgtatgaaacatgtgtgatctttgatattgaaaaatagaacttctaatgaaacttcgg

SEQ ID NO: 45572 - protein, 149 aa, Panicum virgatum
  misc_feature: Ceres CLONE 2025768
  misc_feature (46)..(122): Pfam Name: Ribosomal_L14e Pfam Description: Ribosomal protein L14
MTYQNFVEIGRVAYVHFGGERGKLVVILDILNENRVLVENPQEGVVRQIIPVKRLSLTRFKVPIVRAPRTGTLQAALEKFDLKGKWAATSTAKKIALRTQRARLTDFERFRAVVHKRRLAHSLKKHVGVALRGDKKGGAKKATDKKAKK

SEQ ID NO: 45573 - DNA, 771 bp, Panicum virgatum
  misc_feature: Ceres CLONE 2025778
  misc_feature: Encodes the peptide sequence at SEQ ID NO. 45574
ccacccagctcacccagccaccagcacacacactcgcggcagagcagagcacgggagagagcagagcgccaccagccgtccgatcctcagcgcaagaggctgatccgatggctctcgctctctccagctcctccgcctccgcgctccgcgccgctttctcctcgctggccccgcgggccgccagcgccaggggctacgcggcgtcggcggcgaccggggccatgcggcgcgcggcggccggcgcggaaggcgcggccggtggtgaggccaaggaggccgggcgcggcgccgccgccgagatctcctgggtccccgaccccgtcacgggacactaccgcccgtccaactgggccgccgccgctgaccccgccgacctccgcgccgcgcacctcgcccgcgcctacgcccgggcgtgagtgagcgcccccgacgacgccgtcgtctcgttccgtgtgatgccaagggccgccatggtcgtgggacgggaggaggttctcctctcgctgtgctactcgacgctgcatcatcatctatcttcgctcgaccaaacgggaaatacgattaagatacaagaaaaatgcggcctctggtcgccgtggtgtgtgcgtgtgtgggctggacgccctgttctaacttctagcgctatctttgtcagatccagatgcagtagtacgctgctgcataggtagagaggagcagggttttgctgctgttttacgttttgttactcgctatcatcatcagtaataaaaactggttgcagttttctct

SEQ ID NO: 45574 - protein, 102 aa, Panicum virgatum
  misc_feature: Ceres CLONE 2025778
  misc_feature (1)..(96): Pfam Name: LEA_3 Pfam Description: Late embryogenesis abundant protein
MALALSSSSASALRAAFSSLAPRAASARGYAASAATGAMRRAAAGAEGAAGGEAKEAGRGAAAEISWVPDPVTGHYRPSNWAAAADPADLRAAHLARAYARA

SEQ ID NO: 45575 - DNA, 541 bp, Panicum virgatum
  misc_feature: Ceres CLONE 2025795
  misc_feature: Encodes the peptide sequence at SEQ ID NO. 45576
ggggcgactgcgacgcggtggcgagggcattcgtggactactactaccgcacgttcgacgccgaccgcggcgcgctcgcggcgctctacgccccccacacctccgtgctctccttcgagggccacgccgtcgcgggcgccgaggagatcggccggcagctggcgcagctgcccttcggccagtgccggcactccgtctccaccgtcgactgccagccctcgccgtcgttcccgggcggcatcctcgtcttcgtcagcggccacctccagctcgccggcgaggaccaccagctcaggttcagccagatgttccagctggtgcccaacgagcaggggagcttcttcgtgcagaacgacatattccggctcaactacgggtgacgcgcgcggtcgcgtgcgcttgccgaaaggaaggttgctatcgtgccgcatggacaccgggcgcgtgatcctctgcttttatttttcttctttcgtcctctcgtatccttgcacgtgatccccaaacttcgtttccttcagggaaaaaaaatgtaacgtcc

SEQ ID NO: 45576 - protein, 125 aa, Panicum virgatum
  misc_feature: Ceres CLONE 2025795
  misc_feature (6)..(122): Pfam Name: NTF2 Pfam Description: Nuclear transport factor 2 (NTF2) domain
  misc_feature: Functional homolog of the protein sequence given in SEQ ID NO 51710
  misc_feature: Useful for making plants with modulated nitrogen use efficiency
GDCDAVARAFVDYYYRTFDADRGALAALYAPHTSVLSFEGHAVAGAEEIGRQLAQLPFGQCRHSVSTVDCQPSPSFPGGILVFVSGHLQLAGEDHQLRFSQMFQLVPNEQGSFFVQNDIFRLNYG

SEQ ID NO: 45577 - DNA, 438 bp, Panicum virgatum
  misc_feature: Ceres CLONE 2025799
  misc_feature: Encodes the peptide sequence at SEQ ID NO. 45578
acgcctccccatctcctctcgccctcccgcgccgccgccgagaaggaaggaaggagcaggcaggcggagatgggccactccaacgtctggaactcgcacccgaagaactacgggcccggatcccgcgtctgccgggtctgtgctaacccccatgggttgatcaggaagtatgggctcatgtgctgcaggcagtgcttccgcagcaacgccaaggacattggcttcatcaagtaccgctgaagacattgccttgatggcgtcgagaacttcacccggggttgaaaaagaaatcgatccttcaataggaggctcaatttatgtgctttagctttttgttcagacctgagactgatgtgctagtaaactacttgttaaagatttgatgggtactatatgcctgttaaactaattataattaagtgattggagtattttgtc

SEQ ID NO: 45578 - protein, 56 aa, Panicum virgatum; identical to SEQ ID NO: 9888
  misc_feature: Ceres CLONE 2025799
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency

SEQ ID NO: 45579 - DNA, 641 bp, Panicum virgatum
  misc_feature: Ceres CLONE 2025835
  misc_feature: Encodes the peptide sequence at SEQ ID NO. 45580
gatagttatgtgggctggaacatggagggtaggtggggtacttgcgatgtctcgggcatttggcaaccgtctgctaaagcaatttgttattgcagagcctgagattcaggaacaagaaataaatgatgaattggagtttctgattatagctagtgatgggctgtgggatgtggttccgaatgaggatgtggtttcacttgtgaagatggaggaggaacccgaggcagcagcccggaagctgatagagactgcattcgcccgcgggagcggttataacatcacgtgcatagttgtgaaattccagcacgacaagccgagcggcgattctccctcgccttcgggcgacaagagttgattccatttgttggttatacatgttgtcggccctttcaccttaagccggattttcctggccccccatccatggcggtccccttatagcggcacggctggtacttaaaggagtcggttcatgttcgttgcttgtctatatatcccccctaattttggtcctccggtgggttacagatcgcagtgctatttacagatacgttcgctactggttcattctatactgcattgctgttagtagttgctgttgtattaatgactgttaggaagggaagttcgagccagaactg

SEQ ID NO: 45580 - protein, 117 aa, Panicum virgatum
  misc_feature: Ceres CLONE 2025835
  misc_feature: SWISSPROT Homolog: EC 3.1.3.16 Phosphoprotein phosphatase
IVMWAGTWRVGGVLAMSRAFGNRLLKQFVIAEPEIQEQEINDELEFLIIASDGLWDVVPNEDVVSLVKMEEEPEAAARKLIETAFARGSGYNITCIVVKFQHDKPSGDSPSPSGDKS

SEQ ID NO: 45581 - DNA, 700 bp, Panicum virgatum
  misc_feature: Ceres CLONE 2025846
  misc_feature: Encodes the peptide sequence at SEQ ID NO. 45582
gccttcccgagctgcactgcgccgccgcgtcctctccacctcctccggcgagaatcgctcacctccggcgaggtccctccgttccgcgtgagtatgggagaaccttattctcatcctccagccagatccccatcaatttttaaggcggcgctccgacagcttctcccttcccgacgcggttcgtggatccggcggccggatctgcgccggccgcaccaccggatcctgccctttgattgcttctcggcgctggacgcacggatcctcaccctcctcacctcttattccactctttcactgcaggtctgcgaggaagtgccggcgagctcccttccacccctccggcgggctcccgttccgaagcggaatgggcctgtggacattgctggagggttttctacttctcgcaaatgcattggcaatactgaacgaagatcgttttcttgctcccaggggatggagcatgtctgaagtgtcaggaaatgggcaaacaaagtcattgaagggccagatcgtgggccttatctacgccacacaatttctgagggtgcccttgatagcccttaatgttcttagcattgttgtgaagttggtgtcaggctgagtctcactgtctggttttgtctgttggttggatcgatatcagtagcattatgtaaaagttaaatatactcaaagttgctggagacatgttcatgta

SEQ ID NO: 45582 - protein, 78 aa, Panicum virgatum
  misc_feature: Ceres CLONE 2025846
  misc_feature (3)..(78): Pfam Name: Yos1 Pfam Description: Yos1-like
MGLWTLLEGFLLLANALAILNEDRFLAPRGWSMSEVSGNGQTKSLKGQIVGLIYATQFLRVPLIALNVLSIVVKLVSG

SEQ ID NO: 45583 - DNA, 498 bp, Panicum virgatum
  misc_feature: Ceres CLONE 2025863
  misc_feature: Encodes the peptide sequence at SEQ ID NO. 45584
gggctgtgctcccgctgcgttctctagcttacacgatcgccgcgtgtgttcacgatggcaagggctctcgcctcctccggtggcgcggccgcagatgcgggcttcgtccagccgtggctcgcggtgctcggcgtggccctggtctccgtatgggccgtcacgctcgccgtcctcctctgcggcgacggctccgagggcaggcgcaggcgcaggcgcagcaccgctgctggcgctggagcagctgcggctggcgacggcggcgccggctgtggtgccggcgacggcggcggcggagggggatgcggcggcggcggcggcggcggaggctgtggtggcggcgggggtggaggcggcggttgctagaggtcgcagctcaggctcaggaagcctgcagtgctaagggcatatgaatactgcgccgcttgcgtgtgtctgtatgtaaatgcatcgtgtaaaaattagagtaaattccctctatgccactgaggaatgtaactc

SEQ ID NO: 45584 - protein, 102 aa, Panicum virgatum
  misc_feature: Ceres CLONE 2025863
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Functional homolog of the protein sequence given in SEQ ID NO 50180
  misc_feature: Useful for making plants with altered alkaloid content
MARALASSGGAAADAGFVQPWLAVLGVALVSVWAVTLAVLLCGDGSEGRRRRRRSTAAGAGAAAAGDGGAGCGAGDGGGGGGCGGGGGGGGCGGGGGGGGGC

SEQ ID NO: 45585 - DNA, 675 bp, Panicum virgatum
  misc_feature: Ceres CLONE 2025868
  misc_feature: Encodes the peptide sequence at SEQ ID NO. 45586
gatgaaacttggtcagattgtgcaagatctggtctggcagtgaagccgaaaaaaggagacgcgctactgttcttcagtcttcatgtcaatgcaacaactgatacaagtagtcttcatgggagctgtccagtaattgagggtgagaaatggtctgccacgaaatggattcacgtccgatcattcgataatcctccagatgtaaggacagatgtgccatgttccgatgacaacgagctctgccgtaaatgggctgctattggggagtgttacaagaacccaacatacatggtgggcaccaaggatactctcggattttgccgcaaaagctgtggactctgtgatgcttgaaccgccaacaatctgaacgtgctgtggggtgttagatcggccgctattgtttgcatccctactcggttttttctggtactgacttgtaaataacaagtgaagcaggtcggttgagtagtataagagttacgtttacacctttgcatggtacctgcaaattgacctcacaaatcacaacatcttgacatagaagcaacggaattttttgtttttgtcaggtttaaggctgcgtgatctcgttgtgctacttagtaagtgttgtgttaacggtattactggccatatggcctgatggatcctccaaatgctacttgatcaatgttctgt

SEQ ID NO: 45586 - protein, 115 aa, Panicum virgatum
  misc_feature: Ceres CLONE 2025868
  misc_feature (73)..(113): Pfam Name: ShK Pfam Description: ShK domain-like
  misc_feature: SWISSPROT Homolog: EC 1.14.11.2 Procollagen-proline dioxygenase
DETWSDCARSGLAVKPKKGDALLFFSLHVNATTDTSSLHGSCPVIEGEKWSATKWIHVRSFDNPPDVRTDVPCSDDNELCRKWAAIGECYKNPTYMVGTKDTLGFCRKSCGLCDA

SEQ ID NO: 45587 - DNA, 679 bp, Panicum virgatum
  misc_feature: Ceres CLONE 2025875
  misc_feature: Encodes the peptide sequence at SEQ ID NO. 45588
gccagtgagaggatggaatcatggagccgtgaggagagcatgcagaaacttcttccacaacatcagcttgcagtcgctctgcctgaccggatctcagagcaaatttgcaactgtgctgtagaaatggcaaacaaccttgctgtggatgccatatttgtttacacaaagcatggtcacatggcatcacttttatcacgcaaccggccaaaccctcccatatttgcgttcactgatgatgttcattcaagaaagagcatgaacctctactggggagtgataccgttgcatcttccattatctaacagcatggaggataactttaagaaaaccatcagcctgatgaagtcaaagggttctgtgaaacctggagacacaatcttgctggtctcagactctgatctaaaccgaccttgtgctgccacatctgtgttccaatccattcaagttcggttagtggactaggttaggcttaggcataatgggacgaataaatgttcctggatgttgatggctctttacaagtacaggggttgctgcaaatgtattacagtaccagactgcataccttgtacatttgtccatggattacgtgcgttcattctccaataaggagctatttgacttgtagcattttagtacatttgtacacgaaaatgattattacctttcaatattgaag

SEQ ID NO: 45588 - protein, 153 aa, Panicum virgatum
  misc_feature: Ceres CLONE 2025875
  misc_feature (32)..(149): Pfam Name: PK_C Pfam Description: Pyruvate kinase, alpha/beta domain
  misc_feature: SWISSPROT Homolog: EC 2.7.1.40 Pyruvate kinase
ASERMESWSREESMQKLLPQHQLAVALPDRISEQICNCAVEMANNLAVDAIFVYTKHGHMASLLSRNRPNPPIFAFTDDVHSRKSMNLYWGVIPLHLPLSNSMEDNFKKTISLMKSKGSVKPGDTILLVSDSDLNRPCAATSVFQSIQVRLVD

SEQ ID NO: 45589 - DNA, 624 bp, Panicum virgatum
  misc_feature: Ceres CLONE 2025886
  misc_feature: Encodes the peptide sequence at SEQ ID NO. 45590
acgagcgccagccagtcaccacctacccgaagccgccgcgatcgatcgagccgagcgccccgcccccacgccgccaccgaaaccctagctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcaactgcagcaacatcggcgtcgcgcagatcgtcgccgcggcgtggtcggactgccccgccgccgcctccgcggcggcggaggtcagcgcaatccccaacgctaaggttgcgcagccatccgccgtcgtacaggccgagcgtaacctgctcggctccgacgccagccttgccgtccacgcgggcgagaggctgggaagaaggatcgccacggatgcgatcaccacgccagtagtgaacacgtcggcctactggttcaacaactcgcaagagctaatcgatttcaaggaggggaggcatgctagcttcgagtacgggaggtatgggaacccgaccacagaggcattggagaagaagatgagcgcactggagaaagctgaatccactgtgtttg

SEQ ID NO: 45590 - protein, 172 aa, Panicum virgatum
  misc_feature: Ceres CLONE 2025886
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAAASAAAEVSAIPNAKVAQPSAVVQAERNLLGSDASLAVHAGERLGRRIATDAITTPVVNTSAYWFNNSQELIDFKEGRHASFEYGRYGNPTTEALEKKMSALEKAESTVF

SEQ ID NO: 45591 - DNA, 704 bp, Panicum virgatum
  misc_feature: Ceres CLONE 2025914
  misc_feature: Encodes the peptide sequence at SEQ ID NO. 45592
ttggacatgtggagtcttggctgcatgtttgctggaatgatatttcgtaaggaaccatttttctatggccatgacaaccatgatcagcttgttaagattgctaaggtacttggaacagatgggctgaatgcttatttgaacaagtacagaattgagcttgaccctcagcttgaagccctcgttggaaggcatagcaggaaaccctggtcgaagtttattaatgcggataaccaacacctagtatctcctgaggccatagatttcctcgacaagcttctgcgttatgatcaccaggacaggtttactgcacgtgaagcaatggtaagtgttatgctaattttgttgtctgacaactcaaatgtaactggctgcttgatagtctaaacatcccgtctgatattttactagtctagtatcactcaaacaaaaggtcgtgcatggtatttttggctgagcattttggtttctgtgccagagcttttgcacgcaaatttgtaagggccagcacatttaattgatttatgctgcctagtatttccagtctgtctcatcttatactggatacttgtattctgtaggtgcacccatacttccaacaagtgagagccgcagaaaatagcaggacacgcgcataacaggcaagggcagagatgcgctaacagatcatcagctgcgctccatcgatcttcagtcatataatagcg

SEQ ID NO: 45592 - protein, 127 aa, Panicum virgatum
  misc_feature: Ceres CLONE 2025914
  misc_feature: SWISSPROT Homolog: EC 2.7.11.1 Non-specific serine/threonine protein kinase
  misc_feature: The sequence is a functional homolog of SEQ ID NO 1 in US patent 7038110
LDMWSLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRFTAREAMVSVMLILLSDNSNVTGCLIV

SEQ ID NO: 45593 - DNA, 696 bp, Panicum virgatum
  misc_feature: Ceres CLONE 2025932
  misc_feature: Encodes the peptide sequence at SEQ ID NO. 45594
gagagcgttataaatggccgaactggtgaaaggatgcagtccttggttttcatgggccctacattttaccaaaggctgattcacatgtccgaagataaggtgaaattccgcaacactggaccagtgcaccccctcacaaggcagcctgtcgctgacaggaaaaggtttggtggagttaagtttggagaaatggagcgtgattgcctcctcgcccatggagctgctgccaacctgcatgagcggctgttcatgcttagtgatttctctcagttgcacatctgccagacatgcgagcgggtggctaatgttatcatgaggtgtgtcccaggagggaaaaagatcagggggccgtactgtggcttctgcaagtcttctgagaacatagtgaggatcaatgtgccctatggtgcaaagcttctctaccaggaactctttagcatggggatctgcctcaagttcgagacagaagtctgctagaagcttagaactcctaaacctatttgctatccagtcatgtacataaacctgtgtgatgctggcatagcaaggatgggcgaaccgatagagtgaattgcactggcagtggcagcaggatatttccagtgcgtaggggcgtctgtctcaagtttcggaagaaaccctgttgaaactaaaccttgtagcctttattactctgctcatctggtaaactatgcc

SEQ ID NO: 45594 - protein, 158 aa, Panicum virgatum
  misc_feature: Ceres CLONE 2025932
  misc_feature (57)..(156): Pfam Name: RNA_pol_Rpb2_7 Pfam Description: RNA polymerase Rpb2, domain 7
  misc_feature: SWISSPROT Homolog: EC 2.7.7.6 DNA-directed RNA polymerase
ESVINGRTGERMQSLVFMGPTFYQRLIHMSEDKVKFRNTGPVHPLTRQPVADRKRFGGVKFGEMERDCLLAHGAAANLHERLFMLSDFSQLHICQTCERVANVIMRCVPGGKKIRGPYCGFCKSSENIVRINVPYGAKLLYQELFSMGICLKFETEVC

SEQ ID NO: 45595 - DNA, 675 bp, Panicum virgatum
  misc_feature: Ceres CLONE 2025936
  misc_feature: Encodes the peptide sequence at SEQ ID NO. 45596
ccaaatgcaagttcattgcccaatgctttatatatggtgatagtttcaactcttccctagttgctgttgttgcagttgaactagaggttttgaaggcttgggctgcatctgaaggaatccagtacgaagacttaaggcagctttgtgccgatcctagagcaagagctgctgtcctggctgatatggattctattggaaaggaagcacagctaagaggttttgaatttgctaaagctgttactcttgttgctgaaccattcacattggagaatggtctcctcaccccaacattcaaggtcaaaagaccgcaagctaaggcatactttgcaaaagaaatatcagatatgtatgcagagttgagagagacagagccagctaggccgaagttgtaatcgcttgtgtaatcatcagaatggaagtggaaaatacaggcttacaggagattgttgggttccaagattccacgattatttcttcatatcataaaataagttgaatcttctgaatggcagataattgttcctgcaatgatcaggaaaagattcaacaagacgggcagtgcttggtgcagaatgaaaacatggtacttgctatgtgaaccattggatttctaccattaaagaaaaatcggatgctgagtacgtgttgaatttctgtccgtgtccactgccctct

SEQ ID NO: 45596 - protein, 129 aa, Panicum virgatum
  misc_feature: Ceres CLONE 2025936
  misc_feature: SWISSPROT Homolog: EC 6.2.1.3 Long-chain-fatty-acid--CoA ligase
KCKFIAQCFIYGDSFNSSLVAVVAVELEVLKAWAASEGIQYEDLRQLCADPRARAAVLADMDSIGKEAQLRGFEFAKAVTLVAEPFTLENGLLTPTFKVKRPQAKAYFAKEISDMYAELRETEPARPKL

SEQ ID NO: 45597 - DNA, 614 bp, Panicum virgatum
  misc_feature: Ceres CLONE 2025941
  misc_feature: Encodes the peptide sequence at SEQ ID NO. 45598
gatgtttacagctttggtgttgtactactagagttgcttaccgggcgtagcccaactgatcaacagtttgacagcgaaatgagcattgtctcatgggtttcatttcatctggctgagcaaagcccaacagctgttcttgatccaaaagtaagcaatgactcatcagagtacatgataaaggccctgaatattgctattctttgtactgctcagcttccttctgaacggccgacaatgagagaagttgtgaaaatgctcatcgacaatgatccgagctccacaactgggagggcaaagaacaagaatgataagtaacaacatgctttttcttagtaagatatactagtaacaatcagaacatcagggcctctaagcaccctgtagcactcatgggggaagcttattaggtcctcagactgcctgactagtgaatacagtagcaactagcaggctggtaaaataacgtggaggtatagcctctgcaaagcttgtccatatgtaaaagctttagataatatcctgtaaaaattagtattttgtactgaaaaattctgtaaatacatcgtgcatcgacatgatttgtgcatcccttgcaaaagtttgtgaatgacgat

SEQ ID NO: 45598 - protein, 104 aa, Panicum virgatum
  misc_feature: Ceres CLONE 2025941
  misc_feature: SWISSPROT Homolog: EC 2.7.11.1 Non-specific serine/threonine protein kinase
DVYSFGVVLLELLTGRSPTDQQFDSEMSIVSWVSFHLAEQSPTAVLDPKVSNDSSEYMIKALNIAILCTAQLPSERPTMREVVKMLIDNDPSSTTGRAKNKNDK

SEQ ID NO: 45599 - DNA, 615 bp, Panicum virgatum
  misc_feature: Ceres CLONE 2025945
  misc_feature: Encodes the peptide sequence at SEQ ID NO. 45600
aacaaacgctaaaaaagtaacagtttctgtactttattggattgcatacagccaaccatgtccacgattcgcaagactcacctgcccggccacaacaacaaccgccacctgacgggtgatgagctggagaacaacatcggccagctcgccgtcacggactccaagctccgcgagctctttgaccaatacgacgtcaaccacaacggcttcctcgagctcgaggaggtgaagaagcttgtcgccgcgcaggagtggtacggcctgacgcccagcaacgcgcagatcgaaagcttgatccgcaagtactccaagtcgcgcgacaaccacgttagctacgacgagttcagcgcgctgtggctcggcctggcccaattgtaacgtagcccgtctccgagggcatccgttgctctgcatgacatgtacctcagtctgttccaacaagccggtcgcatcgccgccgccgaggctcccgcaacgtcgcacgttccttttcctgtgcgctgttcgtgaccaacaaccatcattttctccaccgtgtgtatacaggcggcgggggccggcagcggtcgtgtggtgtgcgatggcttgagctacccacaggtgcgctcccgtctc

SEQ ID NO: 45600 - protein, 106 aa, Panicum virgatum
  misc_feature: Ceres CLONE 2025945
  misc_feature (36)..(64): Pfam Name: efhand Pfam Description: EF hand
  misc_feature: SWISSPROT Homolog: EC 2.7.11.1 Non-specific serine/threonine protein kinase
MSTIRKTHLPGHNNNRHLTGDELENNIGQLAVTDSKLRELFDQYDVNHNGFLELEEVKKLVAAQEWYGLTPSNAQIESLIRKYSKSRDNHVSYDEFSALWLGLAQL

SEQ ID NO: 45601 - DNA, 695 bp, Panicum virgatum
  misc_feature: Ceres CLONE 2025961
  misc_feature: Encodes the peptide sequence at SEQ ID NO. 45602
atcacgccgcgacgcctccttgtcctctctctctctccccaacccggagctcgaaaccctaggcgcgtgcggcggaggcggcgaggcatggccatggacccggacgcggtggccaaggccttcgtggagcactactaccggaccttcgacaccaaccgcgccgcgctggtgtcgctgtaccaggagacctcaatgctcaccttcgagggccagaagcttcagggcccggccgccatcgccggcaagctcggctcgctccccttccagcactgcgagcaccagatcgtcaccgtcgactgccagccgtcggggccccagggaggcatgctcgtcttcgtctccggctccatccgcaccgcccccgacgagcaccccatgaagttctcccaggcgttccatttgatgcctgctggaaattccttctacgtgcagaatgacatgttccgcctgaactatggttaaagacagtcaagagttgccggaagcgaagtgattaagggtttcatgttgaattgattaatatgaatgatgctgctactcttgcccgtttgttggctgctgttgtttgctgcaagaaaattgctagacttgatatgcttgttggataatttcttattttggatcatgtactctggttgcatgggcaccggttctgtggattgtgaatgaaaacggtccagatctattcatgtgag

SEQ ID NO: 45602 - protein, 124 aa, Panicum virgatum; identical to SEQ ID NO: 13109
  misc_feature: Ceres CLONE 2025961
  misc_feature (8)..(121): Pfam Name: NTF2 Pfam Description: Nuclear transport factor 2 (NTF2) domain

SEQ ID NO: 45603 - DNA, 626 bp, Panicum virgatum
  misc_feature: Ceres CLONE 2025962
  misc_feature: Encodes the peptide sequence at SEQ ID NO. 45604
ggaccgatcgaccgacgacaccgcacgacaaccaccctcaccacatcacgaccggatccagccgtcaaaatggtcaacgttcccaagacccggaagacctactgcaaggggcgggagtgcaacaagcacaccctccacaaggtcacccagtacaaggccggcaaggcctcatcattcgcccagggtaaacgccgttacgaccgcaagcagtccggttacggtggtcagaccaagcccgtcttccacaagaaggcgaagaccaccaagaaggtcgtcctccggctggaatgctcgtcatgcaagaccaagaagcagctcccgctcaagcggtgcaagcacttcgagcttggtggtgacaagaagaccaagggtgccgccctcgtgttctaagcgcgtcacatttggggaaatcggtggtgacgaaatggggacatggcttcggtccttcggaagctggccttgcatggccctgcccgccatggagtgggaatccagaaagcgatttcgatcttgacatgggggaatccgggcatagaggaacatgtacatgggcatgggtggttcggacgtggaacaacaagcacaataccatccttggggcgtttcgtctgcgctttttattcacg

SEQ ID NO: 45604 - protein, 106 aa, Panicum virgatum
  misc_feature: Ceres CLONE 2025962
  misc_feature (19)..(95): Pfam Name: Ribosomal_L44 Pfam Description: Ribosomal protein L44
MVNVPKTRKTYCKGRECNKHTLHKVTQYKAGKASSFAQGKRRYDRKQSGYGGQTKPVFHKKAKTTKKVVLRLECSSCKTKKQLPLKRCKHFELGGDKKTKGAALVF

SEQ ID NO: 45605 - DNA, 628 bp, Panicum virgatum
  misc_feature: Ceres CLONE 2025985
  misc_feature: Encodes the peptide sequence at SEQ ID NO. 45606
caagtgcgaccctcggcacggcaagtacatggcgtgctgcctgatgtaccgtggtgatgtggtgcccaaggacgtgaatgctgcggtggcaaccatcaagaccaagcgcacgatccagttcgtggactggtgcccgacggggttcaagtgtggcatcaactaccaggctccgacggtggtgccgggtggcgacctcgccaaggtgcagcgcgctgtgtgcatgatctccaactccaccagcgttgccgaggtgttctcccgcatcgaccgcaagttcgacctcatgtacgccaagcgcgccttcgtgcactggtatgttggcgagggcatggaggagggtgagttctctgaggcccgtgaggacctggctgccctggagaaggactatgaggaggtgggcgccgaaggcgggggtgatgaggatgaggaggacgaggagtactgatctgcttccttgaaactgttgtgtgcagtcaccatgggtgacttcttgcagtgtcgaaaagtcgttcaaagtctagtcttggttgtgttatgttgattgcttctccgtagtttgttgaactgcttttgtaccatgtcgtaatggaatactcctgagtatctcttattaataactgtttggttc

SEQ ID NO: 45606 - protein, 147 aa, Panicum virgatum
  misc_feature: Ceres CLONE 2025985
  misc_feature (1)..(90): Pfam Name: Tubulin_C Pfam Description: Tubulin/FtsZ family, C-terminal domain
  misc_feature: Functional homolog of the protein sequence given in SEQ ID NO 50141
  misc_feature: Useful for making plants with altered cell wall content and/or composition
KCDPRHGKYMACCLMYRGDVVPKDVNAAVATIKTKRTIQFVDWCPTGFKCGINYQAPTVVPGGDLAKVQRAVCMISNSTSVAEVFSRIDRKFDLMYAKRAFVHWYVGEGMEEGEFSEAREDLAALEKDYEEVGAEGGGDEDEEDEEY

SEQ ID NO: 45607 - DNA, 624 bp, Panicum virgatum
  misc_feature: Ceres CLONE 2025989
  misc_feature: Encodes the peptide sequence at SEQ ID NO. 45608
cccaggcaagcaagctcgaggcgacagaggcaagccaagaaaagcagcagcagccagccaagctcgccgccgcggctcttcttgctcgcctccggccgttccgttcccgtcccgccgagcttccgcagaagggatggagatgaagaagatcgcctgcgccgtcctcgtcgctgcctcggccaccgtggcgctcgccgcggacgccccggccccggcccccaccagcgggtcctccgccgtcgcgcccgccgtcggcgccgcgctcggggccgccgtggcctccttcttcgcctactacattcagtgagccgctggaacggccggcccggcgggaggaggacgaggaggaagagaccagggggagacatggcggcgctgattccgaacaccgcgcgcgcattccgatgcgtgcgtgggtttcgatttgacacggctttctcttcttctcccccccccccccccccccccctcctctttctccttgatttaacgaattgatcgatgtcgctgatgcaccagtttaatttggtgccttgttatttgttcttcaatccctttgagagagggaccgacacctgtaccattgcttgccatttgtttggatcaattcaacaattcgatttg

SEQ ID NO: 45608 - protein, 57 aa, Panicum virgatum; identical to SEQ ID NO: 36286
  misc_feature: Ceres CLONE 2025989
  misc_feature: Functional homolog of the protein sequence given in SEQ ID NO 50462
  misc_feature: Useful for making plants with altered carbohydrate content
  misc_feature: Functional homolog of the protein sequence given in SEQ ID NO 51521
  misc_feature: Useful for making plants with altered cell wall content and/or composition

SEQ ID NO: 45609 - DNA, 626 bp, Panicum virgatum
  misc_feature: Ceres CLONE 2025995
  misc_feature: Encodes the peptide sequence at SEQ ID NO. 45610
atcttcttcttacgcaagaaaaaaaaaaggatcaaggtcaggcggcgtgcggcgagtttattgagaggccagggttcgttgcgtgccggaccgtgtcgcgagtcccgatggcggagccggcgaagcccgaggtgacggaggaggccaagatggacctgctcgaggacgacgacgagttcgaggagttcgagatcgaccaagagtgggatgacaaggaagaaggcaacgaagcacttcagcaatgggaggatgactgggacgacgatgacgtcaacgatgacttctcgctgcagttgaggaaggagctggagagcaatgcgcccaagaagtagccaacatatgcagccttgtatcgagttggagagtggtgtgatggtgtccaaggactagttggcgtatgcagccttgtatccattattgtcagatagggactggtgtacggtgacgatggttgggacactgctactgttgttcggcgctcgtccttcttggcatggtcactgatttagtcgttccgcttgcttttgatggatcatttccctgtttccgtctactaataactgatgcaccttggttaaaaggcagcgatgagaattgtatgctacatatgcgctgttcgtttgtac

SEQ ID NO: 45610 - protein, 74 aa, Panicum virgatum; identical to SEQ ID NO: 9910
  misc_feature: Ceres CLONE 2025995
  misc_feature (8)..(70): Pfam Name: DSS1_SEM1 Pfam Description: DSS1/SEM1 family

SEQ ID NO: 45611 - DNA, 659 bp, Panicum virgatum
  misc_feature: Ceres CLONE 2026017
  misc_feature: Encodes the peptide sequence at SEQ ID NO. 45612
ggtcacggaagatatgtatgtcgaagatactgagttatggaagaggagagttgggcactacaagtccgtgatctcgcaattcgggcagaaaggccggtaccgcaatttgcttgatatgaatgcgaagtttggtggcttcgctgcagctttggtggatgacccagtgtgggtcatgaacatggtccctactgtgggcaactcaacaaccctgggggtaatatacgagcgtggcctcatcgggagctaccaggactggtgtgagggcatgtctacttatccccggacctacgacctcattcatgctgattcagtgttcacgctatacaatggcaggtgtgagatggagaacattctgctggaaatggacaggatcctgaggccggagggcacgatcatcattagagatgacgtggacctgttagtgaagataaagagcatcgcggacgggatgagatggaatagccagatcgtggatcacgaagatggtccgctcgtccgcgagaagctcctccttgttgtgaagacatactggacattgggggacaacaaacaataggaataacgtggaataaaagagttagagtgattgacttgctcggcaaatcttgtgactggctttgccctgtgaatctcgagtttgttttcgtttttccttttgg

SEQ ID NO: 45612 - protein, 184 aa, Panicum virgatum
  misc_feature: Ceres CLONE 2026017
  misc_feature: The sequence is a functional homolog of SEQ ID NO 1593 in the 11/479,226 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
  misc_feature: Functional homolog of the protein sequence given in SEQ ID NO 51175
  misc_feature: Useful for making plants with altered cell wall content and/or composition
  misc_feature: The sequence is a functional homolog of SEQ ID NO 560 in the 10/412,699 US patent application
  misc_feature: The sequence is a functional homolog of SEQ ID NO 2546 in the 10/374,780 US patent application
  misc_feature: The sequence is a functional homolog of SEQ ID NO 760 in the 10/412,699 US patent application
  misc_feature: The sequence is a functional homolog of SEQ ID NO 824 in the 10/225,066 US patent application
VTEDMYVEDTELWKRRVGHYKSVISQFGQKGRYRNLLDMNAKFGGFAAALVDDPVWVMNMVPTVGNSTTLGVIYERGLIGSYQDWCEGMSTYPRTYDLIHADSVFTLYNGRCEMENILLEMDRILRPEGTIIIRDDVDLLVKIKSIADGMRWNSQIVDHEDGPLVREKLLLVVKTYWTLGDNKQ

SEQ ID NO: 45613 - DNA, 523 bp, Panicum virgatum
  misc_feature: Ceres CLONE 2026045
  misc_feature: Encodes the peptide sequence at SEQ ID NO. 45614
cataaaaaacgctgggcacgcagtcaatcttgagaagcccaaggaggtgtgcaagaacgtcatcgagtttttcaaagagccagccgctgaagctgcaaagggagacgacaaggtccggaaaattttgcattgatctctaggaccaatttctgactagctcaatccctcgacagtcatatgctgcggtgattaagttgatatgctcagtcatatgttggcacggttcctgcggcgtactatcttgtaaccttctttctttttttctttttcttttttttgaaaataatgtaaccttctgttgattcatctcgcaggtatagatagcttcaccaatggcggacaggtcgtcgcttgcatctgcagatccgcttgtggcacgcaaatgaggacgggtagatgtgtggcatgagtgctctccgccattgttcgctgtagtgctagattcaacgcggtagccattcacaagcatgtaacggaaaacactgcaaaccaaagtgactcgagtgccagtgaaatcctgtgt

SEQ ID NO: 45614 - protein, 43 aa, Panicum virgatum
  misc_feature: Ceres CLONE 2026045
  misc_feature: Functional homolog of the protein sequence given in SEQ ID NO 51412
  misc_feature: Useful for making plants with altered lignin content
IKNAGHAVNLEKPKEVCKNVIEFFKEPAAEAAKGDDKVRKILH

SEQ ID NO: 45615 - DNA, 658 bp, Panicum virgatum
  misc_feature: Ceres CLONE 2026048
  misc_feature: Encodes the peptide sequence at SEQ ID NO. 45616
agaaacagcgagttgtggcactctcctcatgtgaggcagagtacattgcagccacatctgctgcctgccaaggcatttggctgtcaaggctgcttggggagctccaagatgaagaacctgctccctttgagctaaggatggacaacaaagcagcaatcgagctgtgcaagaatcctgtcttccatgagcgcagcaaacacgtcgacacaagataccacttcatcagggactgtgttgatcaagggaagacaagggtgagctacatcaacactaaagatcagctagctgacatcctaaccaaggcattgggaaggatccaatttgaagagctgcgcagcaaattggcatgatcaagattgcaaaactagaagaaaccaagacttagggggtgattgatgaataagtcttagcttaaggcactctccaaagctagcagcattgtataagctgcacatagaatcctgtgatgtcacccatgacctatattagtgtatgaggtcagcagtgacatatagtttccttaactagcaagtatatctgctgtgtggtagcagtagtcaacttagttttttccacttcaagcaagtagtaagtctacatacttgtagcactataaatatgcctctttgggctagcaatgaagcaagcttttctgctt

SEQ ID NO: 45616 - protein, 115 aa, Panicum virgatum
  misc_feature: Ceres CLONE 2026048
  misc_feature: SWISSPROT Homolog: EC 2.7.7.49 RNA-directed DNA polymerase
  misc_feature: The sequence is a functional homolog of SEQ ID NO 1842 in the 10/374,780 US patent application
  misc_feature: The sequence is a functional homolog of SEQ ID NO 1038 in the 10/374,780 US patent application
  misc_feature: The sequence is a functional homolog of SEQ ID NO 848 in the 10/666,642 US patent application
  misc_feature: The sequence is a functional homolog of SEQ ID NO 1035 in the 10/374,780 US patent application
  misc_feature: The sequence is a functional homolog of SEQ ID NO 1040 in the 10/374,780 US patent application
  misc_feature: The sequence is a functional homolog of SEQ ID NO 845 in the 10/666,642 US patent application
  misc_feature: The sequence is a functional homolog of SEQ ID NO 850 in the 10/666,642 US patent application
  misc_feature: The sequence is a functional homolog of SEQ ID NO 1037 in the 10/374,780 US patent application
  misc_feature: The sequence is a functional homolog of SEQ ID NO 847 in the 10/666,642 US patent application
KQRVVALSSCEAEYIAATSAACQGIWLSRLLGELQDEEPAPFELRMDNKAAIELCKNPVFHERSKHVDTRYHFIRDCVDQGKTRVSYINTKDQLADILTKALGRIQFEELRSKLA

SEQ ID NO: 45617 - DNA, 702 bp, Panicum virgatum
  misc_feature: Ceres CLONE 2026059
  misc_feature: Encodes the peptide sequence at SEQ ID NO. 45618
ggcctattgctgcatgagctagttgatggcttaagggagctcataatggagaagaggtacctaagaaagcagatagcaaacaagatggctgaagggatcttgccaaatgtgctaaaggagctccatcaagtcagcagcaatctcatggttgtgaaggttgcaagaagtgatgaagactgtgcagaagttactttagtagatgcctacaacaacactagaagatggacagaggacctcaagaaccagaaatgctcttgcagagtttggcaggtgactggaaaaccatgtcagcatgccctggcctggattttgtctaacagaggtgtacaaatctttgattttgtacatgagtactactctgtggctaagttcaaggcagcctatgaaggcagggtcactacaatgccagataggtcccaatggcctgtagtggatcttggtttccaagtttggccaccactgcagaaaagagcacctggcaggcctaaggttcagagaatcagaggagcccttgagaaagggcccaaaaagaaggttagatgctctagatgcaaaggctatggacactttgccaagacttgcaagcttgcagaaccatcagaaccagcagaactagcacaagatgttactccacaaacaccaagcaaaaggaagaggcagccacaagatgaaggcccttctgttcaacacaacaacaagaag

SEQ ID NO: 45618 - protein, 233 aa, Panicum virgatum
  misc_feature: Ceres CLONE 2026059
  misc_feature (61)..(107): Pfam Name: SWIM Pfam Description: SWIM zinc finger
GLLLHELVDGLRELIMEKRYLRKQIANKMAEGILPNVLKELHQVSSNLMVVKVARSDEDCAEVTLVDAYNNTRRWTEDLKNQKCSCRVWQVTGKPCQHALAWILSNRGVQIFDFVHEYYSVAKFKAAYEGRVTTMPDRSQWPVVDLGFQVWPPLQKRAPGRPKVQRIRGALEKGPKKKVRCSRCKGYGHFAKTCKLAEPSEPAELAQDVTPQTPSKRKRQPQDEGPSVQHNNK

SEQ ID NO: 45619 - DNA, 423 bp, Panicum virgatum
  misc_feature: Ceres CLONE 2026080
  misc_feature: Encodes the peptide sequence at SEQ ID NO. 45620
caccaagggcaaggaggacaagatcgccgttgttgtcggcaccgtcaccgatgatgcccgtctcctcaagttccccaagctgaccgtgtgcgccctgaggttcaccgagggtgcccgcagccgtatccttaaggccggcggtgaggtcatcaccttcgatcagctcgccctccgtgcccccaccggcgccaacaccctcctcctgaggggccgcaagaccgccaggaaggccaccaagcacttcggcgcccccggtgtgcccaacagcaccaccaggcccaaggttgccaacaggagcaggaagaccgagagggctaggggtaggaggaagtctgtcggcttcaaggtgtaagtcacccaacggctgcgttctcttccactcttctgtcacacataaggcattaaacagacagttctcgatgc

SEQ ID NO: 45620 - protein, 116 aa, Panicum virgatum
  misc_feature: Ceres CLONE 2026080
  misc_feature (1)..(114): Pfam Name: Ribosomal_L18e Pfam Description: Eukaryotic ribosomal protein L18
  misc_feature: Functional homolog of the protein sequence given in SEQ ID NO 50173
  misc_feature: Useful for making plants with modulated nitrogen use efficiency
TKGKEDKIAVVVGTVTDDARLLKFPKLTVCALRFTEGARSRILKAGGEVITFDQLALRAPTGANTLLLRGRKTARKATKHFGAPGVPNSTTRPKVANRSRKTERARGRRKSVGFKV

SEQ ID NO: 45621 - DNA, 817 bp, Panicum virgatum
  misc_feature: Ceres CLONE 2026087
  misc_feature: Encodes the peptide sequence at SEQ ID NO. 45622
tctgttcttcattcagggtgcacatttggcatttctagttgtttgccttgcattgattctcattttctcaacatctactattggtatgattcatccttaaactgctgaatgaagctcacaaacacaatacagaggaagctgaaggtcacctcgacgcagcgcctgtaccaatccgcgccttaccaagcagcaatcctgttcgcgaccggccccttcgtggatcagctcctcaccagccgaagcgtcttcgcccacaaatacacattcccagttgtgggcttcatcgtgctgtcgtgcgtgatcgcggtgtcggtgaacttcagcacgttcctggtgatcgggacgacgtcgccggtgacgtaccaggtgctggggcacctcaagacgtgcctggtgctgtcgttcgggtacacgctgcttcgcgaccccttcaccgcgcgcaacatcctgggcatcctcgtcgccatcttcgggatggcgctctactcctacttctcggtgcgcgagggcaggaagaaggccgcgggcgacgccctcccggtgtcacagatgccggagaaggagacggagccgctgctggcgtcgaccaaggacggcggcgacgccaagaaggccaacggcgtagctcacgactgctagatgctcctttctctcgtctgttatagcttagccagctctagtgtgtcgctacgctacgcagtacgcacactgttctgaatctgatgtcggggaagcaagaattcctttcgtttatttgtacgatagaaagtgggggcgcgttgtactcgtccacaattaaaaatcgatggttcctctc

SEQ ID NO: 45622 - protein, 176 aa, Panicum virgatum
  misc_feature: Ceres CLONE 2026087
  misc_feature (3)..(128): Pfam Name: TPT Pfam Description: Triose-phosphate Transporter family
MKLTNTIQRKLKVTSTQRLYQSAPYQAAILFATGPFVDQLLTSRSVFAHKYTFPVVGFIVLSCVIAVSVNFSTFLVIGTTSPVTYQVLGHLKTCLVLSFGYTLLRDPFTARNILGILVAIFGMALYSYFSVREGRKKAAGDALPVSQMPEKETEPLLASTKDGGDAKKANGVAHDC

SEQ ID NO: 45623 - DNA, 608 bp, Panicum virgatum
  misc_feature: Ceres CLONE 2026098
  misc_feature: Encodes the peptide sequence at SEQ ID NO. 45624
gagccgccgaggcgaggcgcggccatcccccatccatggcggaggccggcggcgacaagctcatcctgcgcggcctgcagttccacggcttccacggcgtgaagcgggaggagcagacgctgggccagaagttcgtcgtcgacgtcgacgcatggacggacctcgccgccgccggcgagtccgacagcatcgccgacaccgtcagctacaccgacatctacgggattgctaaggatgtcgtcgaaggcacgccgcacaacctcttggagtcggtggctcagtcgatcgcaaaggccacgctgctcaagttccctcagatctccgccgtccgggtgaagattggcaaacctcacgtcgcggtgcaaggcgttgtggactatctgggcgtcgagataacgaggcacagaaacaaagcgtgagagtgatttcactgtggaatgggactgatactgtagatgctgctgccgttggttagctgctgtaatcgaatatattccacaattgttggcatcatgtttgatgaactagatttggctgtgctgtttgtgtgaactgaaacgggaacaataatcgaataacaatgagccaaaacattatcttctattttt

SEQ ID NO: 45624 - protein, 127 aa, Panicum virgatum
  misc_feature: Ceres CLONE 2026098
  misc_feature (9)..(122): Pfam Name: FolB Pfam Description: Dihydroneopterin aldolase
  misc_feature: SWISSPROT Homolog: EC 4.1.2.25 Dihydroneopterin aldolase
MAEAGGDKLILRGLQFHGFHGVKREEQTLGQKFVVDVDAWTDLAAAGESDSIADTVSYTDIYGIAKDVVEGTPHNLLESVAQSIAKATLLKFPQISAVRVKIGKPHVAVQGVVDYLGVEITRHRNKA

SEQ ID NO: 45625 - DNA, 508 bp, Panicum virgatum
  misc_feature: Ceres CLONE 2026105
  misc_feature: Encodes the peptide sequence at SEQ ID NO. 45626
aggcacctctgtactatagagacgctcaagcagccctcttggtatatgacgtgacagataccagaaccttccaaagtttggattattgggttcgtgaacttgatgaaaaggtcagagatgagaatatggtgctcattattgcaggaaacaagagcgacttgccaggcagaagagttaaggaagaacaagtcaaggcttttgctgaaaatgcaggaatcaaatatttcgacgtgagcgcaaagtcgggacaaaatattacagaacttttcacagacttgtcaacacaacttgtcaagagagcagcaaccaacaacaattaaatcagtaattggcatttattttgtgttgaatacctaaatttgaatattttatggtcattttattacatatataatcaaccttgcctctctattgagagatctcggtatataaaccgatttgtaattcgcttcgttatcttctcgtatcctctcgtatcatttgctcagctccctccttttcacatccc

SEQ ID NO: 45626 - protein, 105 aa, Panicum virgatum
  misc_feature: Ceres CLONE 2026105
  misc_feature (1)..(98): Pfam Name: Ras Pfam Description: Ras family
APLYYRDAQAALLVYDVTDTRTFQSLDYWVRELDEKVRDENMVLIIAGNKSDLPGRRVKEEQVKAFAENAGIKYFDVSAKSGQNITELFTDLSTQLVKRAATNNN

SEQ ID NO: 45627 - DNA, 682 bp, Panicum virgatum
  misc_feature: Ceres CLONE 2026107
  misc_feature: Encodes the peptide sequence at SEQ ID NO. 45628
aagtagcgaagagatctgtttcatagcttacggcgagtaacctctcattcttatctgagcttacagtaggaggatggccggaggagggcggcttgcgctggtggtggcgctgctgtgcgcggcggcggccatggccgcggcgcagcaggcgtccggcgtgcgcgccacctacaactactaccgcccccagaacatcaactgggacctgaacgccgccagcgtgtactgcgccacctgggacgccggcaagtcgtacgagtggcgcagcaggtacggctggaccgccttctgcgggcctgccggccccactggccaagcctcgtgcggccagtgcctccaggtgacgaactcggcgacgggcgtgtcgacgacggtgaggatcgtcgaccagtgcagcaacggcgggctggacctggactacgatacggcgttcagcaagatcgacaccgacggttcaggcgtccgagacggccacctcaccgtcagctaccagttcgtcaactgcggcgacaactgaaaactgatgatgactccatcaccccagcagcgcagcagcagcagtagctgcacgtatacagaattaatatatatatatgtaaccccacatgatggtgaaattaaacttgaagatgaataagtgggcgtccagtgaaaataaattaaagctttgttgttgttgttg

SEQ ID NO: 45628 - protein, 147 aa, Panicum virgatum
  misc_feature: Ceres CLONE 2026107
  misc_feature (25)..(144): Pfam Name: Barwin Pfam Description: Barwin family
MAGGGRLALVVALLCAAAAMAAAQQASGVRATYNYYRPQNINWDLNAASVYCATWDAGKSYEWRSRYGWTAFCGPAGPTGQASCGQCLQVTNSATGVSTTVRIVDQCSNGGLDLDYDTAFSKIDTDGSGVRDGHLTVSYQFVNCGDN

SEQ ID NO: 45629 - DNA, 660 bp, Panicum virgatum
  misc_feature: Ceres CLONE 2026123
  misc_feature: Encodes the peptide sequence at SEQ ID NO. 45630
aaaaacccgaaaaaacaaaaattgcggtatgcaccaatgcaggatcgtaattattggttcggctgccattggtaagacggctttctgtattcagttcattcaaggattcttcgtggacgaatatgaccccaccatcgaagattcgtacagaaaacaagtgatgattgataatgaatcattcttgctcgaagtgctggacactgctggacaagagtattctgttgctgatcaatatatgagggttggcgatggatttgttatggcttatgcaatcacagatcgaaactcatttactcaacttccttcatacagacaaaaagttttagacgcaaaagagacagacagttgtcccatggttctagtggggaataaatctgatttgagtcatgaaaggaaagttggaacagaggagggaagtgaattggctaggtcttggtctgttcctttctttgaaggtagtgctcttgctagaattaatgttgaacctgcattttttgctgttgctcgagaagtaagacgtcaaactccaacaaattcaacaacaacgactcctcgaggctccagaaataggggaccttgtactcttttttaaaaaaaaaattatatatcattttctattgcaataacacaaatttaatttaaataaaactcatcttgtac

SEQ ID NO: 45630 - protein, 187 aa, Panicum virgatum
  misc_feature: Ceres CLONE 2026123
  misc_feature (5)..(164): Pfam Name: Ras Pfam Description: Ras family
  misc_feature (5)..(117): Pfam Name: Miro Pfam Description: Miro-like protein
MHQCRIVIIGSAAIGKTAFCIQFIQGFFVDEYDPTIEDSYRKQVMIDNESFLLEVLDTAGQEYSVADQYMRVGDGFVMAYAITDRNSFTQLPSYRQKVLDAKETDSCPMVLVGNKSDLSHERKVGTEEGSELARSWSVPFFEGSALARINVEPAFFAVAREVRRQTPTNSTTTTPRGSRNRGPCTLF

SEQ ID NO: 45631 - DNA, 475 bp, Panicum virgatum
  misc_feature: Ceres CLONE 2026141
  misc_feature: Encodes the peptide sequence at SEQ ID NO. 45632
gatttgtctgaggggaagaggctgtactcgctggacgcgggttccatcatccactcgctctgcttctcgcccaaccgctactggctgtgtgctgcgacgcaggactccgtcaagatctgggaccttgagtcgaagcacgtcgtgcaggacctcaagcctgacatccagatctccaagaaccagatcctgtactgcacaagcttgagctggagtgcggatggaagcaccctctacactggctacacggatggatctatcagggtctggaagatctctggattcggctacgcaggctagatggtaaaagccttttggaaggtctaggaagtctttgttcggcaaaacaatgtaatgttccgtcaatattttgactatcgtgagctatattgtctgtttggtacttttcagtcgcccaactatttatgcttagctttgttaatgagctaatcgtactatgaagaatctattttgcacc

SEQ ID NO: 45632 - protein, 98 aa, Panicum virgatum
  misc_feature: Ceres CLONE 2026141
  misc_feature (52)..(90): Pfam Name: WD40 Pfam Description: WD domain, G-beta repeat
DLSEGKRLYSLDAGSIIHSLCFSPNRYWLCAATQDSVKIWDLESKHVVQDLKPDIQISKNQILYCTSLSWSADGSTLYTGYTDGSIRVWKISGFGYAG

SEQ ID NO: 45633 - DNA, 595 bp, Panicum virgatum
  misc_feature: Ceres CLONE 2026159
  misc_feature: Encodes the peptide sequence at SEQ ID NO. 45634
ctctttcttcacgtcggcggacttgttggggaagcgtccgcgaagatgcagatcttcgtgaagaccctgacgggtaagaccatcaccctcgaggtggagagctctgacaccatcgagaatgtcaagataaagatccaggacaaggagggcatccccccagaccagcagcgtctgatctttgccggcaagcagcttgaggacggccgcaccctggctgactacaacatccagaaggagagcaccctccatctagtgttgcgcctgcgcggtggcattattgagccttctctgcagattttggcccgcaagtacaaccaggacaagatgatctgccgcaaatgctatgcccgcctgcacccccgcgctgtgaactgccgcaagaagaagtgtgggcacacgaaccagctgcgccccaagaagaaggtcaagtaaacctcggatttcagttcctttacaaggacagcaggtggaatgggatgtgacctactgccacccctgcctagctgcaacagcacagcagcgccttgtgccttgccttttttggtttggagcgagttagcaactgtgttgggcacctgtaagcgcttatatgcgg

SEQ ID NO: 45634 - protein, 128 aa, Panicum virgatum
  misc_feature: Ceres CLONE 2026159
  misc_feature (6)..(74): Pfam Name: ubiquitin Pfam Description: Ubiquitin family
  misc_feature (77)..(128): Pfam Name: Ribosomal_L40e Pfam Description: Ribosomal L40e family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIENVKIKIQDKEGIPPDQQRLIFAGKQLEDGRTLADYNIQKESTLHLVLRLRGGIIEPSLQILARKYNQDKMICRKCYARLHPRAVNCRKKKCGHTNQLRPKKKVK

SEQ ID NO: 45635 - DNA, 679 bp, Panicum virgatum
  misc_feature: Ceres CLONE 2026165
  misc_feature: Encodes the peptide sequence at SEQ ID NO. 45636
gattccataccaagcaacagagaagcagacaccagatttctttttgaaggacaccttactgtgggacaggagcctccacctccagcatggcttgttgctgataacttagcacgggaattgagcatactaactgaatcctctgggggtcaagatgggaacagcaataggatagagtctagagctgaggatgtgacacctgctataatgaacttcttagaaagcatatcaggaaacagggatctagaaactgccttggaagaatcactgcagggaatcattgagcatccacccagggcacccccagcttcaaaggaagttgttgccaacttacctgtcctaacagttaccgaggaagtcattgccagattgggcattgagacggagtgtgctgtttgtcgtgaaaacttggttgtggatgacaagatgcaggagctaccgtgcaagcatcttttccatcctccgtgcctgaagccatggctggacgagaacaactcatgcccgatctgccgccacgagctgaggacggatgatcatgtgtatgagagcaggaaggagcgcgaaaaggaagaggaggaagacaggaggggagcggcaaatgcccgtaggggtggggaattcatgtatatctgaactcagcagtagcagaatgtggctgagctttgtgatttcttgatgcctc

SEQ ID NO: 45636 - protein, 209 aa, Panicum virgatum
  misc_feature: Ceres CLONE 2026165
  misc_feature (129)..(169): Pfam Name: zf-C3HC4 Pfam Description: Zinc finger, C3HC4 type (RING finger)
  misc_feature: SWISSPROT Homolog: EC 6.3.2.19 Ubiquitin--protein ligase
DSIPSNREADTRFLFEGHLTVGQEPPPPAWLVADNLARELSILTESSGGQDGNSNRIESRAEDVTPAIMNFLESISGNRDLETALEESLQGIIEHPPRAPPASKEVVANLPVLTVTEEVIARLGIETECAVCRENLVVDDKMQELPCKHLFHPPCLKPWLDENNSCPICRHELRTDDHVYESRKEREKEEEEDRRGAANARRGGEFMYI

SEQ ID NO: 45637 - DNA, 673 bp, Panicum virgatum
  misc_feature: Ceres CLONE 2026185
  misc_feature: Encodes the peptide sequence at SEQ ID NO. 45638
atcgcaggcgcttagcaatcgagttatttagaccagccagcttaatcactctgcttcctgcttgtggtcaagcgagtgtgtggatcgagcaatggcaggcaaggcctcagtcgcgctgttcctcgccgtcaacatggtcgtgttcgccatggccagcgcctgcggcggcaactgccccacgccgtcgaccccgtccaccccatccacgccaaccccgacgccggcctccaaaggcaagtgcccccgcgacgcgctgaagctgggcgtgtgcgccaacgtgctgggcctcatcaaggccaaggtcggcgtgccgccagcggagccctgctgcccgctgttggaggggctcgtcgacctcgaggccgccgtgtgtctctgcaccgccatcaagggcaacatcctcggcatcaacttgaacctgcccatcgacctcagcctcatcctcaactactgcggcaagaccgttcccaccggcttcaagtgctaagcatccggccgcgtggtcgcgagtttatgcacgcgtgcgttgatcgtttgaatttctggtgtgtttggctaatctgcattcgtggcggtctgcatgcatgcatggatgggtctgcgcgcgcgctcatgcatgcgtgtatcgatgatcagcttcatttggtttccgttgcttgatctattgttcgtt

SEQ ID NO: 45638 - protein, 131 aa, Panicum virgatum
  misc_feature: Ceres CLONE 2026185
  misc_feature (50)..(131): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 50191
  misc_feature: Useful for making plants with modulated salt sensitivity
MAGKASVALFLAVNMVVFAMASACGGNCPTPSTPSTPSTPTPTPASKGKCPRDALKLGVCANVLGLIKAKVGVPPAEPCCPLLEGLVDLEAAVCLCTAIKGNILGINLNLPIDLSLILNYCGKTVPTGFKC

SEQ ID NO: 45639 - DNA, 813 bp, Panicum virgatum
  misc_feature: Ceres CLONE 2026189
  misc_feature: Encodes the peptide sequence at SEQ ID NO. 45640
atccattcataaagtttctagctagcttagctgcagcacgctagcttgctcttccaagaagctcggcgatctcctctgcttaccaccccttccagcagctaatagctaccctgactggctacttgtgccatggcaacaagatttatcgccgttgcggccgtgatggcagcggccctcgtcggcatggcgtcggcggcggtctacaacgtcggcgagccggccgggtcctgggacctgcggaccaactacggcgactggaccgcctccaagcggttccacccgggcgaccagatcgtcttcaggtactccccgcaggcgcacgacgtggtggaggtgagcaaagcggactacgactcctgctccaccgccaggcccatcgccacccacacctccggcaacgacgccatcgccctgacctccaccggcacgcgctacttcatctgcggcttcaccggccactgcgacgggggcatgaagctccaggtcgaggtggtgcccggcgccaccacctccgtcgccccggctggcgctccgggtgccaacgctccggtctcgccccagaccccatccacgcccgattccgccgctaccaaggccaccgccaccggcttcgctctcgccggggtcttgctcgctgccggcctcatggcctaattaagtagttgctacttactgttgcgtgttgtatttgtaaatgcscatgaatttgcttattaattatcattgattgttgtattcttttggagagatgtccgtacgatgcatgtatgtacgcgtataaagatatgagacactaccggcatatacatagtt

SEQ ID NO: 45640 - protein, 174 aa, Panicum virgatum
  misc_feature: Ceres CLONE 2026189
  misc_feature (34)..(115): Pfam Name: Cu_bind_like Pfam Description: Plastocyanin-like domain
MATRFIAVAAVMAAALVGMASAAVYNVGEPAGSWDLRTNYGDWTASKRFHPGDQIVFRYSPQAHDVVEVSKADYDSCSTARPIATHTSGNDAIALTSTGTRYFICGFTGHCDGGMKLQVEVVPGATTSVAPAGAPGANAPVSPQTPSTPDSAATKATATGFALAGVLLAAGLMA

SEQ ID NO: 45641 - DNA, 703 bp, Panicum virgatum
  misc_feature: Ceres CLONE 2026193
  misc_feature: Encodes the peptide sequence at SEQ ID NO. 45642
aacgaacgctaaagtaacagtttctgtactttattgcttcccgcccaacatggccaccatcggcacgatcaacgaggagggtgtcaacgtcgacctctacatcccgcgcaagtgccacgcgtcgaacacgctcatcgcggcgttcgactatggcgcgatccagctgaacatcggcgagatcgatgccaacggtgtgtacactggcacgacgaagacgctctgcatcgcgggcttcctgcgcgcggagggcgagtccgatcacgcgatcaaccgcctgtgcatcacgcacggcatcattcgcgcgcgcacgggcaagccgaagaagcagaagaagcgtctgccggcccgccagccggccacgaaggcccccgccgccgctggccgcaagccggcgaccggtgcgcgcaagcccgccggtggcgaccgcaagccccgcccgcagggtgaccgcccgcagggtgagcgcaagccgcgcccgcagggtgagcgcccgcagggtgagcgcaagccgcgtccccagggtgagcgcccggcccgcccgcagggcgagcgtccggcccgcccgcagggtgagcgcccgccgcgcccccagggtgagcgcccgccgcgcccccagggtgagcgcaagccgcgcgccccggccgccaagagcgagtaaaccgtaactcgccgcgagagaagcaaccagcgttcctcccttttc

SEQ ID NO: 45642 - protein, 202 aa, Panicum virgatum
  misc_feature: Ceres CLONE 2026193
  misc_feature (8)..(86): Pfam Name: Ribosomal_S21e Pfam Description: Ribosomal protein S21e
MATIGTINEEGVNVDLYIPRKCHASNTLIAAFDYGAIQLNIGEIDANGVYTGTTKTLCIAGFLRAEGESDHAINRLCITHGIIRARTGKPKKQKKRLPARQPATKAPAAAGRKPATGARKPAGGDRKPRPQGDRPQGERKPRPQGERPQGERKPRPQGERPARPQGERPARPQGERPPRPQGERPPRPQGERKPRAPAAKSE

SEQ ID NO: 45643 - DNA, 650 bp, Panicum virgatum
  misc_feature: Ceres CLONE 2026196
  misc_feature: Encodes the peptide sequence at SEQ ID NO. 45644
taaccggccacgtactagctagacaacacaagcatcgtcatcaatggcggcgtcccgtgctgcctcttcggtgtcggtggtcctcttcctcgtcctcgccgccttcgctgccggcgccagcgcggccaccttcaacataaagaataactgcggctacacggtgtggccggcgggcatcccggtgggcggtggcacgcagctggacccaggccagacgtggaccgtcgacgtgcccgccggcacgagcggcaggttctggggccgcaccggctgctccttcaacggcgggagcggccactgcgacagcgccgactgcgccggggcgctgtcctgcacggtctccgggcagccgccggcgacgctggccgagttcaccatcggcggcgcccaggacttctacgacatctcgctggtagacggcttcaaccaggccatggacttctcgtgcagcaccggcgtgaacctgcactgcggtggccctggatgccccgacgcctacctcttccccaacgatgacaccaagacccatgcgtgtgccggcaacagcaactaccaggtcaccttctgcccatgatcaggccgtcagctggtcgtcgaacgaacgatgcatatatacatgatgataatatatgtactactatatatagtgg

SEQ ID NO: 45644 - protein, 176 aa, Panicum virgatum
  misc_feature: Ceres CLONE 2026196
  misc_feature (34)..(176): Pfam Name: Thaumatin Pfam Description: Thaumatin family
MAASRAASSVSVVLFLVLAAFAAGASAATFNIKNNCGYTVWPAGIPVGGGTQLDPGQTWTVDVPAGTSGRFWGRTGCSFNGGSGHCDSADCAGALSCTVSGQPPATLAEFTIGGAQDFYDISLVDGFNQAMDFSCSTGVNLHCGGPGCPDAYLFPNDDTKTHACAGNSNYQVTFCP

SEQ ID NO: 45645 - DNA, 625 bp, Panicum virgatum
  misc_feature: Ceres CLONE 2026237
  misc_feature: Encodes the peptide sequence at SEQ ID NO. 45646
atttttccttcctgcccgcaacccagcccaggcccggcggtccctcgatcctctcggctccggatcggcaagagcccagccgccgccgcccgtagccgcctcgctgccggattcacacgacacctcgtcggcgtctctttctctctctcttctgcggcgcgcaccggtactcggaccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagggtgctgtcatcacgctgttctggagaatcccacaaacaagaagaagatggtttgattgatgaagg

SEQ ID NO: 45646 - protein, 137 aa, Panicum virgatum
  misc_feature: Ceres CLONE 2026237
  misc_feature (89)..(118): Pfam Name: zf-AN1 Pfam Description: AN1-like Zinc finger
FFLPARNPAQARRSLDPLGSGSARAQPPPPVAASLPDSHDTSSASLSLSLLRRAPVLGPPFSPAANRPPAGPAESPSKAPRTSSSINRCHSCRKRVGLTGFRCRCGELFCGYDYKGVARDAIARENPVVRAAKIVRF

SEQ ID NO: 45647 - DNA, 610 bp, Panicum virgatum
  misc_feature: Ceres CLONE 2026284
  misc_feature: Encodes the peptide sequence at SEQ ID NO. 45648
gtggagtcaggagtccgctccttcaactctgctctccccttccttcccctccccccgtcccctgtccgtctccgcccagatccagatccagtttgctcattcatgtttcagggttcaatcaccacaccaggataagcaaccgagacaatggcggcagactctagcgctcgtaggcagccaaccttcaccaaggttgaccagctgcgcccggggacccatggccacaacctcattgtcaaggtcgttgactccaagatggtcgtccagaggggccgcgatggagggccgcagggcaggcagatgcggattgctgagtgcttggtcggcgatgaaaccggcatcatcgtcttcactgcaagaaacgaccaagtggatgtaatgaagcctggaacaactgttgaactgaggaatgcaaagattgacatgttcaagggttcgatgcggctcgccgttgacaagtggggaattgtgaaagctgcagaaagcccagctgagtttgcagtcaaggaggacaacaacctgtccttgattgagtttgagctggtgaccgtggtggagtgaaaaccaccttttgtaggaggatgttgcgttatgttatgttgttgaacct

SEQ ID NO: 45648 - protein, 137 aa, Panicum virgatum; identical to SEQ ID NO: 40098
  misc_feature: Ceres CLONE 2026284
  misc_feature: Functional homolog of the protein sequence given in SEQ ID NO 50161
  misc_feature: Useful for making plants with modulated drought sensitivity
  misc_feature: Useful for making plants with modulated water use efficiency

SEQ ID NO: 45649 - DNA, 835 bp, Panicum virgatum
  misc_feature: Ceres CLONE 2026291
  misc_feature: Encodes the peptide sequence at SEQ ID NO. 45650
atctccggcagcccatccagatcgtcggcggcgaactccctccattgacacacaactaacgtagcgatggagctcgtcaagtccagggccgccgcgtgcgctctcctgcttgtgctgctcgtcctcacacgtacacacgcgcgcgcacgctctctcagtctctctatcttatctactatgctaactccgatcgccgctgctgctgaaggacggctctaattaaaaagcttaccacatgcttgtatcctacgcagacgacggcggcggcggcgggatggtggcggtggaggcgcgggtgtgcacggggaagagccagcaccactccttcccctgcatctccgaccgcctctgcacccgcaactgcgtcagcgagggcggcggatggaccgccggctactgccaccacaggttctgcacctgccagaaggcatgctagctgatcgtgatcctcacctcgcggcagcgggggatcggccagctcgtccgctcccaccttccttccgacaatcttcgccgcacgtatgcgctgcgctctgttgtcagtgcagaaccatgcatgggtgtcgccatgtaagagtaatgatatactacaacaggaataataagagcaggaccggcggcgcccgtgtgtgtgtgcacccgcgcaatggtcaactgtactgcccctcaaaaaaaaaagcccgttggcttgaaatggcccattacatcaatcagcctgacttatcatcacattatcatacacgaaaacagtagaattttatcaagttttcaggaaaatcataaagaaggatattgtagcactctttaaagattttcataaagaacgcctactcct

SEQ ID NO: 45650 - protein, 66 aa, Panicum virgatum
  misc_feature: Ceres CLONE 2026291
  misc_feature (20)..(66): Pfam Name: Gamma-thionin Pfam Description: Gamma-thionin family
MLVSYADDGGGGGMVAVEARVCTGKSQHHSFPCISDRLCTRNCVSEGGGWTAGYCHHRFCTCQKAC

SEQ ID NO: 45651 - DNA, 644 bp, Panicum virgatum
  misc_feature: Ceres CLONE 2026294
  misc_feature: Encodes the peptide sequence at SEQ ID NO. 45652
acgcaacgcaatcttgcaatccagcccccgaaagaggcctaaaaaccgccaccaggcttttttcgatcgcgccgagggaggacgaacaatggcggccgaggagggagtcgtgatcgcgtgccacaccaaggaggagttcaagaaccagatgaccaaggccaaggatgccggcaagctggtgatcattgacttcactgcctcctggtgtggtccttgccgcatcatcgccccggtttttgctgaattagccaagaagttcactgacgctttcttcctgaaggtcgatgttgacgagctgaaggaagtagcctcagagtacgagatccaggcgatgccgaccttcctcttcattaagaacggtgagaagatccacactgttgttggtgccaggaaggaggacctccagaccagcatcgagaagcacgcctccgccactgctgcttccgcctccgcctaaggcaatagcgccaccagttatcaataagggccagcccacggcgtggtagcagtaggcgtcgtaattttcagtttggtttgggtgaattgtgagctatgttcaaatctggagtcctgatatgtttggttcctgtgctggacctgttatcgtcctgaatacctgtgttgatatggatgctttgtgaccg

SEQ ID NO: 45652 - protein, 122 aa, Panicum virgatum; identical to SEQ ID NO: 18184
  misc_feature: Ceres CLONE 2026294
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase

SEQ ID NO: 45653 - DNA, 582 bp, Panicum virgatum
  misc_feature: Ceres CLONE 2026309
  misc_feature: Encodes the peptide sequence at SEQ ID NO. 45654
gtgctctctcagaggtgggttggcttctcctccccctccggttcgcggttcggttcggtccggtttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgccagggcggcggcggctactgcggcggcggcggcggctacaggcgccgcgagggcggcggcggctactgcggcggcggcggcggctactgtggctacagcggcggcggtggcttcggtggtcgtggaggctacggcggcggcggcggcggcggctacggcaactccgatgggaactggaaga

SEQ ID NO: 45654 - protein, 162 aa, Panicum virgatum
  misc_feature: Ceres CLONE 2026309
  misc_feature (10)..(81): Pfam Name: RRM_1 Pfam Description: RNA recognition motif. (a.k.a. RRM, RBD, or RNP domain)
  misc_feature (48)..(158): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRRQGGGGYCGGGGGYRRREGGGGYCGGGGGYCGYSGGGGFGGRGGYGGGGGGGYGNSDGNWK

SEQ ID NO: 45655 - DNA, 664 bp, Panicum virgatum
  misc_feature: Ceres CLONE 2026318
  misc_feature: Encodes the peptide sequence at SEQ ID NO. 45656
ggttcctcttctttggggatgatattgtgcctacgtcacgcgtaacttgggtacctatgtctcggagcacatctgggaactactactcagctggctcaggatcgctgcagtttgatgggcgttcactaggcgtaaagcctatggaggtcgtatttgacagtggtagcacctatacctactttactgcccagccataccaagctgttgtctctgcgctcaagggtggtctcagcaaatcacttaaacaggtgtcagatcctgagctgcctctgtgctggaaagggcaaaaggcattcaaatctgtgtttgacgtcaagaaggaattcaagccactgtctcttagctttcccaatgccaagaatgctgtcatggacatccctcctgaaaactacctcgttgtcactaaaaatggaaatgcgtgcttgggcatccttgacggaacgacagctaagctgagtttcaacgtaattggagacatcacgatgcaggatcagatggtgatatatgataatgagaaagcgcagattggatgggtgcgtggaccatgcaggagtgccaagtctattctgtcttcctttccatgaccatttcccatattagaaccatgggctcttgaatccgtttccgtatactgctgctggagtttgtgaaaattactatcatc

SEQ ID NO: 45656 - protein, 193 aa, Panicum virgatum
  misc_feature: Ceres CLONE 2026318
  misc_feature: SWISSPROT Homolog: EC 3.4.23.12 Nepenthesin
FLFFGDDIVPTSRVTWVPMSRSTSGNYYSAGSGSLQFDGRSLGVKPMEVVFDSGSTYTYFTAQPYQAVVSALKGGLSKSLKQVSDPELPLCWKGQKAFKSVFDVKKEFKPLSLSFPNAKNAVMDIPPENYLVVTKNGNACLGILDGTTAKLSFNVIGDITMQDQMVIYDNEKAQIGWVRGPCRSAKSILSSFP

SEQ ID NO: 45657 - DNA, 537 bp, Panicum virgatum
  misc_feature: Ceres CLONE 2026322
  misc_feature: Encodes the peptide sequence at SEQ ID NO. 45658
gtacatacaggagccacagcaaccatcaaagttcaagaacgtggttagcacacataactcctctctctctctctctctctctctctctctctctctctctccaccaggagaggcggaggctgaaactgctgctatttttcatattattactgataggacacaccagcgaaaatgagcagtggcagcggtaagagctcgtggccggaggtggttgggctgccggccgaggcggcgaagcagaagatcctggccgaccggccggacgtgcagatggttgtgctgcccgtgggctccttcgtgaccactgagttcaaccccaagcgcgtccgcgtcttcatcaacccggccggcgacgttgcgcaggtccccaagatcggctaggaccggcgcatggagcacattcgtgatgatccatcgcagataatatacacataatatattattttcatgatgaataatgctctcagggtgatgtctcatttgtgcaatcatgtaaaccagcaaataatgttgttacttcatgtccaataaacaaat

SEQ ID NO: 45658 - protein, 69 aa, Panicum virgatum
  misc_feature: Ceres CLONE 2026322
  misc_feature (7)..(69): Pfam Name: potato_inhibit Pfam Description: Potato inhibitor I family
MSSGSGKSSWPEVVGLPAEAAKQKILADRPDVQMVVLPVGSFVTTEFNPKRVRVFINPAGDVAQVPKIG

SEQ ID NO: 45659 - DNA, 508 bp, Panicum virgatum
  misc_feature: Ceres CLONE 2026342
  misc_feature: Encodes the peptide sequence at SEQ ID NO. 45660
caggtcaagaaggacggcaagtggttcgccgtgaaggctctcgaaggcgccttcatcgtcaacgttggtgacgtcattgagatcatgagcaatgggaaattcaaaagtgttgagcacagggccgtgatacacccaaccaaagagcgaatttctattgcactgttccaccatccttgccaggatatggtggttggtcctctgccagagttcatgaaaggcgataaagtgcgttacagataaaccaattaccaggattacttgaagcagtacttcacagcaaaacttgatgggagggtgcacgtagagagattgaagttggagcagtagctaccacttctaccgtacatcgtgagggatggcagttcaaaaaatatcttgtccacgaatatgagtaccggagaataattctatcttcgactatacagcatgagtagtgtttattctcaagctttatgtatgtatgcatctatcctgcattcctccagaaaataaacatgagtatttggac

SEQ ID NO: 45660 - protein, 79 aa, Panicum virgatum
  misc_feature: Ceres CLONE 2026342
  misc_feature: SWISSPROT Homolog: EC 1.14.11.9 Flavanone 3-dioxygenase
  misc_feature: Functional homolog of the protein sequence given in SEQ ID NO 51075
  misc_feature: Useful for making plants with modulated oxidative stress sensitivity
QVKKDGKWFAVKALEGAFIVNVGDVIEIMSNGKFKSVEHRAVIHPTKERISIALFHHPCQDMVVGPLPEFMKGDKVRYR

SEQ ID NO: 45661 - DNA, 697 bp, Panicum virgatum
  misc_feature: Ceres CLONE 2026344
  misc_feature: Encodes the peptide sequence at SEQ ID NO. 45662
  misc_feature (610)..(610): n is a, c, t, g, unknown, or other
acaaaacggggccagcagacccgcgcatcagccagtaagtagcaacacaattccaaggagtagtttcttggcaagctgaccgatcgcgtcagcaagtagcaaatccaagcaagaaaaatggcagcgagggcggcgccgttctggctcctggccgcggcgctggtcgcggcggcgtccgcgcagtcctccggctccggcggcggcgactgcacgtcggcgctggtgagcctgtccccgtgcatggactacatcagcggcaacggcacgtcggcgcccagcgcctcgtgctgctcgcagctcaaggccgtggtgcagtccaagccgcagtgcctctgcgccgcgatcggcggcggcgcctcgtcctccctcggcggcgtcgagatcgaccggtcgcgcgcgctcggtctccccgccgcctgcaacgtccagaccccgcccgccagccggtgcaacgccgggtcgtcgggcggcgggtcgaaggcgacgccatccctgccatccggcgccgcggcgctccggtggccggcgggtctcgtgctcggcctcgccgtggctgcggtctacgccgcgactgctgcgtgatgcgcggagcgtggcgattcaggacgcngtgcgtcgtgtaaactttcttttcagcagcacttcgggaggaggatttccagcgttgtgtgtgcctctactctatggatttgtgtca

SEQ ID NO: 45662 - protein, 154 aa, Panicum virgatum
  misc_feature: Ceres CLONE 2026344
  misc_feature (31)..(111): Pfam Name: Tryp_alpha_amyl Pfam Description: Protease inhibitor/seed storage/LTP family
MAARAAPFWLLAAALVAAASAQSSGSGGGDCTSALVSLSPCMDYISGNGTSAPSASCCSQLKAVVQSKPQCLCAAIGGGASSSLGGVEIDRSRALGLPAACNVQTPPASRCNAGSSGGGSKATPSLPSGAAALRWPAGLVLGLAVAAVYAATAA

SEQ ID NO: 45663 - DNA, 529 bp, Panicum virgatum
  misc_feature: Ceres CLONE 2026352
  misc_feature: Encodes the peptide sequence at SEQ ID NO. 45664
gtctagccaccgcacgatcactcaatccctcctcgccctcctcccacaaagatgaaccgtctgtccctcgtctcgcgccccgccgcctccctcgtcctccgccagtcggccaccgccaacatgatggccatcaggcgcttctcagaggacatcaacccctcccgtctcttcgtcggcggtctctcgtggaacaccgatgacaacaagctcagggaggcctttgaggacttcggcgaggtcaggcacgtgcgagttgtgctcaacagggagaccggtcgctcgcgcggcttcggcttcgtgaccttccagtcggccgacgatgccaagacggctgccgagtcgatgcacgacaaggagctcgatggccgcaggctgagcgtctcctacgccaggaacacccccaacccccgccagggcttcgagagccgccccaccgaggacaaggagggtggcagcttctaagaggccagcaatttcttcatccccttcacatatcgacccgaaatcgaataaatttcacatccaacac

SEQ ID NO: 45664 - protein, 113 aa, Panicum virgatum
  misc_feature: Ceres CLONE 2026352
  misc_feature (16)..(87): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50182
  misc_feature: Useful for making plants with modulated biomass
MMAIRRFSEDINPSRLFVGGLSWNTDDNKLREAFEDFGEVRHVRVVLNRETGRSRGFGFVTFQSADDAKTAAESMHDKELDGRRLSVSYARNTPNPRQGFESRPTEDKEGGSF

SEQ ID NO: 45665 - DNA, 748 bp, Panicum virgatum
  misc_feature: Ceres CLONE 2026354
  misc_feature: Encodes the peptide sequence at SEQ ID NO. 45666
tgacagtcacggcacgccggcatccccccggcaccgccgcaccaccattccccaggccttcgcctcccatggcgaccagggcggcggcagccacgctcacggcggccacgtcctctctcctcgggcgctctccctcgctgcggtcgcatagcctccgggtcccccgccaagtgcctccccagagatttgtgcgccacgttgcttcatcggcaaatgaggaagctgctgccagagcagctgctgccactgctgatactggaggaccaaccattttcgacaagatcgtctcaaaggagattccttcaagcgttgtctatgaagatgacaaagtcttagcatttagagatattaatccacaagcccctgtgcacgttctagtcatcccaaaagtgagagatggactaactggactatccaaggctgaaccaaggcatgctgagattctgggccagcttctttacgcagcgaaagtagtcgctgagaaagaaggtttggcaaatgggtaccgtgtcgtcataaacgatggagctgaaggatgtcaatctgtctatcatttgcacttgcatgtactcggtggaaggcagttgaagtggcctcccggttaattacagagtgggacacatttactttattttgtatccctgtctctgagttttctgtgtgtctgactgttgtttcaaaaagagaacgaatttgtacaactgtgtgcccctgtgatggccccctttgagcaatcatctctgtggtc

SEQ ID NO: 45666 - protein, 178 aa, Panicum virgatum
  misc_feature: Ceres CLONE 2026354
  misc_feature (74)..(173): Pfam Name: HIT Pfam Description: HIT domain
  misc_feature: SWISSPROT Homolog: EC 3.6.1.17 Bis(5'-nucleosyl)-tetraphosphatase (asymmetrical)
MATRAAAATLTAATSSLLGRSPSLRSHSLRVPRQVPPQRFVRHVASSANEEAAARAAAATADTGGPTIFDKIVSKEIPSSVVYEDDKVLAFRDINPQAPVHVLVIPKVRDGLTGLSKAEPRHAEILGQLLYAAKVVAEKEGLANGYRVVINDGAEGCQSVYHLHLHVLGGRQLKWPPG

SEQ ID NO: 45667 - DNA, 489 bp, Panicum virgatum
  misc_feature: Ceres CLONE 2026362
  misc_feature: Encodes the peptide sequence at SEQ ID NO. 45668
gacaacgcttctaatcccaccaaccactattttgatcatcaacctggttggtgtggttgccggcatttcctatgcgatcaacagcggctaccagtcgtgggggcctctctttgggaagctcttctttgccttctgggtgattgtccacttgtaccccttcctcaagggtctcatggggaggcagaaccgcacgcccaccattgttgtcgtctgggccatcctactcgcatcgatcttctccctgctgtgggttcgcatcgatccattcaccacccgggtcactggtcctgatattgtaaaatgcggcatcaactgctagaatggtcgaaaatattaggaatgtaattggcacccattgtgttgtaagttatcagcgggtgacactttctattatggtaggaactcagttgtcagaactttactttcgtatgcactaatatgtaccttggatatcggttaccgataagttaaaatcactgccttgtttgg

SEQ ID NO: 45668 - protein, 105 aa, Panicum virgatum
  misc_feature: Ceres CLONE 2026362
  misc_feature: SWISSPROT Homolog: EC 2.4.1.12 Cellulose synthase (UDP-forming)
  misc_feature: Functional homolog of the protein sequence given in SEQ ID NO 51427
  misc_feature: Useful for making plants with altered cell wall content and/or composition
  misc_feature: Functional homolog of the protein sequence given in SEQ ID NO 50122
  misc_feature: Useful for making plants with modulated biomass
  misc_feature: Functional homolog of the protein sequence given in SEQ ID NO 50124
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 26 in US patent 7312377
  misc_feature: The sequence is a functional homolog of SEQ ID NO 2 in US patent 7049481
  misc_feature: Functional homolog of the protein sequence given in SEQ ID NO 50125
  misc_feature: Useful for making plants with modulated plant growth and development
TTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDIVKCGINC

SEQ ID NO: 45669 - DNA, 694 bp, Panicum virgatum
  misc_feature: Ceres CLONE 2026365
  misc_feature: Encodes the peptide sequence at SEQ ID NO. 45670
agaggacgtcccgaaaggagagagagagagaggcacgcgcagcatccattccttgccgctgccgccgcacactcccattgcagagccccaccccgcgcaaaagcagagcagccactttcccctcccgctccccatctccgtcctcctcccatggcgagctcgacgcgcggcgcgctcctcctcctcctcgcgctgctggcgctggcggcggcggcccgcgcgggcgacgtgccggcggcggcgctgggctgggagctcggggtggtgggcgccgcggaggacgaggagttcggcttccccgccggcggcgactccgtggcgcgccgggtgctgcagggcgggtccgggtacatcagctacggcgcgctgcggcgggacaacgtgccgtgctccgtgcggggggcctcctactacaactgccgccccggcgcgcaggccaacccctactcgcgcggctgctccgccatcgcccgctgccgcggctgatccctcgcccgcccgcccgcccgcccgcttcggcaccggcgaccgccgggaggaataggagaaggttcatcccgttaatccctcgccgttcagcagaaaaaaaaaggaaactgttcatctgccccttttaatcaattgttattgttattagtgcttggtatgtactgaatttggtggtgggctgataatgtgttttctgaaggtggat

SEQ ID NO: 45670 - protein, 111 aa, Panicum virgatum
  misc_feature: Ceres CLONE 2026365
  misc_feature (45)..(111): Pfam Name: RALF Pfam Description: Rapid ALkalinization Factor (RALF)
MASSTRGALLLLLALLALAAAARAGDVPAAALGWELGVVGAAEDEEFGFPAGGDSVARRVLQGGSGYISYGALRRDNVPCSVRGASYYNCRPGAQANPYSRGCSAIARCRG

SEQ ID NO: 45671 - DNA, 667 bp, Panicum virgatum
  misc_feature: Ceres CLONE 2026370
  misc_feature: Encodes the peptide sequence at SEQ ID NO. 45672
cccgtcctcgctgcggctccccccatccttccgctgcgagtgcctgctgcggcgctccgtcgtccgcgtccagatccggccaccaatcgatccggcctccggcatggctgcggcggcgagggcggcgggagccctggcgctggcgctcgtgctcgcgctggcgggggccaactccgagggggacgcgctctcggcgctgcgccgcagcctcagggaccccggcggcgtgctccagagctgggaccccacgctcgtcaacccctgcacctggttccacgtcacctgcgaccgcgagaaccgcgtcacgcgcctagatcttggaaatttgaacttatctggtcatctggtgcctgaacttgggaaattggagcatctgcagtatctggaactttacaagaataacattcaaggaacaatcccgtctgagcttggtagcttgaagagtctaataagcttggacttgtacaagaacaacatttcagggacaatacctcctgcccttggaaagctgaagtcccttgtattcttgcggctcaatgggaatcgtttgactgggccaatcccaagggaactggctggaatatctagtctcaaagttgttgatgtttcaagtaatgatttgtgcggaacaattcccacctccggaacatttgagcacattcctctg

SEQ ID NO: 45672 - protein, 187 aa, Panicum virgatum
  misc_feature: Ceres CLONE 2026370
  misc_feature (22)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAARAAGALALALVLALAGANSEGDALSALRRSLRDPGGVLQSWDPTLVNPCTWFHVTCDRENRVTRLDLGNLNLSGHLVPELGKLEHLQYLELYKNNIQGTIPSELGSLKSLISLDLYKNNISGTIPPALGKLKSLVFLRLNGNRLTGPIPRELAGISSLKVVDVSSNDLCGTIPTSGTFEHIP

SEQ ID NO: 45673 - DNA, 667 bp, Panicum virgatum
  misc_feature: Ceres CLONE 2026389
  misc_feature: Encodes the peptide sequence at SEQ ID NO. 45674
gacgcgccaggcctggcaatggcccgcgcgtttggggacttctgcctcaaggattacggtgtcatctctgtaccagagttcttccactggtcacttacggagaaggatcaattcgtcgtccttgcatcagatggggtgtgggatgtccttagcaaccagcaggcagtggacatagtgtcgtcatccccgagccgatcaaaggccgcaaaatccctagttgaggcagctacccgtgaatggaaaaccaaataccctacatccaagatcgatgactgcgtagtggtttgcctatatttggatggcaaaatggaccacgagcgagactcgactgcctccatggacaacatcagcgtggacgagggttcagtagcagacccgaatgaagctccggagcaggagccagctctaacccggaatttcacggtcagaactgttgctgggagcgcccatgagaaggtgctggctggggcaacggatgcagtggtcgctggcgcagctcatgatcagaattggtcaggccttgatggggtgacgcgggtgaactcgctcgtccagctccccaggttctccgaggagaaggcgatcggctgaggagctgcgattctttgttcttaattaacttattctcttctgtttgaatttagtttagtcgccagttgtttgagag

SEQ ID NO: 45674 - protein, 196 aa, Panicum virgatum
  misc_feature: Ceres CLONE 2026389
  misc_feature: SWISSPROT Homolog: EC 3.1.3.16 Phosphoprotein phosphatase
DAPGLAMARAFGDFCLKDYGVISVPEFFHWSLTEKDQFVVLASDGVWDVLSNQQAVDIVSSSPSRSKAAKSLVEAATREWKTKYPTSKIDDCVVVCLYLDGKMDHERDSTASMDNISVDEGSVADPNEAPEQEPALTRNFTVRTVAGSAHEKVLAGATDAVVAGAAHDQNWSGLDGVTRVNSLVQLPRFSEEKAIG

SEQ ID NO: 45675 - DNA, 573 bp, Panicum virgatum
  misc_feature: Ceres CLONE 2026405
  misc_feature: Encodes the peptide sequence at SEQ ID NO. 45676
aatccctcttccccaatctctcgccctcctgcctcccccgtgcgccgcagctagaaagctagggtttcgcctgcgatccgatccgtcgagtccaccctccccacccagatcgatggcggccgagggcgataagaagatgatcaccctcaagagctcggacggcgaggagttcgaggtggaggaggcggtcgccatggagtcgcagaccatccgtcacatgatcgaggacgactgcgccgacaacggcatcccgctccccaacgtcaactccaagatcctctccaaggtaatcgagtactgccagactgttgctgacatgatcaagggcaagactcctgaggagatccgcaagaccttcaacatcaagaacgacttcacccctgaggaggaagaggagatccgcagagagaaccagtgggccttcgagtagagaggcgcttgagcccctgatctcttgatgcctaggttttgtcgtacctattaccttgcaatgtctgcttttatgtgtcgtcgtaatggttgtaagtattttgggagttgctgtggttggtttgagaacaagtgttgatcatc

SEQ ID NO: 45676 - protein, 105 aa, Panicum virgatum
  misc_feature: Ceres CLONE 2026405
  misc_feature (8)..(68): Pfam Name: Skp1_POZ Pfam Description: Skp1 family, tetramerisation domain
  misc_feature (48)..(105): Pfam Name: Skp1 Pfam Description: Skp1 family, dimerisation domain
MAAEGDKKMITLKSSDGEEFEVEEAVAMESQTIRHMIEDDCADNGIPLPNVNSKILSKVIEYCQTVADMIKGKTPEEIRKTFNIKNDFTPEEEEEIRRENQWAFE

SEQ ID NO: 45677 - DNA, 675 bp, Panicum virgatum
  misc_feature: Ceres CLONE 2026410
  misc_feature: Encodes the peptide sequence at SEQ ID NO. 45678
gatcgagcacgcgctggccaacggcgacgccgagcgcgtcgcggagacgtccatcttcgccaaggtggccgagttcgagcagcaggtgcgcaccgcgctgcccaaggaggtggaggccgcgcgcgccgccgtggagagcggcaaccccatggtccccaatcggatcagggagtgccgctcgtacccgctgtaccggttcgtccgcgaggagctcggcaccgagtacctgaccggcgagaagacccggtcgcccggcgaggagctcaacaaggtgctggtggccatcaaccagcgcaagcacatcgacccgctgctccagtgcctcaaggagtggaagggtgagcccctgccgctctgctgaactgcctgcccccacaggcaggaggagaggaaaccaacacacagaagaaaaacacaaacaaaagtatagcgtctcgagacagagcatttcaagatcattgtgaagttctacgatcagtctagctgatgatactctctatatttttaccgttcccttgtagctaaagttcattgtgaatgttgttgtgttcttgatgctgagacgccatggcctctgcaatgtgcgtggcctgggcatctgcatctgctgaaacttttactacctactttttaacttgtgtaagttgggggtaaagtaaattattttgttctacc

SEQ ID NO: 45678 - protein, 119 aa, Panicum virgatum
  misc_feature: Ceres CLONE 2026410
  misc_feature: SWISSPROT Homolog: EC 4.3.1.5 Phenylalanine ammonia-lyase
  misc_feature: Functional homolog of the protein sequence given in SEQ ID NO 50787
  misc_feature: Useful for making plants with altered cell wall content and/or composition
  misc_feature: Useful for making plants with altered lignin content
IEHALANGDAERVAETSIFAKVAEFEQQVRTALPKEVEAARAAVESGNPMVPNRIRECRSYPLYRFVREELGTEYLTGEKTRSPGEELNKVLVAINQRKHIDPLLQCLKEWKGEPLPLC

SEQ ID NO: 45679 - DNA, 601 bp, Panicum virgatum
  misc_feature: Ceres CLONE 2026411
  misc_feature: Encodes the peptide sequence at SEQ ID NO. 45680
gtgctctctcagaggtgggttggcttctcctccccctccggttcggttcggttcgggttcgtgaggttcttggggttccgttcgggggctagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggcggcggcggctacggtcgccgcgagggcggtggcggctacggcggcggcggcggcggcggcggcggcggcggctacggtggccgtggaggctacggtggcggcggctacggtggcaaccgcggcggctgctaccgcaactcctatgggaactggaggagctgagcgggtggg

SEQ ID NO: 45680 - protein, 163 aa, Panicum virgatum
  misc_feature: Ceres CLONE 2026411
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
MEASDVEYRCFVGGLAWATDDNSLHNAFSPYGEVLESKIILDRETQRSRGFGFVTFSSEQAMRDAIEGMNGKELDGRSITVNEAQSRGGPRSGGGGGYGRREGGGGYGGGGGGYGRREGGGGYGGGGGGGGGGGYGGRGGYGGGGYGGNRGGCYRNSYGNWRS

SEQ ID NO: 45681 - DNA, 538 bp, Panicum virgatum
  misc_feature: Ceres CLONE 2026424
  misc_feature: Encodes the peptide sequence at SEQ ID NO. 45682
gtcatccacatcccaagtcctccaaaatgggtcgcgtcagaaccaaaacagtcaagaaagcagcacgtttagtagttgaaagatactatccaaaattgacattagactttcaagtcaacaagaaaatctgcggtgaggtcgcagttatcccttcaaaacgcctccgaaaccaaattgctggtttcgtcactcatctcatgaaacgaattgctagaggaccagtaagaggaatttcattagttttacaagaagaagaaagagaacgaagagacaactacgttccagctgaaaccattctagcatcaatggttcataaaaccgaagttgatgatacaaccaaagaaatgctggcagcaatgtgcgattttggaaaacttggtatccaatctgcatcagaaaaagcagcgcagccatctggtttccgtgataaccgattcccacctcgccgaactgaccgaaaataaaactaaacaataaaggaggccgatgttggttacttactaagattctgactcaataaaatcctgtattttggatt

SEQ ID NO: 45682 - protein, 145 aa, Panicum virgatum
  misc_feature: Ceres CLONE 2026424
  misc_feature (1)..(125): Pfam Name: Ribosomal_S17e Pfam Description: Ribosomal S17
MGRVRTKTVKKAARLVVERYYPKLTLDFQVNKKICGEVAVIPSKRLRNQIAGFVTHLMKRIARGPVRGISLVLQEEERERRDNYVPAETILASMVHKTEVDDTTKEMLAAMCDFGKLGIQSASEKAAQPSGFRDNRFPPRRTDRK

SEQ ID NO: 45683 - DNA, 659 bp, Panicum virgatum
  misc_feature: Ceres CLONE 2026435
  misc_feature: Encodes the peptide sequence at SEQ ID NO. 45684
attccccccagcacacagagaaggtaatccacactcgcactactggatcatttgctttgcttagcgcgaccgccgatcgataattaataataatacaccggatgtggcggttctgatgatgaagaacaagaagcacatgcgagcggtggtggccttggccgatgtggtggcggcggccgcgctggaggagtccgactcggcggtcatcacctgcgggcaggtgggttcggtgctggcaccatgcatcccgtacgcgacggggaaggcgagcgcgctgccctcgtcgtgctgccgtggtgtgcgcaccctcaactgcgcggcgcgcacgaactcagaccggtacgcggggtgccggtgcctctggatcctggccagcaccgtcaagtcggtgaacatgggcaccgtcgccaccatccccggcaggtgcggcgtctgcgtgccattccctatcaccatgtcgactgagtgcaacaagaccatctaaattaatcttacatcatatatgctgctacctgatggtgagaagcttggtccttcagaagatagctacgagctatttattatgacaataaaatatagttgttcacgcatcatcatcagcatcatctatactattttgtagtactaattaattaattaattaaatgttgtactcgatc

SEQ ID NO: 45684 - protein, 122 aa, Panicum virgatum
  misc_feature: Ceres CLONE 2026435
  misc_feature (33)..(118): Pfam Name: Tryp_alpha_amyl Pfam Description: Protease inhibitor/seed storage/LTP family
MMKNKKHMRAVVALADVVAAAALEESDSAVITCGQVGSVLAPCIPYATGKASALPSSCCRGVRTLNCAARTNSDRYAGCRCLWILASTVKSVNMGTVATIPGRCGVCVPFPITMSTECNKTI

SEQ ID NO: 45685 - DNA, 452 bp, Panicum virgatum
  misc_feature: Ceres CLONE 2026448
  misc_feature: Encodes the peptide sequence at SEQ ID NO. 45686
attcaactccgcgtagtaacccctaaacaacatgtctggctggcaagattacatcacaaccaacttagttggatctcaacatatcgctcgtgctttgatctgtggaactgacggaacctggtgggcaggatctgacgacttcgctccatcaagcgctgaaattcaagccattattgctggattctctgatggtggtgcacaacttcgtgcaaagggaatgttcatccaaggaaacaaataccttcttcttcgcgctgatgaacaatcaatctacggaaagtttggacaaggaggagttgctgctgccaaatgcaacacctgtgtcatcatctccgtctatgttgaaaagatgtccccaggaaactgcaacaacgccactgaaactttggctgaatacttgagagacaacaactactaaacaaccctaaataaacgacgttgttcaaatttac

SEQ ID NO: 45686 - protein, 128 aa, Panicum virgatum
  misc_feature: Ceres CLONE 2026448
  misc_feature (3)..(123): Pfam Name: Profilin Pfam Description: Profilin
MSGWQDYITTNLVGSQHIARALICGTDGTWWAGSDDFAPSSAEIQAIIAGFSDGGAQLRAKGMFIQGNKYLLLRADEQSIYGKFGQGGVAAAKCNTCVIISVYVEKMSPGNCNNATETLAEYLRDNNY

SEQ ID NO: 45687 - DNA, 629 bp, Panicum virgatum
  misc_feature: Ceres CLONE 2026454
  misc_feature: Encodes the peptide sequence at SEQ ID NO. 45688
gatgaacgcacactctcacttatctcccttaaaaatgcgaaacctggacacagtgatatgcccatgcattctgctgcagtccgaatccaaaataagtttagagggtggaaaggaagaaaggaatttatgattatccgtcagaaaattgtgaagatacaggcccatgtacgaggacatcaggtaaggaaaaactatcggaaggtagtctggtctgttggcatcgtggaaaaagtcatactgaggtggaggagaaagagaaggggtctgcgaggtttccaacctgagaaacaacttgaaggcccatcatcgcagatccaacctgtgaagtctgaagcggaggatgaatacgatttcttgaaggatggcaggagacaggctgaaggcaggctacaaagagcactcgctcgtgtgcattccatgactcagtatccagaagcaagggaccagtaccgcaggttgcaaaactgtgttaacgagctgcaagagtctcaggcaatgcaggataggatgctaagtgacacagctggcgctgatgggaatgatttgatggctgaactggaggagctatgccggggcgatggcgatgcgccaatgtcgactatttcgtgacattgagcttactagatcag

SEQ ID NO: 45688 - protein, 202 aa, Panicum virgatum
  misc_feature: Ceres CLONE 2026454
  misc_feature (46)..(66): Pfam Name: IQ Pfam Description: IQ calmodulin-binding motif
  misc_feature: The sequence is a functional homolog of SEQ ID NO 1309 in the 10/666,642 US patent application
  misc_feature: The sequence is a functional homolog of SEQ ID NO 1308 in the 10/666,642 US patent application
  misc_feature: Functional homolog of the protein sequence given in SEQ ID NO 51211
  misc_feature: Useful for making plants with altered alkaloid content
  misc_feature: The sequence is a functional homolog of SEQ ID NO 588 in the 10/666,642 US patent application
DERTLSLISLKNAKPGHSDMPMHSAAVRIQNKFRGWKGRKEFMIIRQKIVKIQAHVRGHQVRKNYRKVVWSVGIVEKVILRWRRKRRGLRGFQPEKQLEGPSSQIQPVKSEAEDEYDFLKDGRRQAEGRLQRALARVHSMTQYPEARDQYRRLQNCVNELQESQAMQDRMLSDTAGADGNDLMAELEELCRGDGDAPMSTIS

SEQ ID NO: 45689 - DNA, 558 bp, Panicum virgatum
  misc_feature: Ceres CLONE 2026461
  misc_feature: Encodes the peptide sequence at SEQ ID NO. 45690
aatatatataaaaaaaattaattaaacaaaaaaacatggataacagagacaaggacgaagattacgaagttggtgatgactacgatcccgaagctgaaaccgtcgatttcggtggtgaaaagaagctcaaccttcccgaagtccccgtccaaactggtgaagaagacgacgaacaagttgccaaatacagatgcaaattgtacagatgggccaagtctgaatggaaggaaagaggcgctggtgacctcagattcctcaagaacaagagcaccaacaagatccgtattgttctccgtcaagataaaactcataaagtcgtcgctaacttctatgtttctggcgaaaacttgtgcaagcttgacagaatgaagagcaacgacaagtcctggatctggacctgctacgactgctctgacctcccccctaccgtccaaaagctctgcggtagattcgtcagcaaggaagactttgaatccttccaaaaggaattcgaaaaggcctatgaagccaacagcgccgtcgttaaatccgccgccccttccactgaaaccaagcccg

SEQ ID NO: 45690 - protein, 174 aa, Panicum virgatum
  misc_feature: Ceres CLONE 2026461
  misc_feature (37)..(158): Pfam Name: Ran_BP1 Pfam Description: RanBP1 domain
MDNRDKDEDYEVGDDYDPEAETVDFGGEKKLNLPEVPVQTGEEDDEQVAKYRCKLYRWAKSEWKERGAGDLRFLKNKSTNKIRIVLRQDKTHKVVANFYVSGENLCKLDRMKSNDKSWIWTCYDCSDLPPTVQKLCGRFVSKEDFESFQKEFEKAYEANSAVVKSAAPSTETKP

SEQ ID NO: 45691 - DNA, 620 bp, Panicum virgatum
  misc_feature: Ceres CLONE 2026462
  misc_feature: Encodes the peptide sequence at SEQ ID NO. 45692
attcgcgtcggcggcggtcggcgccacccttcgcgccgccgccctcgggtgtcaccgcccgcggccgctcgatccgatggctcccactaagaaatcgaatcaacagcacggagagcatgcgccctcagctgtctctggtgatgaatagcggtgagtacactctcggctactacaccgtcctcaatactctgctcatctccaaggggaagctgatcctccttgcgaactactgccctccgcttaggaagtctgagatccagtactatgccatgcttgccaaagttagcgtgcatcttttccatggaaactgtgttgatcttggtgctgcctgcgataagtactacagagtgtgctgcctcagtatcattgacccgggtgactcggacatcatcggcaccacccctggcgcccatgtgagcaaagaaaaggagcgagctttgcctatccctagttgagatgagatatagggctcagaccttgccaggtcaatggccgtttcttgtttgtctttagtctatgatgagtggatctcgcatacatacctcatatggttgttatgtgtggcatatctatggttctgtttgatgagatcgtcataattattccgttgtctcaaaaat

SEQ ID NO: 45692 - protein, 112 aa, Panicum virgatum
  misc_feature: Ceres CLONE 2026462
  misc_feature (1)..(93): Pfam Name: Ribosomal_L7Ae Pfam Description: Ribosomal protein L7Ae/L30e/S12e/Gadd45 family
MRPQLSLVMNSGEYTLGYYTVLNTLLISKGKLILLANYCPPLRKSEIQYYAMLAKVSVHLFHGNCVDLGAACDKYYRVCCLSIIDPGDSDIIGTTPGAHVSKEKERALPIPS

SEQ ID NO: 45693 - DNA, 472 bp, Panicum virgatum
  misc_feature: Ceres CLONE 2026473
  misc_feature: Encodes the peptide sequence at SEQ ID NO. 45694
tctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctg

SEQ ID NO: 45694 - protein, 72 aa, Panicum virgatum
  misc_feature: Ceres CLONE 2026473
  misc_feature: Functional homolog of the protein sequence given in SEQ ID NO 51454
  misc_feature: Useful for making plants with modulated salt sensitivity
SRLQGSALTNGAETPEKGSSAGPVKKRLSFQGGTAAASPMRRHSGPPKVDSVVKDIVAPPQPEALVINGGSK

SEQ ID NO: 45695 - DNA, 646 bp, Panicum virgatum
  misc_feature: Ceres CLONE 2026494
  misc_feature: Encodes the peptide sequence at SEQ ID NO. 45696
gtgttgagactggtatcatcaagcctggtatggttgtgaccttcggtcccagcggcctgactactgaggtcaagtctgtcgagatgcaccacgaggctctccaggaggcccttcctggtgacaatgttggcttcaacgtgaagaacgttgctgtgaaggatctgaagcgtgggtatgtggcctccaactccaaggatgaccctgccaaggaggctgccagcttcacctcccaggtcatcatcatgaaccaccctgggcagattggcaacggttacgccccagtgctggactgccacacctcccacattgctgtcaagttcgccgagcttattaccaagattgacaggcggtctggcaaggagctagagaaggagcccaagttcctcaagaatggtgatgctggtatggtgaagatggttcccacaaagcccatggtggtggagaccttctctgagtaccctcctcttggtcgctttgctgtccgtgacatgaggcaaacggttgctgttggagtcatcaagagtgtggagaagaaggacccaactggcgccaaggttaccaaggctgctgccaagaagaaatgatgtgcctgtggtttattgtgtgtctgctttttgctatagcgccaaggttaccaaggctgctg

SEQ ID NO: 45696 - protein, 193 aa, Panicum virgatum
  misc_feature: Ceres CLONE 2026494
  misc_feature (68)..(176): Pfam Name: GTP_EFTU_D3 Pfam Description: Elongation factor Tu C-terminal domain
  misc_feature (1)..(61): Pfam Name: GTP_EFTU_D2 Pfam Description: Elongation factor Tu domain 2
VETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 45697 - DNA, 626 bp, Panicum virgatum
  misc_feature: Ceres CLONE 2026510
  misc_feature: Encodes the peptide sequence at SEQ ID NO. 45698
gcatcccccttgcttcgtgtcatcgtcctccgctcatgagagctaagcaagctagcaagcgcggctcccgaactgaacctccacctcggcggctctcctcgatcggctcgtcccccgacggcgccaccctggaccgcaagggcacctcgagctcggcggcggggtccatggccgcgctcgccgccgccggcgcggccggccagggccagccgacctccggccaggccaacggggcgctgtcctcgccgcatgcggaggaggacgagaaccctgctacggcaggcgccgtgagcggtggcagcgcctccggctcctcggacccggtggccgcgaggaggggagcggcgggcggcggcccgagctgccaggtggagcggcgcgccgccgacctacacgaagcgaggcggtactaccggacgcacgaggtgtgcgagccgcactccaaggagctcgccgtgctcgtcgccggcctccgccagcgcttctgccagcaatgcagccggttccatgagctgtgggagttcgacggcgacaagcgcagctgccgccggcgcctggaggggcacaacgcacggcgccagaggagctcggcggataggcacggcggcagcggcggcgaccaggac

SEQ ID NO: 45698 - protein, 196 aa, Panicum virgatum
  misc_feature: Ceres CLONE 2026510
  misc_feature (109)..(187): Pfam Name: SBP Pfam Description: SBP domain
MRAKQASKRGSRTEPPPRRLSSIGSSPDGATLDRKGTSSSAAGSMAALAAAGAAGQGQPTSGQANGALSSPHAEEDENPATAGAVSGGSASGSSDPVAARRGAAGGGPSCQVERRAADLHEARRYYRTHEVCEPHSKELAVLVAGLRQRFCQQCSRFHELWEFDGDKRSCRRRLEGHNARRQRSSADRHGGSGGDQ

SEQ ID NO: 45699 - DNA, 671 bp, Panicum virgatum
  misc_feature: Ceres CLONE 2026519
  misc_feature: Encodes the peptide sequence at SEQ ID NO. 45700
gatcctgaagcctaaactgtttgccactgtcctcgtccagctcaagtaccccgcccccggcgccccggacttagccctgcggaccaaggagctcctggagcaagccgggttcggccccgtgaaggaggaccacagccgcgggctggaccacggcgcgtgggtgccgctgatgctcatgtacccggacgccgacatccccgtgtgccagctctcggtgcagaccgaccgcgacggcgcgtaccactacaacctcgggcgggcgctggcgccgctgcgggaggagggcgtcctcgtcctcggctccggcagcgccacgcacaacctgcgcaagatggggcccatggacgcgcccgtgccgcagtgggcggccgagttcgacacctggctcaaggacgcgctcctcagcggaaggtacgatgacgtgaaccggtacgaggagaaggcgccgcacgcgaaggtggcgcacccgtggccggaccacttctacccgctgcacgtcgcgctgggcgccgccggggacagcgtgaaggcagagcagatccaccagagctggaccaacgccacggtctcctacgcttgttacaggttctccacaaacaagtgacggccgggtaattgctgaatgattgtgaagtgtgaaccatatcatccgtgctcatgtatagtatacc

SEQ ID NO: 45700 - protein, 200 aa, Panicum virgatum
  misc_feature: Ceres CLONE 2026519
  misc_feature (1)..(197): Pfam Name: LigB Pfam Description: Catalytic LigB subunit of aromatic ring-opening dioxygenase
ILKPKLFATVLVQLKYPAPGAPDLALRTKELLEQAGFGPVKEDHSRGLDHGAWVPLMLMYPDADIPVCQLSVQTDRDGAYHYNLGRALAPLREEGVLVLGSGSATHNLRKMGPMDAPVPQWAAEFDTWLKDALLSGRYDDVNRYEEKAPHAKVAHPWPDHFYPLHVALGAAGDSVKAEQIHQSWTNATVSYACYRFSTNK

SEQ ID NO: 45701 - DNA, 728 bp, Panicum virgatum
  misc_feature: Ceres CLONE 2026551
  misc_feature: Encodes the peptide sequence at SEQ ID NO. 45702
agccgctggctaccgaccagtctgtaccaccgaaccggaggaggcaggaggccaggagctgccagccaaacagaaacaggattgcgagaagatgccgccgccgccgccggtcaatccgcagcggctgtcgccggcagagtcccgggagcggacgctgcacttcttccacggcctgggcgtaaacgtgccgctcccggcctcggccgagcgcgccgacgcctacgccgcgctcgtccgcgccatcgtctcctccgccaccgtctcctcgtcgcgcgtctcctgcaccctcgccatctcccccggcgtcgcgaaccagtacaacacactccacggcggcgcggtggcggccgtggcggaggccgtcgggatggcgtgcgcgcgggccgcggcgggcgacaaggagatgttcctcggcgagctcagcacggcctacctcgccgccgcgcgagtcaactctgaagtagatgttgaagcgcagatactgaggaagggcaggtcggtcgtcgttaccactatcgagttcagactgaaggacaccaagaagctctgctacacatctcgggccaccttttacataatgcccgtggcaagcctatgaacaatctagtttacatgtgcaaattgttgtatctacagtaccagagttgcggagttaatttygtaattagactttatttaatatcctaaattaatggtcaaagtactaaaaagttttccaactttttcac

SEQ ID NO: 45702 - protein, 168 aa, Panicum virgatum
  misc_feature: Ceres CLONE 2026551
  misc_feature (76)..(153): Pfam Name: 4HBT Pfam Description: Thioesterase superfamily
MPPPPPVNPQRLSPAESRERTLHFFHGLGVNVPLPASAERADAYAALVRAIVSSATVSSSRVSCTLAISPGVANQYNTLHGGAVAAVAEAVGMACARAAAGDKEMFLGELSTAYLAAARVNSEVDVEAQILRKGRSVVVTTIEFRLKDTKKLCYTSRATFYIMPVASL

SEQ ID NO: 45703 - DNA, 499 bp, Panicum virgatum
  misc_feature: Ceres CLONE 2026564
  misc_feature: Encodes the peptide sequence at SEQ ID NO. 45704
actacccatcaaacaaacaacaacaacaacaagaagcatcattcaaagtgcttacatcttgtgagattgaaatctgcaggtatctctgaagaagatgagcagctcggcaggtggtgatggcaaggggtgcgatgctgctcccaagacagagtggcctgagctagtgggaaagacgatcaaggaggcgacggagaagatcaatgcggagcggccggacctcaatgtggaggcggtccctgttggcaccatagtcaccccagtgttcgacccgacgcgcgtccgtctctgggttgacaccgtcgccgagatccccaggattggctaaaaaagaagcttaacgcaaagccaccgaataatggatggtacatgcatgcatgtgttcctcagaccaatatactagtacataggtcaattagactagaacattcggcccgcgatgcgcgccctaccatttcaacaatcaaatccagcaatacaataaaatcaaataaaattcaag

SEQ ID NO: 45704 - protein, 76 aa, Panicum virgatum
  misc_feature: Ceres CLONE 2026564
  misc_feature (17)..(76): Pfam Name: potato_inhibit Pfam Description: Potato inhibitor I family
  misc_feature: SWISSPROT Homolog: EC 6.1.1.11 Serine--tRNA ligase
MSSSAGGDGKGCDAAPKTEWPELVGKTIKEATEKINAERPDLNVEAVPVGTIVTPVFDPTRVRLWVDTVAEIPRIG

SEQ ID NO: 45705 - DNA, 635 bp, Panicum virgatum
  misc_feature: Ceres CLONE 2026565
  misc_feature: Encodes the peptide sequence at SEQ ID NO. 45706
gaggcaggcgttttcatggcagaggatggattggcagggggaagctcacggagatgctgatgtaggtgctgcatgtggcgtcggccgtggcggcgttcctggcgggctatgtgcgcggggacttccagctcatgctgctcgtctatgctgccggcgtcgtgctcacgatgctcgtcaccatccccaactggcccttcttcaaccgcaacctgctcaagtggcttgacgccgccgatgccgagcgccacccacgcctgcaggttggcgccaccggcgcgggggcaggggttaagaagtccgggaagaacaagtaattggtctttcaaaggaaagacactatttctcatggtacttggcccatttcatgaacatattccaataggattatacgaagatgagcaacaagatggggatatgtggtgcagtagacaattgtagagttcttgaacaaagtgatggtcgaggtggtgaagccagtgccgtgctatggcttcgatcgtggtccaaagctgattgtattatttaaatgagaattcagttcacaatgtttcgttattgatgtcatcactattttgaatgggatgttagattgaataatggattgatttattaataatatatatgtgtgttgcagc

SEQ ID NO: 45706 - protein, 60 aa, Panicum virgatum
  misc_feature: Ceres CLONE 2026565
  misc_feature (1)..(44): Pfam Name: SPC12 Pfam Description: Microsomal signal peptidase 12 kDa subunit (SPC12)
MLLVYAAGVVLTMLVTIPNWPFFNRNLLKWLDAADAERHPRLQVGATGAGAGVKKSGKNK

SEQ ID NO: 45707 - DNA, 574 bp, Panicum virgatum
  misc_feature: Ceres CLONE 2026614
  misc_feature: Encodes the peptide sequence at SEQ ID NO. 45708
aggagcggcaagtgcggtggacagcgagcgatcgagactcgagagaggacagtgcacagcccggagcggtcaggtctcgaggggtttcttctcgtgcgagcgggagcgttctgacggcggcggcgggccgggatggcgtcgcagcaggcggagagggcggcggagctgcaggacccggagatccgggcggagctggaccggcgcgtccgcgaggagggcgagaccgtcgtcaagagcggcggcggcggcaccactctcgacgcccaggagcgcctcgccgaagggcgcaagaagggagggctgagccgcacgacggagtccggcaaggaccgcgccgagaaggagggcgcggtgcgcgtcgagcccgacgagaagcagctccagcaggctaagaagagcctcggccgcgactgatgcgttgaccaccgtagcttactctgtagtatgtactccaatatactactattagtacaataacagctagccgtagccgtagtctggctagctgctctagctgctgcaagggtgtagatgaagtatgtaggtgacggccaaaggctacaaaattttggtc

SEQ ID NO: 45708 - protein, 93 aa, Panicum virgatum
  misc_feature: Ceres CLONE 2026614
  misc_feature (1)..(87): Pfam Name: LEA_5 Pfam Description: Small hydrophilic plant seed protein
MASQQAERAAELQDPEIRAELDRRVREEGETVVKSGGGGTTLDAQERLAEGRKKGGLSRTTESGKDRAEKEGAVRVEPDEKQLQQAKKSLGRD

SEQ ID NO: 45709 - DNA, 744 bp, Panicum virgatum
  misc_feature: Ceres CLONE 2026629
  misc_feature: Encodes the peptide sequence at SEQ ID NO. 45710
gaccagcacctcaatcgataatcgcatcttcctcaatctaagctacatcagcgattcaatcagcaggaagaaaagctcccatattgattccaactattcgtcaaaatggttctcgcagtcgatcttttgaacccaacccctcaggctgaggcccgcaagcacaagctcaagactcttgtacctgctcctcgatcattcttcatggacgtcaagtgcccaggctgcttcaccatcacaacagtcttctctcacgcccagaccgtcgtcatctgcgcaggctgctcgactgtgctttgccaacccaccggtggcaaggccagactcacagagggctgctctttccgaagaaagtagattaacaattctggaatgacttgatggcattttcttgctagatagaaggtggattcctggcctgacaccgaaccacgatgaatggagttccggatatcttgcaaaaagactttagcatggcggggcattatttttgtttttaccaacataacaaataagagcgaagaagtagtccttctacgaacaggatggttttcgcaaaaaaagtcatttctgcatcggaccgaccggcagaggcaggagattctgcatgaacatacatagtgatgtgaggaaggcaagtctcactgttgaggaggccttcgcccttgcacgatgctaggtcgtggttgaggatgaatgggcatgtactgatagtacaaagtcaagcaataaaatcttctgaaaagc

SEQ ID NO: 45710 - protein, 82 aa, Panicum virgatum
  misc_feature: Ceres CLONE 2026629
  misc_feature (28)..(82): Pfam Name: Ribosomal_S27e Pfam Description: Ribosomal protein S27
MVLAVDLLNPTPQAEARKHKLKTLVPAPRSFFMDVKCPGCFTITTVFSHAQTVVICAGCSTVLCQPTGGKARLTEGCSFRRK

SEQ ID NO: 45711 - DNA, 464 bp, Panicum virgatum
  misc_feature: Ceres CLONE 2026636
  misc_feature: Encodes the peptide sequence at SEQ ID NO. 45712
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcggccccttcggcgaggtcctcgagtccaagatcatcctccatcgtgagacccagaggtcccgcggcttccgcttcttcaccttctcgagcgagcaggcgatgcgcgatgccatcgtggggatgaacggcaaggagctggacggccgcagcatcttcgtgaatgatggcttgtcccgtggcggcccgccctccggcggctgcggctgctggtacaggcgccgcgagggcggccgcggctacggcagagttggctacgacggctggagaggcagcttctggcgccgt

SEQ ID NO: 45712 - protein, 122 aa, Panicum virgatum
  misc_feature: Ceres CLONE 2026636
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50210
  misc_feature: Useful for making plants with modulated biomass
MAASDVEYRCFVGGLAWATDDNSLHNAFGPFGEVLESKIILHRETQRSRGFRFFTFSSEQAMRDAIVGMNGKELDGRSIFVNDGLSRGGPPSGGCGCWYRRREGGRGYGRVGYDGWRGSFWR

SEQ ID NO: 45713 - DNA, 597 bp, Panicum virgatum
  misc_feature: Ceres CLONE 2026667
  misc_feature: Encodes the peptide sequence at SEQ ID NO. 45714
aaaaacttaaacaaaaataaaaattctgcacagataagcaacaatgcaggcaatgaaagaagcactcggccctatgggtcaacaagtcagaaagaagctcatggaaaagtttactccatcccatctcgaaattatcaatgaaagctatatgcatagtgtccctaaaggatctgagactcactttaaagttgtagtcgtttctgattcattcaagggcttgagtcgggtccaaacgcatagaggagtacaagaatgccttgccgatgaaatgaaaactggcattcatgcattgtctattgtggctaaaactgaagaagaatgggcaaagaataatgttattcctcagagtcctggttgtcttggaggatctaaacatgataagaaggtgtaattatgctgtattatgttaaatcagacaagtcaaagcgattgagtattttggagcgaaaggagatagtgatattgttgagagacatttttatggaaaattctttgaagtgtaatattgaatgagttggctgactaatgctttgatatgcttgcataaagttgtaaaaatagttgcatgaagaaaaaaagaaaagagttcattttttc

SEQ ID NO: 45714 - protein, 115 aa, Panicum virgatum
  misc_feature: Ceres CLONE 2026667
  misc_feature (18)..(93): Pfam Name: BolA Pfam Description: BolA-like protein
MQAMKEALGPMGQQVRKKLMEKFTPSHLEIINESYMHSVPKGSETHFKVVVVSDSFKGLSRVQTHRGVQECLADEMKTGIHALSIVAKTEEEWAKNNVIPQSPGCLGGSKHDKKV

SEQ ID NO: 45715 - DNA, 654 bp, Panicum virgatum
  misc_feature: Ceres CLONE 2026676
  misc_feature: Encodes the peptide sequence at SEQ ID NO. 45716
cttgacgcccgcgctcgcgatccgcggcatcctccgccgcccgccgcgcgcgaagggggcccctctacgatctccggcggagacgctggcagcgccgggggggcggctccaatggcttcggaggcggaggggcagtgggcgctgatggcgacggggcgggcgccgaccaacatcgcggtgatcaagtactgggggaagcgcgacgaggcgctcatcctccccgtcaacgacagcgtcagcgtcaccctcgaccccgaccacctctccgccaccaccaccgtcgccgtcagcccgtccttcgcctccgaccgcatgtggctcaacggcaaggtgcggtgccgggaatgggattcccctccttactcacttcaagtgtgctacactggctactgttggcatttggtgcttgtgttcatcgaagtggctgctgttgcctcgatctggatctggatcgaagtgtgcagagctccaattttttcttttgtcgtttgctaaaatattgtatgcctattttgtattttctgtagttgcagggttgctactttggacaatgagtaagtgacaaacatagaatcctagggcggagtgtgggacttcaattggatggaacataacactgaaaagtttatcatccttctgtgtggtatggttttc

SEQ ID NO: 45716 - protein, 127 aa, Panicum virgatum
  misc_feature: Ceres CLONE 2026676
  misc_feature: SWISSPROT Homolog: EC 4.1.1.33 Diphosphomevalonate decarboxylase
MASEAEGQWALMATGRAPTNIAVIKYWGKRDEALILPVNDSVSVTLDPDHLSATTTVAVSPSFASDRMWLNGKVRCREWDSPPYSLQVCYTGYCWHLVLVFIEVAAVASIWIWIEVCRAPIFSFVVC

SEQ ID NO: 45717 - DNA, 594 bp, Panicum virgatum
  misc_feature: Ceres CLONE 2026678
  misc_feature: Encodes the peptide sequence at SEQ ID NO. 45718
atctcgcctcgcgcactcccgtccccatcttcccaattctctccgcgcccccactcccactcgtctctccgccgcccgccgcgtcggctgcggcgacccgaccagcgtcactcgccatgactacctcaaggcgtcttgctgataggaaaattgcacgatttgagaagaacatcacaaagaggggagctgttcctgagacaatcaagaaagcaaatgattatccttttggacctattctgcttgggttcttcgtcttcgttgttgttggatcatctctctttcagatcatcaggactgcctcaaatgctggtctattctgagcatggttcttcacttaacttacagattatatcggtaaagtggaggaacatggttgatatatgcagtttgtcacttagaaaacaaaagtgcgtggcgtagctggtactctatgatgctaccctataatatattgtagtagtatggtgaagtggagaagtttaagttatatggtgacaatatatgtgtaacataggggtaactgggtaacccaagtcactcgggcgataggaaagatgattccgtaatacatattgcgaagttatagctcgtgtt

SEQ ID NO: 45718 - protein, 67 aa, Panicum virgatum; identical to SEQ ID NO: 9974
  misc_feature: Ceres CLONE 2026678
  misc_feature (1)..(63): Pfam Name: RAMP4 Pfam Description: Ribosome associated membrane protein RAMP4
  misc_feature: Functional homolog of the protein sequence given in SEQ ID NO 50140
  misc_feature: Useful for making plants with modulated nitrogen use efficiency

SEQ ID NO: 45719 - DNA, 846 bp, Panicum virgatum
  misc_feature: Ceres CLONE 2026680
  misc_feature: Encodes the peptide sequence at SEQ ID NO. 45720
aaccaacaccagcaactcagcaacaccgagcaaacacaccactgcttctctgctcaaaggcagctagcattagatcgtcgagtcgagacgatgtatccggccaagcccggcgaggcggcggcggcggcggcgccggtgaccggggtccccgccgggcagtggtcctcggggctgctggactgctccgacgactgcgggctgtgctgcgtgacgtgctggtgcccgtgcatcacgttcgggcgcgtggcggagatggtggaccgcggcgcgacgtcgtgcgggacgagcggggcggtgtacgcggtgctggcctgcctcatgggccagtggatctactcgtgcatgtaccgcgccaagatgcgcgcccagttcgggctccccgaggacccctgctgcgactgctgcgtccacttctgctgcgagccctgcgcgctctgccagcagtacaaggagctcaaggcccgcggcttcgacccggacctcggctgggaactcaacgcccagagggccagcgccatgtacccgcccgccgcacagggcatgggccgctgaacttgctacttgctcatcatggacgatctcatctcataatctcagtcatccgtgctgatgatggtcatcagtcgacgagtttatttaatttgctgcctcgaattatattcgtgcatggtggattgtactacgtacgtactgctatgtgtttatttcattatttgtgtgtgtgtttgatctcttgcatcagccagcaaaaagaaatgtgcatgtaaacatcatcagtacggagtgatgtacgtttcctttttcttttgttactactacatatttcttggttcttccatggtttgg

SEQ ID NO: 45720 - protein, 153 aa, Panicum virgatum
  misc_feature: Ceres CLONE 2026680
  misc_feature (24)..(122): Pfam Name: PLAC8 Pfam Description: PLAC8 family
MYPAKPGEAAAAAAPVTGVPAGQWSSGLLDCSDDCGLCCVTCWCPCITFGRVAEMVDRGATSCGTSGAVYAVLACLMGQWIYSCMYRAKMRAQFGLPEDPCCDCCVHFCCEPCALCQQYKELKARGFDPDLGWELNAQRASAMYPPAAQGMGR

SEQ ID NO: 45721 - DNA, 777 bp, Panicum virgatum
  misc_feature: Ceres CLONE 2026691
  misc_feature: Encodes the peptide sequence at SEQ ID NO. 45722
agcaacctaaaaccccgcaactcgcatctcaccaacatcactctccactccacctctaaaccgtatttcgcaacccaaccgactcgcaccagccgcgcgcctgctcagtcttatgtccacagacatccaaaacctcaagtccttcgatccgttcgcggaagccgaagacgcaggtggagaagtcaaggtcagcaatcagcagaactacatccatatccgtattcagcaacgcaatggtcgcaagacattgactacggtccaaggcctgcctaagaagttcgatcagaagaagatcctcaaggtgatcaagaagcagtttgcctgcaatggcaccatcgttgccgacaccgagatgggagaggtgatccagctccagggcgatcagcgcaaggatattcaggatttcttgacaaacaagaaggagggccttggtcttgacgttaagaccatcaaggtccacggtttctaagccagaacatgccataagccactgcccgcgcttcgcgcgatgacgcacgtcgccgacaatccgcgcccaatcacatgccggtccgcacatgtgaccaaacggcaacgaggctgaatgatggcagtatacggcggctacccattttgagatgactgcgggtgtttcctatcgtcattcctttagggaagaggaggaacagggtaaagcgcgcgctccccatccgcagcgaggatcagttacacgtgctttgatgctgagagttacggaattcgtgagattttcgtagataatcaattttccggcttgtg

SEQ ID NO: 45722 - protein, 118 aa, Panicum virgatum
  misc_feature: Ceres CLONE 2026691
  misc_feature (27)..(112): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time
MSTDIQNLKSFDPFAEAEDAGGEVKVSNQQNYIHIRIQQRNGRKTLTTVQGLPKKFDQKKILKVIKKQFACNGTIVADTEMGEVIQLQGDQRKDIQDFLTNKKEGLGLDVKTIKVHGF

SEQ ID NO: 45723 - DNA, 827 bp, Panicum virgatum
  misc_feature: Ceres CLONE 2026700
  misc_feature: Encodes the peptide sequence at SEQ ID NO. 45724
aaaaaaagctccaacttccatccaacatgaccacaagagaagagaatgtctacatggctaaactcagcgaacaagctgaacgatacgatgaaatggtctcagcaatgaagaaagttgcagaactcaatgttgagttaactgtcgaagaaagaaacttgctctccgttgcttacaagaacgtcgttggagctagacgtgccagctggagaatcatctcttccattgaacaaaaggagaaatccaaggacaatgaagctcatgtcaaacttatccgtgaatacggatcaaaggttgaaaaagaactcagtgacatctgtaatgacgtcctcaaagttctcgatgatcatctcatcaaatccgctgaatccaacgaatcaaaggtcttctacaacaagatgaagggagattactaccgatacatggcagaattcacacctggacaatccagacaaggattcattgacctcggacttaaagcttacgaagaagcatcaagaattgcagctgaagctcttcctccaacccacccaatcagacttggacttgcattgaatttttcagtcttttactatgaaattttcaatgagccagaaaaagcttgtgaactcgccaagaaggcattcgatgatgcaattgctgaactcgataacttaaccgaagatagctacaaagacagcactgtcattatgcaactcctccgagacaacctaacgctctggacctcagacattgctgaagaagatgatgatgaaggccaataagccttttcactcagctaattttttgttaaacattgtacatagtcccataaatacctccctaaactc

SEQ ID NO: 45724 - protein, 244 aa, Panicum virgatum
  misc_feature: Ceres CLONE 2026700
  misc_feature (4)..(239): Pfam Name: 14-3-3 Pfam Description: 14-3-3 protein
  misc_feature: The sequence is a functional homolog of SEQ ID NO 793 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 801 in the 11/479,226 US patent application
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 809 in the 11/479,226 US patent application
  misc_feature: The sequence is a functional homolog of SEQ ID NO 1777 in the 11/479,226 US patent application
MTTREENVYMAKLSEQAERYDEMVSAMKKVAELNVELTVEERNLLSVAYKNVVGARRASWRIISSIEQKEKSKDNEAHVKLIREYGSKVEKELSDICNDVLKVLDDHLIKSAESNESKVFYNKMKGDYYRYMAEFTPGQSRQGFIDLGLKAYEEASRIAAEALPPTHPIRLGLALNFSVFYYEIFNEPEKACELAKKAFDDAIAELDNLTEDSYKDSTVIMQLLRDNLTLWTSDIAEEDDDEGQ

SEQ ID NO: 45725 - DNA, 493 bp, Panicum virgatum
  misc_feature: Ceres CLONE 2026708
  misc_feature: Encodes the peptide sequence at SEQ ID NO. 45726
cgccggtgcaaccctcgacctcaattacccatcgttcatagcgttcttcaaccagaacggcagcggcgcaggcgagaggacgttcactaggaccgtgaccaacgtgggcggcgcgccagcgagctacaccgcccaagttgttggcctgaaagggctgacggtgaccgtgactccggacaggttggtcttcggcagcaagaacgagaagcagaagtacacgctcgtgatccggggacagatgaatagcaataccggcgatgtgctgcaagggtcgttgacgtgggttgacgacgccggcaagtacacggtgagaagtccgatcgtcgcaaccacagtgagctcacagcagttttaggatccgtgcgtatatcatatatttattgaactctatgtaagcaaatcaggcaagtaaagctttcaaaaaaggtcaggcaagtaaagctcgtcaccatctgaggatacataatgatttccagtattgaaagtttcgcgg

SEQ ID NO: 45726 - protein, 117 aa, Panicum virgatum
  misc_feature: Ceres CLONE 2026708
  misc_feature: SWISSPROT Homolog: EC 3.4.21.25 Cucumisin
AGATLDLNYPSFIAFFNQNGSGAGERTFTRTVTNVGGAPASYTAQVVGLKGLTVTVTPDRLVFGSKNEKQKYTLVIRGQMNSNTGDVLQGSLTWVDDAGKYTVRSPIVATTVSSQQF

SEQ ID NO: 45727 - DNA, 609 bp, Panicum virgatum
  misc_feature: Ceres CLONE 2026715
  misc_feature: Encodes the peptide sequence at SEQ ID NO. 45728
aacaaacgctaaaaaagtaacagtttctgtactttattgggctgcccggcatgacgaagaagcacgagtcgaagtactacaagccccgtgccctcgacgttgcgcaccagacggagcgcgcgtaccagcgccagacggccgtgaatgagaactctcgcgccccggccaagaagttcctcaacaacgctggccgcatccgctacgtgaagagcgtcggcctgggcttcaagacgcccaaggccgccgttgagggcaagtacgtcgaccagaagtgcccgttcactggcaacgtgtcgatccgcggccgcatcatccgcgcccaggttcgctcgacgaagatgaagcgttccatcgtgatccgtcgcaactacctgcacttcatcaacaagtaccagcgttaccagaagcgccacaagaacttcactgttcactgctccccgtgcttcgagccggctgttggagacagcgtgatcgtcggccagtgccgcccgctcagcaagaccatccgctacaacgtcctgcaggtcgtgtcgcgcaagggtggcaagaagttcgacaagaactgagtgtgttgagcagcctacgtccatccaaatctctctgcacttt

SEQ ID NO: 45728 - protein, 171 aa, Panicum virgatum; identical to SEQ ID NO: 45536
  misc_feature: Ceres CLONE 2026715
  misc_feature (91)..(159): Pfam Name: Ribosomal_S17 Pfam Description: Ribosomal protein S17

SEQ ID NO: 45729 - DNA, 698 bp, Panicum virgatum
  misc_feature: Ceres CLONE 2026728
  misc_feature: Encodes the peptide sequence at SEQ ID NO. 45730
atcgagctccagcttgaggcggcaggctcgctcctcccttggtcttccttccctggcggcgccgactgggcgagcagcagtgccattcgtcatcacgtcttcgtccagccctttgccggcgacgagcatccaccaggaaagcacctcattctcaaatgaagcatatatccaagattgttgctatactggtagcaatctcagccatctgggttgcactccttgaaacctcaactgttcctcgaagttatacttggctgcttccaatctacttggtagtggctcttggatgctacggcctttttatggttggatttggacttatgttcttcccaacttgccctcaagaagctatactactgcaacaggatattgtggaggcaaaggaattcttagcaaagaagggtgttgatgtgggctccgagtgaggccaatttcagcattcaacattcatgatcgttttgaaggatcaccattctgttccttggaatagactactttttggatactgtagctagaaaatatatcatttcactatgttctgaactattactaacacagttttagtgagttgacatgttacactttgtcaaagaatggagacatattgaggtggtgtttttaagtttcaaaaagtgcattgctgttctagggatatttgcttcgcacctcgattttgtattgtatcaattacggcatgc

SEQ ID NO: 45730 - protein, 89 aa, Panicum virgatum
  misc_feature: Ceres CLONE 2026728
  misc_feature (1)..(86): Pfam Name: DPM3 Pfam Description: Dolichol-phosphate mannosyltransferase subunit 3 (DPM3)
MKHISKIVAILVAISAIWVALLETSTVPRSYTWLLPIYLVVALGCYGLFMVGFGLMFFPTCPQEAILLQQDIVEAKEFLAKKGVDVGSE

SEQ ID NO: 45731 - DNA, 547 bp, Panicum virgatum
  misc_feature: Ceres CLONE 2026740
  misc_feature: Encodes the peptide sequence at SEQ ID NO. 45732
ctttttcattaaaatgtcgctcgtcgttcctgagagaactactttccagcacattctccgtcttttgaacaccaacgttgacggtcgtgtcaagattcaaattgctttgacctctgttaagggtgttggccgtcgttttgccaacattgcctgtaagaaggccgatattgacctcaccaagagagctggtgaactttccagtgaagaattggaacgtattgtcaccattctccaaaaccctgctcaatacaagatccctaactggttccttaacagacaaaaggatattgttgatggcaagtctagccaagtcatctccaacgttcttgacaccaagtaccgtgaagatcttgaacgcttgaagaagattcgtgctcaccgtggtctccgtcactactggggtgtccgtgtccgtggtcaacacaccaagactactggtcgtcgtggacgtaccgttggtgtctccaagaagaaataaagaacctgtggaaaccaatacatatttttttttgtttttcaaataaaagattccttgtttgtaaaactc

SEQ ID NO: 45732 - protein, 154 aa, Panicum virgatum
  misc_feature: Ceres CLONE 2026740
  misc_feature (16)..(144): Pfam Name: Ribosomal_S13 Pfam Description: Ribosomal protein S13/S18
MSLVVPERTTFQHILRLLNTNVDGRVKIQIALTSVKGVGRRFANIACKKADIDLTKRAGELSSEELERIVTILQNPAQYKIPNWFLNRQKDIVDGKSSQVISNVLDTKYREDLERLKKIRAHRGLRHYWGVRVRGQHTKTTGRRGRTVGVSKKK

SEQ ID NO: 45733 - DNA, 637 bp, Panicum virgatum
  misc_feature: Ceres CLONE 2026750
  misc_feature: Encodes the peptide sequence at SEQ ID NO. 45734
ataaggcaacgaagactcgagagaggaaatctgagaaaccccaccaaatccgccaaaccctaggcgagctcggcgcgtcggcgatggcggcggcgggcctgcggaaggggaacgcgcgtctcccgccggaggtgaaccgggtgctctacgtgcggaacctgcccttcaacatctcgagcgaggagatgtacgacatcttcggcaagtacggcgccatccggcagatccggctgggcaacgccaaggacacgcgcggcaccgcctacgtcgtctacgaggacatctacgacgccaagaacgccgtcgaccacctctccggcttcaacgtcgccaaccgctacctcatcgtgctctactaccagccagccaagatgtccaagaagtccgacgtcaagaagaaggaggaggagatcaccaggctccaggagaagtatggagtcgggtctaagacctccggccccggctccagcgactgagcgaccaggggtattattgcctctgcggtcgcttgtctggagaagagcaatcagagggaacgaattggtagagctgtgctatgtctcatccagtgttaccaattactgtgttgttatgctttgaccatcacagctgaatagatatgtgcttatcatgaacc

SEQ ID NO: 45734 - protein, 130 aa, Panicum virgatum
  misc_feature: Ceres CLONE 2026750
  misc_feature (21)..(89): Pfam Name: RRM_1 Pfam Description: RNA recognition motif. (a.k.a. RRM, RBD, or RNP domain)
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDVKKKEEEITRLQEKYGVGSKTSGPGSSD

SEQ ID NO: 45735 - DNA, 658 bp, Panicum virgatum
  misc_feature: Ceres CLONE 2026760
  misc_feature: Encodes the peptide sequence at SEQ ID NO. 45736
gagattttgttagacgtgcgcccgcaggagaggctattcccttccaacgacccgaagccccgtcgctgtcaaaggaaccgtcgcccatcgcccatttgactcgacaccgacatatttcaccatgtctacttccaaggtcaaggcgggccaattgtggtccaagacggagctgggccagcttcgcatccagaagatcgtgtcctcgggcagcaagctcaccaagatccacgatatccgcaagtcgatcgcccgcgtcctcaccgtcatcaacgcgaagcaacgtgctcagctccgcctcttctacaaggacaagaagtacctgccccttgacctccgggccaagcagacccgcgccatccgccgccgcctgtcccccgaggacgcctcgagggttctggagaagaccaagaagcgccaaacgcacttcccccagcggaagttcgccgtcaaggctgcataaaggcgttatcgtgggtaatgggatggttgtatctaggggcacttccggcgcggttattaaaacatttggcactcgacacattgcatcatcccagggattctgctttcggggtttagggtgttatacgaggtccatgatttctcggtcccggcgtggtgtctataccactgccgaatgaaagcactgcgctgaacaccc

SEQ ID NO: 45736 - protein, 112 aa, Panicum virgatum
  misc_feature: Ceres CLONE 2026760
  misc_feature (8)..(52): Pfam Name: Ribosomal_L29 Pfam Description: Ribosomal L29 protein
MSTSKVKAGQLWSKTELGQLRIQKIVSSGSKLTKIHDIRKSIARVLTVINAKQRAQLRLFYKDKKYLPLDLRAKQTRAIRRRLSPEDASRVLEKTKKRQTHFPQRKFAVKAA

SEQ ID NO: 45737 - DNA, 486 bp, Panicum virgatum
  misc_feature: Ceres CLONE 2026765
  misc_feature: Encodes the peptide sequence at SEQ ID NO. 45738
caattatgggaaactacaatggatccagagaggcggctcttaaagcagcttaaggttgacgatgctgctgaggccaatgttgtcttctcatcacttatgggtacccgggttgaatataggaagcaactgatccagaatgctgcaagctcgatcaaactagatcaacttgacatttgattgcattgagtaaggctgaccccattgtgtatgatatagaaggtccacccaaccaagcatagaagacttgattcttcaccaccaaatgttttggtgctagggtagcagtaaaaataggctagaactggatccaggatgacagcgtcttgcccagtttcctggttctcccgacacatttgtggccatcctgtgacgtgtaaactgttttggcctggcggatatcacctgggggagttggggtagtttcctgccatgtttgcgacggatacagtctaacagacttttatcttctgaaatttgcggttgatt

SEQ ID NO: 45738 - protein, 58 aa, Panicum virgatum
  misc_feature: Ceres CLONE 2026765
  misc_feature (1)..(45): Pfam Name: DNA_gyraseB_C Pfam Description: DNA gyrase B subunit, carboxyl terminus
  misc_feature: SWISSPROT Homolog: EC 5.99.1.3 DNA topoisomerase (ATP-hydrolyzing)
QLWETTMDPERRLLKQLKVDDAAEANVVFSSLMGTRVEYRKQLIQNAASSIKLDQLDI

SEQ ID NO: 45739 - DNA, 577 bp, Panicum virgatum
  misc_feature: Ceres CLONE 2026770
  misc_feature: Encodes the peptide sequence at SEQ ID NO. 45740
aatcacctgtagcaacatacaagggcgacatatacagctttggtattgttctgcttgagctactcactggtcggaggcctgtggacatgtgcaggccaaaagggaccagggatgtcgtgtcatgggtgcttcagatgaaagaagagggcagggaaacagaagttttccatccaagcatacaccacaaggagaatgaaaggcagttgatgagagtactcaagatagcatgcctttgtgtgactgctgctcccaagtcaagaccaacatcgcagcagctagtcgcatggctcgacgacattgcagaagactctggtttagagcaacctggagtttccagtggtttcaatttgctttcttgagaggatcaaccttatagtttcttaagaattgttagttgtgtacatataatatttacatagtgatatgccgagagttctctggtgttgctctcctctcaagtaatgatatgagcatatttggtagttactcccttcataaggtggttgcaagatcaccagtgtaaaaatgcttagtagctttaaaccattagttcaataatctagtggctatattgagc

SEQ ID NO: 45740 - protein, 118 aa, Panicum virgatum
  misc_feature: Ceres CLONE 2026770
  misc_feature: SWISSPROT Homolog: EC 2.7.11.1 Non-specific serine/threonine protein kinase
SPVATYKGDIYSFGIVLLELLTGRRPVDMCRPKGTRDVVSWVLQMKEEGRETEVFHPSIHHKENERQLMRVLKIACLCVTAAPKSRPTSQQLVAWLDDIAEDSGLEQPGVSSGFNLLS

SEQ ID NO: 45741 - DNA, 626 bp, Panicum virgatum
  misc_feature: Ceres CLONE 2026773
  misc_feature: Encodes the peptide sequence at SEQ ID NO. 45742
gtctccgctctttatcccccgctgcgcccgtgcctttcctctccatctccgccgccgccgccgccgccgccgccgccgccgccgtcgcctcccacccgcagccgcaccactctccccggcggatcgggacgtctgctcggcgcggtccatccatggcggaggaatcaggtcgccccttgcctaagtttggtgaatgggatgtgaacgacccagcttccgctgatggattcacggtgatattcaacaaagccagagatgagaagaagggtgggaatggacaggatacagagtctccttccaaggacaccaggaccgagagggtggaatcttatgctgccaagccgaattcgaagaaatggttttgctgcgtgatagccagccccacacaatcctgaagacgatcacccgctcgtgggaatactgcccctttaatttttctatacatactatccataagacagtgtagaggtacccagcgctccccgggctccaggatgggtacctcgtatgtatgtgtgtgagggttgtcggcacacatttgcaaagtggacttctgagttctgattgtaattgtagtcccccgtctgtcttatttttgttggtctcgctgcctgagcctgactgcc

SEQ ID NO: 45742 - protein, 80 aa, Panicum virgatum
  misc_feature: Ceres CLONE 2026773
  misc_feature (1)..(73): Pfam Name: NOI Pfam Description: Nitrate-induced NOI protein
  misc_feature: Functional homolog of the protein sequence given in SEQ ID NO 50537
  misc_feature: Useful for making plants with modulated nitrogen use efficiency
MAEESGRPLPKFGEWDVNDPASADGFTVIFNKARDEKKGGNGQDTESPSKDTRTERVESYAAKPNSKKWFCCVIASPTQS

SEQ ID NO: 45743 - DNA, 724 bp, Panicum virgatum
  misc_feature: Ceres CLONE 2026788
  misc_feature: Encodes the peptide sequence at SEQ ID NO. 45744
acagccccctcacctcttgtgtcgaagcggctgctgccgtcgtcgctgacacctatcgccgcttccagagtcgccgccggcgggtgttctcccacgctgctcctgcggtgagggcagcggggcgtgaggatgatgggcagtaacagcggcggagggggcggaggccctggcgggggcatgggtccgggcatgggcgggcccacaggtggaggcggggacgggcggcacgacgacgaggctgcgctcaccgagttcctctccttgctcatggactacacccccacgattcccgatgagctggtggagcactacctcggacgcagcggattccactgccctgatctccgcttaacgagattgattgctgtagccacccagaagttcctttcggacattgcaagcgattctcttcagcactgcaaggccagggtagcagcaccaatcaaagataataagagcaaacaaccaaaggatagacgtcttgtactaactatggatgatctttctaaagccttgcgtgagcatggtgtgaacttgaaacacgctgagtacttcgcagacagcccttcagcaggaatggctccttcaacaagggaggagtagattggattgaggcaacctgtaccaagtgtctaagtggaactggggattatacagggatcatgtcaatgattagcctggtcccattattgcccaattcgatgtaacggtgtactagtatagc

SEQ ID NO: 45744 - protein, 157 aa, Panicum virgatum
  misc_feature: Ceres CLONE 2026788
  misc_feature (51)..(101): Pfam Name: TFIID_30kDa Pfam Description: Transcription initiation factor TFIID 23-30kDa subunit
  misc_feature: Functional homolog of the protein sequence given in SEQ ID NO 51711
  misc_feature: Useful for making plants with altered terpenoid content
  misc_feature: Functional homolog of the protein sequence given in SEQ ID NO 51712
  misc_feature: Useful for making plants with altered lignin content
MMGSNSGGGGGGPGGGMGPGMGGPTGGGGDGRHDDEAALTEFLSLLMDYTPTIPDELVEHYLGRSGFHCPDLRLTRLIAVATQKFLSDIASDSLQHCKARVAAPIKDNKSKQPKDRRLVLTMDDLSKALREHGVNLKHAEYFADSPSAGMAPSTREE

SEQ ID NO: 45745 - DNA, 675 bp, Panicum virgatum
  misc_feature: Ceres CLONE 2026834
  misc_feature: Encodes the peptide sequence at SEQ ID NO. 45746
atcctctcccgctcctgcttttccaaccccacccctcttctttgagtgtggtattctttcgctactggagcccttagctgtgtgcttcctggagaccgatcagagctcaagagttccttgagcccttacacctgcgagtaccgcattcgcccctcctcgcaccgccattatgccctcctcccaggctgtcgctggcgaccttgccatcaagcctgagttcgtcgaccagaagtcgcccatggcttcgaccagcgagcccaaccgcaaccccaagtacgacccgaagaagccgcacatcaccgacacgcccatcaccaaggccaactggtacaagcacgtcaactggctcaatgtcactttcatcattggcattcccctcgctggctgcatctctgcctactggaccccgttgaagtggcagaccgctctctgggcggtcgtctactacttctggactggtcttggtatcaccgccggttaccatcgtctttgggcgcacaagtcctacaacgcttccctgcctctttcgatcttcctcgcccttgttggtggtggtgctgtcgagggttccatccgctggtggagccgtgaccaccgtgctcaccaccgctacaccgacaccaacaaggacccctactccgttcgcaagggtcttctgtactctcacctcgggct

SEQ ID NO: 45746 - protein, 168 aa, Panicum virgatum
  misc_feature: Ceres CLONE 2026834
  misc_feature: SWISSPROT Homolog: EC 1.14.19.1 Stearoyl-CoA 9-desaturase
MPSSQAVAGDLAIKPEFVDQKSPMASTSEPNRNPKYDPKKPHITDTPITKANWYKHVNWLNVTFIIGIPLAGCISAYWTPLKWQTALWAVVYYFWTGLGITAGYHRLWAHKSYNASLPLSIFLALVGGGAVEGSIRWWSRDHRAHHRYTDTNKDPYSVRKGLLYSHLG

SEQ ID NO: 45747 - DNA, 593 bp, Panicum virgatum
  misc_feature: Ceres CLONE 2026840
  misc_feature: Encodes the peptide sequence at SEQ ID NO. 45748
gggcaagaactgaggcttcgtgccattgctaggaaaggaatcggcaaggaccatgccaaatggtcaccagctgctactgtgactttcatgtatgagcctgacatacatatcaatgaagaactcatggatacattgacgcttgatgagaaaataagttgggtcgaaagcagccctacaaaagtatttaaccttgatcctattaccaaacaggtaacagtgtgtgatgctgaggcatacacctatgacgacgaggtgatcaagaaggcggaggccatggggaagccaggcctggtggagatcaacgcgaaggaggacagcttcatcttcactgtggaaacaaccggtgccatcacagcctatgagctgatcatgaacgctatcacggtcctgcggcagaagctggatgctgtccgcctccaggacgacgacggcgaccttggtgagctcggcgcccaccttggcggaccttaagcatcttcctcccctccccattgtagtaggctgatctaactgccctgctagtcgaacagcctgatgcccctctaaattgtccagactgtatttccgaaacgtccagtacgatgttgtggact

SEQ ID NO: 45748 - protein, 156 aa, Panicum virgatum
  misc_feature: Ceres CLONE 2026840
  misc_feature: SWISSPROT Homolog: EC 2.7.7.6 DNA-directed RNA polymerase
GQELRLRAIARKGIGKDHAKWSPAATVTFMYEPDIHINEELMDTLTLDEKISWVESSPTKVFNLDPITKQVTVCDAEAYTYDDEVIKKAEAMGKPGLVEINAKEDSFIFTVETTGAITAYELIMNAITVLRQKLDAVRLQDDDGDLGELGAHLGGP

SEQ ID NO: 45749 - DNA, 565 bp, Panicum virgatum
  misc_feature: Ceres CLONE 2026856
  misc_feature: Encodes the peptide sequence at SEQ ID NO. 45750
tcggtagccgccggttcacttctccaggtaaggaaagggctggtcctcatggcgccgccgcagcccaagtccggcctcttcgtgggcatcaacaagggccatgtcgtcaccaagcgcgagctgccgctgcccccgtcccaccgcaaagggaaagcaacaaagcgggtgaccatggtcaggggcctgatcagggaggttgctgggttcgctccttatgagaagcgtatcactgagcttctgaaggttggcaaggacaagcgtgctctgaaggttgctaaaagaaagctcggaactcacaagagggcaaagaagaagagagaggagatggccaatgtcctcaggaagatgagatctgctggtacccacactgataagaagaaatagagcatctcaagtacgtgaagctggcggcaacattgtcctgtgtcggtttcccctacctgtagaacctaatagacttgtcaaagtacctgccagcaaaacattgtgttgttagttatgtgttgaaccaccccatgagtttttttatccaactttgaatgcatctatctatggtttgtctttc

SEQ ID NO: 45750 - protein, 111 aa, Panicum virgatum
  misc_feature: Ceres CLONE 2026856
  misc_feature (5)..(103): Pfam Name: Ribosomal_L36e Pfam Description: Ribosomal protein L36e
MAPPQPKSGLFVGINKGHVVTKRELPLPPSHRKGKATKRVTMVRGLIREVAGFAPYEKRITELLKVGKDKRALKVAKRKLGTHKRAKKKREEMANVLRKMRSAGTHTDKKK

SEQ ID NO: 45751 - DNA, 690 bp, Panicum virgatum
  misc_feature: Ceres CLONE 2026868
  misc_feature: Encodes the peptide sequence at SEQ ID NO. 45752
aagctcagcacacgaacgcacagtagtcgcagcccatccaattcgttcctgtcctgtccaagcagcccgagcgcaggttaggagagaaagggcgaccggcaactcggtcgggcaggatgcagacggcgaaggtgaagttgcaggacatggcgagctcggcgaaggagaaggtgaaggaagggtcggccaagatgcagggcaagacgggcgaggcgacggcgaggacgcacggcgagaaggagatggccaaggaggaggcccgcgccaagaaggaccaggccaacgccgacaagcaccaggagaaggccgagcaccgcgctgacgccgccgccggccgccacggcacgggcgtgcccctcaccgggaccgggacgcacggccaccacggcgccgccgtcgaccccgcctacccgtccgccggcaccacgtacccggcgtcgggcaagtacatctaagctaggcgatcggtagggaaggatcgtggtcgttctacgtttttgtgtagcgcgactggcgacctagctggggatgatcgatcagtgtggtagcgagtgcatgtatgctgtgtgcacgtgcacgctatatcctggaataatggaagtgtatcagcagtcgggtgaagcttcgtttcagttgtactcaatcatgtactgtctctgtctggtgctgttttttatgtagtgctacttc

SEQ ID NO: 45752 - protein, 112 aa, Panicum virgatum
  misc_feature: Ceres CLONE 2026868
  misc_feature (1)..(73): Pfam Name: LEA_1 Pfam Description: Late embryogenesis abundant (LEA) group 1
MQTAKVKLQDMASSAKEKVKEGSAKMQGKTGEATARTHGEKEMAKEEARAKKDQANADKHQEKAEHRADAAAGRHGTGVPLTGTGTHGHHGAAVDPAYPSAGTTYPASGKYI

SEQ ID NO: 45753 - DNA, 741 bp, Panicum virgatum
  misc_feature: Ceres CLONE 2026869
  misc_feature: Encodes the peptide sequence at SEQ ID NO. 45754
gccacgatcaccaacccaatactcaccaaacttttgacaacagacgaggtcttatccagtaaagatgtcgtccaacgcaaaagtcaagcccggccaactatggggcaagaacaaggacgacctgaagaaacaactcgacgaactcaagactgagttgggtcaactccgtgtccaaaagatctccggtggtgcctcatcgaaattgacgagaatacacgacctgcgcaaatccatcgcacgcaccctgaccgtcatcaacgccaaccagcgccaccaactccgaatcttctacgccaagaagaagtacctcccactcgacctccgacaaaagcagacccgcgccatccgccgccgactaagcaagaaggatgccagcagagtgaccgagaagcagaagaagaagtccacacacttcccccagcggaagtttgcggtgaaagttgaatagacggtcttgactacctttgttttctctggctcgcgaaggaccccggttgtagagaggggagcaggggcgtgaacagactcaatcaaacgggcacaaacaagtggtgctgaatagccagcaggcgatatgggttgtatcggttctcttcaccgagaactaaaaccccttacgcttgaagcaatctgtcagcttggtggtgcagaatcagcatctttcggaatgtactaggcccctgggacggatagggatattccttctacgtgcaaaagatacctggtgcccgatgccaatcc

SEQ ID NO: 45754 - protein, 127 aa, Panicum virgatum
  misc_feature: Ceres CLONE 2026869
  misc_feature (9)..(67): Pfam Name: Ribosomal_L29 Pfam Description: Ribosomal L29 protein
MSSNAKVKPGQLWGKNKDDLKKQLDELKTELGQLRVQKISGGASSKLTRIHDLRKSIARTLTVINANQRHQLRIFYAKKKYLPLDLRQKQTRAIRRRLSKKDASRVTEKQKKKSTHFPQRKFAVKVE

SEQ ID NO: 45755 - DNA, 530 bp, Panicum virgatum
  misc_feature: Ceres CLONE 2026880
  misc_feature: Encodes the peptide sequence at SEQ ID NO. 45756
aaccacgacgactatcatatcccacaacctcgcgtacttgcgaactttctatctttgaaactttgcaggagactcggggcaagatgtcgacgttcgaacctgtcgttgtcattgacggcaagggacacttgctcggtcgtctcgccagtaccgtcgcaaagcaacttctcaatggccagaagattgttgtcgtccgaaccgaagccctcaacatctcaggcgaattcttccgtgctaagctcaagtaccatgcctacctccgaaagatcactcgttacaatcccactcgaggtggtcccttccatttccgtgcacctagccgcatcttctacaagaccgtccgaggcataatcccacacaagaccgctcgcggagcggctgccttggaaagactgaaggtgttcgagggcgtccctcctccatatgacaagaagcaaagagttgtggttcctcaagccctccgtgtcctcagattaaagcctggccgaaagtactgcacagttggcagattggctcatgaggtcggccgg

SEQ ID NO: 45756 - protein, 148 aa, Panicum virgatum
  misc_feature: Ceres CLONE 2026880
  misc_feature (7)..(124): Pfam Name: Ribosomal_L13 Pfam Description: Ribosomal protein L13
  misc_feature: Functional homolog of the protein sequence given in SEQ ID NO 50574
  misc_feature: Useful for making plants with modulated nitrogen use efficiency
MSTFEPVVVIDGKGHLLGRLASTVAKQLLNGQKIVVVRTEALNISGEFFRAKLKYHAYLRKITRYNPTRGGPFHFRAPSRIFYKTVRGIIPHKTARGAAALERLKVFEGVPPPYDKKQRVVVPQALRVLRLKPGRKYCTVGRLAHEVG

SEQ ID NO: 45757 - DNA, 597 bp, Panicum virgatum
  misc_feature: Ceres CLONE 2026890
  misc_feature: Encodes the peptide sequence at SEQ ID NO. 45758
tggtggaggctgtgacgccgttgccgtggctattcgtgacgctgccgcaggagccggagttgccattattgtagctgttggaggccttgacgcccctgttcgtgacgctaccgccggagccggacgattcctcgctgcaacatcctttggagaagctacctcaccagcacccatctattgtacctgcctccaatccatctgaggatgaattccaagcgtaggagtcatagtccagttgaatacgagggtcgtgataaagattatgagacttcaggaagaaaggataactcaagagatctagaagagtcaaaagatactagattaggaagaggtcatgattcgggtaggcacattgataggcattcctttggaacatcgcgtgactccaagaggcatgatgactataggaggtaccatgataagtacagtgatgatcatagtaggagccatctgagagcctctcggtcagatctcgaatcaagggctgataccaattatgatcactcaaagtgtgactacacatctggtagatcacgtggtgaccagcgagatgttgatagtaggtatggagagagatctgtcagtcgagatcagcgg

SEQ ID NO: 45758 - protein, 130 aa, Panicum virgatum
  misc_feature: Ceres CLONE 2026890
  misc_feature: SWISSPROT Homolog: EC 2.1.1.56 mRNA (guanine-N(7)-)-methyltransferase
MNSKRRSHSPVEYEGRDKDYETSGRKDNSRDLEESKDTRLGRGHDSGRHIDRHSFGTSRDSKRHDDYRRYHDKYSDDHSRSHLRASRSDLESRADTNYDHSKCDYTSGRSRGDQRDVDSRYGERSVSRDQ

SEQ ID NO: 45759 - DNA, 439 bp, Panicum virgatum
  misc_feature: Ceres CLONE 2026902
  misc_feature: Encodes the peptide sequence at SEQ ID NO. 45760
aactaacgctaaaaaagtaacagtttctgtactttattgcttcaagccgttccttcccaccgcaacaatgtccgccgccgaccgcaaggccgtgatcaagaacgccgacatgtccgaggacatgcagacggacgcgactgaaatcgccacccaggcgatggagaagttcaacatcgagaaggacatcgccgcgtacatcaagaaggagttcgacaagaagtacaaccccacttggcactgcatcgtgggccgcaacttcggctcgtacgtgacgcacgagacgaagcacttcatctacttctacctcggccaggtcgccatcctgctcttcaagtcgggataaatcggcgcctgtgagaacttctagaaattacccctccgctgtaaaaagaaactcaatccttccctcctcaccgctgtcgtactgcccacccttcgg

SEQ ID NO: 45760 - protein, 91 aa, Panicum virgatum
  misc_feature: Ceres CLONE 2026902
  misc_feature (3)..(91): Pfam Name: Dynein_light Pfam Description: Dynein light chain type 1
MSAADRKAVIKNADMSEDMQTDATEIATQAMEKFNIEKDIAAYIKKEFDKKYNPTWHCIVGRNFGSYVTHETKHFIYFYLGQVAILLFKSG

SEQ ID NO: 45761 - DNA, 691 bp, Panicum virgatum
  misc_feature: Ceres CLONE 2026916
  misc_feature: Encodes the peptide sequence at SEQ ID NO. 45762
acgcggtgcagctagctgcagcaaaggaagtctgatatacccgccggcgagatggatggccctctggagcgagctaccgcggcgaacgtcgccgtcatcgctttgctgctcctcctagcttgccacgctggagtcactgccggcctcgagcctccgcactcctcggcaggggtgaagaagcacgcccgcaagatgctcatcaacgcgacaaccggaggccacccgcacggcgttgctgctgccgccagcacggagtacgcgaaggcggcggcggtggacgacgacgacgactgctcggagggggtcgtgcaggtgtcccaggtcaacgccggcccgctgccgagcggcatcccctcctacagcgtgaccatcaccaacacgtgcctggactgcacggtgcgcgacgtccacgtctcctgcggcgagttcgcctccacggtgctcgtcgaccccagcagcttccggcgcctagcgtacggcgactgcctcgtcggggacggcgggcccataggccccggggagaccgtctgcttcgagtactccaactccttcatctacagcatggacgtagcgtcagtctcatgcggtgatatttaggcgttcaagtgtgggggtttatatcttgttgccaacataatctgtcctatcttaatgttggcaaataaaaaggccggtgtagtctatttagctc

SEQ ID NO: 45762 - protein, 181 aa, Panicum virgatum
  misc_feature: Ceres CLONE 2026916
  misc_feature: SWISSPROT Homolog: EC 2.1.1.43 Histone-lysine N-methyltransferase
MDGPLERATAANVAVIALLLLLACHAGVTAGLEPPHSSAGVKKHARKMLINATTGGHPHGVAAAASTEYAKAAAVDDDDDCSEGVVQVSQVNAGPLPSGIPSYSVTITNTCLDCTVRDVHVSCGEFASTVLVDPSSFRRLAYGDCLVGDGGPIGPGETVCFEYSNSFIYSMDVASVSCGDI

SEQ ID NO: 45763 - DNA, 574 bp, Panicum virgatum
  misc_feature: Ceres CLONE 2026925
  misc_feature: Encodes the peptide sequence at SEQ ID NO. 45764
aaaaccttcccaggacctcaccatttgatttgattgttcccttcggctctgtgccccggtggcccattaatttccccaaaccaaatgggcaggcaaggcctcggcccccctgttcctggccgtcaacttggcctggttccccatggccagcgccggcgggggcaactgccccaccccgccaacccctccccccccttccaccccaaccccaaccccggcgtcaaaaggcaggggcccccccaacccgctaaacctgggctggtgccccaccgtgctgggcctaatcaaggccaaggccggcgggccgccggcgaacccctgctgcccgttgctggaggggttcgccaacttcaaggccgccctgtgcctctgcaccgccttcaagggcaacttcctcggcttcaacctgaacctgcccttcaacttcaccctcttcctcaattacggcggcaaaaccgtgcccattggcttcaagtgcttctaaccatgcttccggccgcggggtcacaagttaataatgcacacccttgcgtgattcgttggaatccggtggggttgggttatcctgctttct

SEQ ID NO: 45764 - protein, 113 aa, Panicum virgatum
  misc_feature: Ceres CLONE 2026925
  misc_feature (32)..(112): Pfam Name: Tryp_alpha_amyl Pfam Description: Protease inhibitor/seed storage/LTP family
MASAGGGNCPTPPTPPPPSTPTPTPASKGRGPPNPLNLGWCPTVLGLIKAKAGGPPANPCCPLLEGFANFKAALCLCTAFKGNFLGFNLNLPFNFTLFLNYGGKTVPIGFKCF

SEQ ID NO: 45765 - DNA, 400 bp, Panicum virgatum
  misc_feature: Ceres CLONE 2026926
  misc_feature: Encodes the peptide sequence at SEQ ID NO. 45766
gcaccttctgcttcgcgttcgccggcaccgacggcggcgtgtccatcatcggcaacatccagcagcaggggttccgcgtggtgttcgacggcgacggccagcgcgtcgggttcgcgcccaagggctgctgagctcgctgggcggcgcggttaattaattagcaggtgattagcgggtaaaaagaagcgagccgccttgttagtcataattaacggaggatgtcagtgagcgagcttttggatgctgtgaaaaaagtttagagctgggcgatgcagagcttgtctgtctctagactaccagaagtagctttgctttggtgcgcgagaggatatcaggataaggcagttggtcgatgaaggctgtaaaaggcccggtgaaagtgtctgggttaatcttttcg

SEQ ID NO: 45766 - protein, 42 aa, Panicum virgatum
  misc_feature: Ceres CLONE 2026926
  misc_feature: Functional homolog of the protein sequence given in SEQ ID NO 50928
  misc_feature: Useful for making plants with modulated biomass
TFCFAFAGTDGGVSIIGNIQQQGFRVVFDGDGQRVGFAPKGC

SEQ ID NO: 45767 - DNA, 665 bp, Panicum virgatum
  misc_feature: Ceres CLONE 2026935
  misc_feature: Encodes the peptide sequence at SEQ ID NO. 45768
gaaagctgggtttcgggaagtcacaacctaactatatcagtggtctatagcatccaatagcagatgtcattgctaaactattatcagtatccgaatactcacatagtttggctggaaaacgtggatgctaaattgaaggccctccgtgacattgaagaaggagaggagctgcgcatctgctacatcgatactagcatggatgtcaatgctcgccagaagattcttgctgacggattcagctttgagtgccactgccttcggtgcttgtctggagattagagtccatggccttgagtcttcctagcatgattaactgtcatgtagaccggttcttgaagcagcttgaggtccatggccttgagcactatcctgcagagctgcagtcctctgtacactagctaatgctgctccgaatttttgatggttaggagtaagcattacttaagacatgatagaagcccagcaatgttgatttatttacttgaaagtactgaatgctgtggccgctgtttttagcctcttttccagacgtcttatgacgaggccatttttccagtactttggtattagaaattatagttttttctcctcttggacacgagtaccggtttcacttgaaatgtaaggctagttttcttaccacttgatatatctccttttaatag

SEQ ID NO: 45768 - protein, 71 aa, Panicum virgatum
  misc_feature: Ceres CLONE 2026935
  misc_feature: SWISSPROT Homolog: EC 2.1.1.43 Histone-lysine N-methyltransferase
MSLLNYYQYPNTHIVWLENVDAKLKALRDIEEGEELRICYIDTSMDVNARQKILADGFSFECHCLRCLSGD

SEQ ID NO: 45769 - DNA, 425 bp, Panicum virgatum
  misc_feature: Ceres CLONE 2026942
  misc_feature: Encodes the peptide sequence at SEQ ID NO. 45770
gatgacgatgccaaagtgaagagggcatttcaaacactccttacttatattggaaatgttgctaaaagtcccgatgaggagaaattcagaaagattaggctcacgaatgctacatttcaggagagggttaggaatctgcatgggggcatagagttcctcgagctctgcggatttgagaagcttgaaggcaacgagttcttgtttctaccaagggacaaggttgacaaggccatcctgaacacggctggagccgagctgaattctgcaatcaccaatcctttcttcggagtcctttgagctgccgagaacctcaatgcctcttggcttcacctctttgcttttacatgcaaattgtgtttaacatgcgcatggcctggatggtagtggatttgcaagtcatacatattacacgaatgattgcatcc

SEQ ID NO: 45770 - protein, 98 aa, Panicum virgatum
  misc_feature: Ceres CLONE 2026942
  misc_feature: SWISSPROT Homolog: EC 3.5.1.52 Peptide-N(4)-(N-acetyl-beta-glucosaminyl)asparagine amidase
DDDAKVKRAFQTLLTYIGNVAKSPDEEKFRKIRLTNATFQERVRNLHGGIEFLELCGFEKLEGNEFLFLPRDKVDKAILNTAGAELNSAITNPFFGVL

SEQ ID NO: 45771 - DNA, 463 bp, Panicum virgatum
  misc_feature: Ceres CLONE 2026951
  misc_feature: Encodes the peptide sequence at SEQ ID NO. 45772
ggattttccgtttttgagcatcgaggatatcagattagaatggctgacggagatgcaatggctgttgatggcgaacttgatcttattggagccttgaaggttgttctcaagaaagctctcatccacgatggtttggctcgtggactccgtgagagtgttaaagctttggatcgtaaagaagcacatttatgtgtccttgctgctgattgtgaagatgaatcatacaaaaccttgattactgctctttgtcgtgctcattccattgacttagttgaggtcccatctcgaacaaaacttggagagtgggctggtttgtataagttggatgcagattctcaacctagaaaggttgtcaacacctcctgtgttgttgttaaaaactatggagaaacttctgcagagttggagttcttgattgattacttcaagaagagataaataaagctccaataattggatcctg

SEQ ID NO: 45772 - protein, 132 aa, Panicum virgatum
  misc_feature: Ceres CLONE 2026951
  misc_feature (17)..(112): Pfam Name: Ribosomal_L7Ae Pfam Description: Ribosomal protein L7Ae/L30e/S12e/Gadd45 family
MADGDAMAVDGELDLIGALKVVLKKALIHDGLARGLRESVKALDRKEAHLCVLAADCEDESYKTLITALCRAHSIDLVEVPSRTKLGEWAGLYKLDADSQPRKVVNTSCVVVKNYGETSAELEFLIDYFKKR

SEQ ID NO: 45773 - DNA, 594 bp, Panicum virgatum
  misc_feature: Ceres CLONE 2026965
  misc_feature: Encodes the peptide sequence at SEQ ID NO. 45774
ggtcgcgcggtcaaacggcaaacgggacacccgacaccgaggcaccaacaaaaaaaagggagtaggggagagggagcggagagcggcggcggcggcccgggcgccggaggggaggggaggggaggaggagaggagatggcggccatcggctcctccgacgtcggattccagctgctgaagaagtcaggttggaaggagggcaccggcctcggagcgcaggagcagggaaggttggagcctgtagagactcgtgttaagaacaacaagcgtggcctaggttctaaagaaccaaaaccaaagccaaaagcggaggatgatgttgaatatgatccccaaaagtccaagccggatatgcaatcaaagaagagagcaaagctagctgcaaagaggataacgaagatgccggaagaggagaagcgattgcaagagaaggatttcgagatggctttctttagggaattttggcctgataatgtgtaaaagcagagctactgaccttgactgataacgcgaatgtacaggttatttaaacgcattgtacgtttttgtgaccgccattctgtttttcagcccattagatgtgagccattatcc

SEQ ID NO: 45774 - protein, 114 aa, Panicum virgatum
  misc_feature: Ceres CLONE 2026965
  misc_feature (6)..(50): Pfam Name: G-patch Pfam Description: G-patch domain
MAAIGSSDVGFQLLKKSGWKEGTGLGAQEQGRLEPVETRVKNNKRGLGSKEPKPKPKAEDDVEYDPQKSKPDMQSKKRAKLAAKRITKMPEEEKRLQEKDFEMAFFREFWPDNV

SEQ ID NO: 45775 - DNA, 618 bp, Panicum virgatum
  misc_feature: Ceres CLONE 2026979
  misc_feature: Encodes the peptide sequence at SEQ ID NO. 45776
atacagaattgggtccatgatcgaggttccgagggcagctcttatagctgacgagatagcagagcaggcagaattcttctcatttgggacaaatgacctcacacagatgacatttggttacagcagggatgacattggcaagtttctcccaatctacatgtcccagggtattctgcagcacgacccatttgaggtgctcgaccagaaaggagtcggggagttggttaagattgccactgagaggggccgaagttcaaggcatgatttggaggtgggcatttgtggtgaacatggtggcgagccttcttcagttgcattttttgcgaaggctgggctggactatgtttcttgttcgcctttcagggtcccaattgcaaggctagccgcagcacaggcggccctctgatgagcgcgaatttgtgaagctcctccgcaagcagtctgttggtgcgtcctgtagataaataatcacagatgggcacctcttgaatggtcgcttgagaggcgcacggtgtatctagtaacttgtagctttgtaaggcatgtgtcccaaaacgttgggatgccatcgtgtcaatgtccacaggttgtacaatagctcgtttgcctgcggtgctg

SEQ ID NO: 45776 - protein, 134 aa, Panicum virgatum
  misc_feature: Ceres CLONE 2026979
  misc_feature (1)..(134): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
YRIGSMIEVPRAALIADEIAEQAEFFSFGTNDLTQMTFGYSRDDIGKFLPIYMSQGILQHDPFEVLDQKGVGELVKIATERGRSSRHDLEVGICGEHGGEPSSVAFFAKAGLDYVSCSPFRVPIARLAAAQAAL

SEQ ID NO: 45777 - DNA, 512 bp, Panicum virgatum
  misc_feature: Ceres CLONE 2026983
  misc_feature: Encodes the peptide sequence at SEQ ID NO. 45778
gcttctgtctcctctctccacacgacttgctcgggccgccgccgccgccgtcgtcgcagcagtcaccgtgacctgcaaccagagaaaggttaagcttgccgtcgtggtcaaggtgatgggccgcaccggttccaggggtcaggtgacccaggtcagagtgaagttcctggacgaccagaaccgtctcatcatgaggaacgtcaagggccctgtccgtgagggtgacatcctcaccttgctcgagtctgagagggaggccaggaggctgcgctgaagcagctggttgttgtgtcagttgttcgctgttcttgtcttaaacaagttaatgatggattgatttccccttgcctagtgtactgctttcgcatcaagttcttgaagaatgctactttgtcttttgcataggctatggagaatgagttaagagcaatggaaatgtaatttgtgcacatgtcctgttgcaagttttggtctgttaccctgaatgaaattaagtgcacttatgttgtgtc

SEQ ID NO: 45778 - protein, 90 aa, Panicum virgatum
  misc_feature: Ceres CLONE 2026983
  misc_feature (24)..(90): Pfam Name: Ribosomal_S28e Pfam Description: Ribosomal protein S28e
LLSPLSTRLARAAAAAVVAAVTVTCNQRKVKLAVVVKVMGRTGSRGQVTQVRVKFLDDQNRLIMRNVKGPVREGDILTLLESEREARRLR

SEQ ID NO: 45779 - DNA, 774 bp, Panicum virgatum
  misc_feature: Ceres CLONE 2026991
  misc_feature: Encodes the peptide sequence at SEQ ID NO. 45780
gcgtcaaaaccaagaaacaactcgtcaatggaaccagagaaagaagaatatgcatttcaagctgaaattaaccagttgatgtctttaatcgtcaacactttttactcaaacaaagaaatcttcttgcgagagttgatttccaactcttctgatgctcttgacaaaattcgataccaatcattgaccaacaaacaacttctcgaagctgaacccgaactcaagattgagcttatccctgataaggaagcaaagacactcaccatcagagacactggaattggaatgaccaaacctgatcttgttaacaatcttggaaccattgctcgatctggaaccaaaaacttcatgcaaatgatcagcgaaaacaatgccgatctcagtatgattggacaatttggagtcggattttattccgcttatttagttgctgacaaagtcactgtcatcaccaaacacaacgatgacgaacaatacatctgggaatctgaagctggaggacacttcacaattcaacgtgatgctcacggtccattcatgggacgaggaactaaaatcgttcttcacctcaaagaagaccaaactgattactttgaagatagaactttgaaagatcttgtcaagaaacactctcaattcatccaatacccaattaacttgctgacaaccaaagaagaagaagtttctgataaggatgaagccaaagttgaaccagctgttgaaaatgctgatgaacctcaagtcactccagcagatgatgacgatgaaaaaaagacc

SEQ ID NO: 45780 - protein, 248 aa, Panicum virgatum
  misc_feature: Ceres CLONE 2026991
  misc_feature (28)..(183): Pfam Name: HATPase_c Pfam Description: Histidine kinase-, DNA gyrase B-, and HSP90-like ATPase
MEPEKEEYAFQAEINQLMSLIVNTFYSNKEIFLRELISNSSDALDKIRYQSLTNKQLLEAEPELKIELIPDKEAKTLTIRDTGIGMTKPDLVNNLGTIARSGTKNFMQMISENNADLSMIGQFGVGFYSAYLVADKVTVITKHNDDEQYIWESEAGGHFTIQRDAHGPFMGRGTKIVLHLKEDQTDYFEDRTLKDLVKKHSQFIQYPINLLTTKEEEVSDKDEAKVEPAVENADEPQVTPADDDDEKK

SEQ ID NO: 45781 - DNA, 574 bp, Panicum virgatum
  misc_feature: Ceres CLONE 2026992
  misc_feature: Encodes the peptide sequence at SEQ ID NO. 45782
accctacctcgcagcgccgcctagcccaagcagccgagcgaggaagcgaagactcaccccccccccccaacccccccgagccagagcaccatgggggcggggggggtttacggtggcctcaaggggaagcttggcgtcgaggacgcccccgagctgcagcttaaccgcatccgcatcaccctgtcctccaagaacgtcaagaacttggagaaagtttgtgcggatttggtgaagggagccaaggacaagcagctgagggttaagggacccgtcaggatccctactaaggttctccacatcaccacccgcaagtccccttgtggtgaaggaacaaacacatgggatcgctttgagttccgcatccagaagagggtgattgacctgatcagctcccccgatgtggtgaagcagatcacctccatcaccattgagcctggtgtcgaggtcgaggtgaccatcgcggatgtgtaatgccatgcagtttagctgtcatagactatccatatattgcgttggtttagtttttgtgctccctttgtgtgcttgtatgagacatctgagtgattattagcat

SEQ ID NO: 45782 - protein, 126 aa, Panicum virgatum
  misc_feature: Ceres CLONE 2026992
  misc_feature (26)..(121): Pfam Name: Ribosomal_S10 Pfam Description: Ribosomal protein S10p/S20e
  misc_feature: Functional homolog of the protein sequence given in SEQ ID NO 50532
  misc_feature: Useful for making plants with modulated biomass
  misc_feature: Useful for making plants with modulated flowering time
  misc_feature: Functional homolog of the protein sequence given in SEQ ID NO 50533
  misc_feature: Useful for making plants with modulated phosphate use efficiency
MGAGGVYGGLKGKLGVEDAPELQLNRIRITLSSKNVKNLEKVCADLVKGAKDKQLRVKGPVRIPTKVLHITTRKSPCGEGTNTWDRFEFRIQKRVIDLISSPDVVKQITSITIEPGVEVEVTIADV

SEQ ID NO: 45783 - DNA, 466 bp, Panicum virgatum
  misc_feature: Ceres CLONE 2026999
  misc_feature: Encodes the peptide sequence at SEQ ID NO. 45784
agtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcttcaccttctcgagcgagcaggcgatgcgcgatgccatcgaggggatgaacggcaaggagctggacggccgcagcatcaccgtcaactaggcccagtcccgcggcggcccgagctcctgcggcggcggcggcgggtacgggcgccgccagggcggcggcggctacaggagcagtggctgcaggggttgcgggtgtggctaccggcgccgca

SEQ ID NO: 45784 - protein, 82 aa, Panicum virgatum
  misc_feature: Ceres CLONE 2026999
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAASDVEYRCFVGGLAWATDDNSLHNAFSPFGEVLESKIILDRETQRSRGFGFFTFSSEQAMRDAIEGMNGKELDGRSITVN

SEQ ID NO: 45785 - DNA, 582 bp, Panicum virgatum
  misc_feature: Ceres CLONE 2027020
  misc_feature: Encodes the peptide sequence at SEQ ID NO. 45786
gggagtatggtcgcaaggctgagcacatgccgcggccgcctccctcagatcctccgtcctcgctcggtcaagtgccgccgctacccccctccgtcactcttctcccgtgacccgcgagtacaccattaacctccacaagcgcctccacggatgcaccttcaagaagaaagcaccaaatgccatcaaagagatcaggaagtttgcacagaaggctatgggaaccactgatgtccgaattgatgtgaagctcaacaagcacatctggagcagtggtatccggagcgttccaaggcgagttcgcgtcagaatcgcccggaagaggaatgatgaggaagatgccaaggaggagctctactctctggtcacagttgctgagatccctgcagagggtctcaaaggtttgggtactaaggttgttgaggatgaggattaagccctcccatggattgaatctgctagcacttagtgcatatcatgagagcaagtttgagaatgttaccttagcttattgttatctaccgttgatgacttatgtaatagaagattcaagactttgctcatttctttcaagtgcttgaaatt

SEQ ID NO: 45786 - protein, 72 aa, Panicum virgatum
  misc_feature: Ceres CLONE 2027020
  misc_feature (1)..(54): Pfam Name: Ribosomal_L31e Pfam Description: Ribosomal protein L31e
MGTTDVRIDVKLNKHIWSSGIRSVPRRVRVRIARKRNDEEDAKEELYSLVTVAEIPAEGLKGLGTKVVEDED

SEQ ID NO: 45787 - DNA, 459 bp, Panicum virgatum
  misc_feature: Ceres CLONE 2027021
  misc_feature: Encodes the peptide sequence at SEQ ID NO. 45788
gaggaggatgaagactttcttgacaatctcaatccttgcactcgacgagagaccccagcccttggagacgcaaacatgaggaacctcaagctcggggaggtcatacagatcgagaggaaaggctactacaggtgtgatgccccatttatcaggtcgtcgaaacctgtggtcctatttgcgatcccagatggtcggcagcaggcctcgctgaactaggcagcatgcaactgatgggcacatggaattcctgagatgtcaggcttggcaatcaatatcgtcgtatacacttaatcttgtactatgattaggcttactcgccatagattttgttcactactagctattggccaggcccatcctgccaaccaagcagcacaggcattttgattttggttgtttgaacatgcatgatgattttggttgatgatacctccgtccataaattggcgttgtttgagc

SEQ ID NO: 45788 - protein, 71 aa, Panicum virgatum
  misc_feature: Ceres CLONE 2027021
  misc_feature: SWISSPROT Homolog: EC 6.1.1.17 Glutamate--tRNA ligase
EEDEDFLDNLNPCTRRETPALGDANMRNLKLGEVIQIERKGYYRCDAPFIRSSKPVVLFAIPDGRQQASLN

SEQ ID NO: 45789 - DNA, 504 bp, Panicum virgatum
  misc_feature: Ceres CLONE 2027044
  misc_feature: Encodes the peptide sequence at SEQ ID NO. 45790
atgtttggtgacctacgaaagtttctgtgtgggtattttgataccacaactggtaataaaagagaaaccaagagttattatgagatctctcagtcacttggtgttgacaatccatctcaaatcttattcatcactgacgtctaccaagaagccattgctgccaaaaatgcaggttttgatgtgataatctccattcgcccgggaaatgctccacttcctgagaaccatggtttccgcactatcaagtcattcagcgagatatgacgaatgcaaacttctagaggtgcgatggcacaggatatgtgtaattcatgagtgttttctgggctaatattagccggccgatcaggccatgcaatagtagcagtatagtgcctcagcaaggcagaacgaggtgacacaacaataaaccggaatggcaaataaaactgtacatgctggtctgttatgtttttgtgccaacgttgcaaccagagtgcttggcttctgcaggttgtttagcag

SEQ ID NO: 45790 - protein, 87 aa, Panicum virgatum
  misc_feature: Ceres CLONE 2027044
  misc_feature: SWISSPROT Homolog: EC 3.1.3.77 Acireductone synthase
MFGDLRKFLCGYFDTTTGNKRETKSYYEISQSLGVDNPSQILFITDVYQEAIAAKNAGFDVIISIRPGNAPLPENHGFRTIKSFSEI

SEQ ID NO: 45791 - DNA, 647 bp, Panicum virgatum
  misc_feature: Ceres CLONE 2027052
  misc_feature: Encodes the peptide sequence at SEQ ID NO. 45792
gggctttatccacggaacactttccggcggcgaccacttggtgcccggcggcggccatgtcatcggagaaggaggcggcgctcgccgccgtgcccaacgacagccccaccatatttgacaagatcataaaaaaggaaataccatctactgtcatttatgaggatgagaaggtattggctttcagagacatcaaccctcaagctccaacacacatcctaatcattcccaaagtcaaggatggattaactggcctttcgaaggcagaagagaggcacgttgagatacttggccatctcctctatgttgccaaagtaattgcgaagcaggaaggacttgaagatggctaccgtgttgtcatcaatgatggccccagtggatgccaatctgtttaccacatccacgttcatctccttggaggcaggcagatgaactggcccccaggctaagaatctcggttgatctgtctccatggtgatgattgatgctgcatctctatcgaataattcctgtaattcccacaaaatttagcgtgttgaccttgtgctgtatttgtggaattactggaaccaccctgctgtgatttatggacgagaaacttgcacttggaagttggaatcatggaatgacatgtcctcgttgatccgctc

SEQ ID NO: 45792 - protein, 129 aa, Panicum virgatum; identical to SEQ ID NO: 9978
  misc_feature: Ceres CLONE 2027052
  misc_feature (25)..(124): Pfam Name: HIT Pfam Description: HIT domain
  misc_feature: SWISSPROT Homolog: EC 3.6.1.17 Bis(5'-nucleosyl)-tetraphosphatase (asymmetrical)

SEQ ID NO: 45793 - DNA, 560 bp, Panicum virgatum
  misc_feature: Ceres CLONE 2027077
  misc_feature: Encodes the peptide sequence at SEQ ID NO. 45794
acttctccatcacttcctctccattccttcatcgcaatggctcgcactaagcaaaccgcacgcaagtctactggtggcaaggcccctcgcaagcagttggcgaccaaggctgcccccaagagcgcccccaccgctgcaggcgtcaagaagccccatcgctatcgccctggtactgtggcccttcgtgagattagaaagtaccagaagtccacagatttgttgattcgcaagctgcccttccagcgtctggttcgtgaaatcgcccaggactacaaagccgatcttcgcttccaaagctctgccattctcgcccttcaagaagcttctgaggcttatctcgtgtcgctcttcgaagataccaacctgtgcgccatccacgccaagcgtgtcacgattatgcccaaggacattcaactcgctcgtcgtatccgtggagagcgtgcttagtccatctgcgtttcacatattcctttttttccccctttcattctgtatctttgtgtgcattttatcacaatcctttgtgttggccctaaggccgatacacgagttatgcgtgc

SEQ ID NO: 45794 - protein, 136 aa, Panicum virgatum
  misc_feature: Ceres CLONE 2027077
  misc_feature (58)..(132): Pfam Name: Histone Pfam Description: Core histone H2A/H2B/H3/H4
MARTKQTARKSTGGKAPRKQLATKAAPKSAPTAAGVKKPHRYRPGTVALREIRKYQKSTDLLIRKLPFQRLVREIAQDYKADLRFQSSAILALQEASEAYLVSLFEDTNLCAIHAKRVTIMPKDIQLARRIRGERA

SEQ ID NO: 45795 - DNA, 539 bp, Panicum virgatum
  misc_feature: Ceres CLONE 2027078
  misc_feature: Encodes the peptide sequence at SEQ ID NO. 45796
aacaaacgctaaaaaagtaacagtttctgtactttattggggttcgcccaacatgaccaaggccaacggtctgcacgcggcccgtaagctgatccgcatccgccggaaggggcgctgggcggacaagggctggaagaagagccacaccttcaccgccgccaaggccaacccgttcggtgggtcgtcccactgcaagggcatcgtgctcgagaagatcggcgtcaaggctaagcagcccaactccgccatccgcaagtgcgtgcgtgtgcagctgatcaagaacggcaagaagatcatcgcgttcgtgccgcgtgacggtgctctccacttcgtggaggagaacgacgaggtgctcgtggccggcttcggccgcgagggccactccgtcggtgacttgcccggagtccgcttcaagatcgtgaaggtcgcctctgtgggtctgtacgcgctgtaccgcgagaagaaggagaagccgcgtaactagacgccagtacccatgttgctaccccaacagcaaatcatctcaccccttttcattc

SEQ ID NO: 45796 - protein, 143 aa, Panicum virgatum
  misc_feature: Ceres CLONE 2027078
  misc_feature (8)..(142): Pfam Name: Ribosomal_S12 Pfam Description: Ribosomal protein S12
MTKANGLHAARKLIRIRRKGRWADKGWKKSHTFTAAKANPFGGSSHCKGIVLEKIGVKAKQPNSAIRKCVRVQLIKNGKKIIAFVPRDGALHFVEENDEVLVAGFGREGHSVGDLPGVRFKIVKVASVGLYALYREKKEKPRN

SEQ ID NO: 45797 - DNA, 276 bp, Panicum virgatum
  misc_feature: Ceres CLONE 2027088
  misc_feature: Encodes the peptide sequence at SEQ ID NO. 45798
ttacagtacgcactccggctgacgcgccccgcactctctcacaaagctcaagcctttcgctcgcatcgctcgctcgcggctacatctacaatggagcgattccagctcgcgggcctgggcatggacatgcgctacgccgcggctgaggcgcaggccccggccgccaccccgactccggcgcccaaggcgccgcccccggcggcgactcctccgccgaccccggcgccagtgtcaccgcccactcaggacacctccggcccggcaccggctatggcg

SEQ ID NO: 45798 - protein, 61 aa, Panicum virgatum
  misc_feature: Ceres CLONE 2027088
  misc_feature: Functional homolog of the protein sequence given in SEQ ID NO 50464
  misc_feature: Useful for making plants with altered carbohydrate content
  misc_feature: Functional homolog of the protein sequence given in SEQ ID NO 50194
  misc_feature: Useful for making plants with altered cell wall content and/or composition
MERFQLAGLGMDMRYAAAEAQAPAATPTPAPKAPPPAATPPPTPAPVSPPTQDTSGPAPAM

SEQ ID NO: 45799 - DNA, 587 bp, Panicum virgatum
  misc_feature: Ceres CLONE 2027121
  misc_feature: Encodes the peptide sequence at SEQ ID NO. 45800
gaacccaatccaacgtccgcagcaaacacacccagctgactccccctgtttccactccactcggaccagatcccaagcactccgaagccgagagagcgccgcgcgcgaagcggtgccgcaagaaccagtaccgcggcatccggcagcggccgtggggcaagtgggcggcggagatccgcgaccccgtgaagggcgtccgcgtctggctcggcacctaccccaccgccgaggccgccgcgcgcgcctacgaccgcgccgccaggcgcatccggggcgccaaggctaaggtcaacttccccaacgacatctcgtccccagcctctgtgccggcggcagctccggccgtgctcccggcgcccaaggcggaggcagcggtgtccgacgaggtcaaggagctgtccgaggagctgatggccttcgagaactacatgaacttcctcggcatcccctacatggagggcgggagcgcggccgcgcccgccgccgccgccgccgccgcccccgtcgcggaggagccgcaggcgccggtgccctccgggctgtggagcttccaggactactacccggcgtccctgtcgctcttcact

SEQ ID NO: 45800 - protein, 194 aa, Panicum virgatum
  misc_feature: Ceres CLONE 2027121
  misc_feature (41)..(92): Pfam Name: AP2 Pfam Description: AP2 domain
  misc_feature: The sequence is a functional homolog of SEQ ID NO 151 in the 11/479,226 US patent application
  misc_feature: The sequence is a functional homolog of SEQ ID NO 32 in the 10/412,699 US patent application
TQSNVRSKHTQLTPPVSTPLGPDPKHSEAERAPRAKRCRKNQYRGIRQRPWGKWAAEIRDPVKGVRVWLGTYPTAEAAARAYDRAARRIRGAKAKVNFPNDISSPASVPAAAPAVLPAPKAEAAVSDEVKELSEELMAFENYMNFLGIPYMEGGSAAAPAAAAAAAPVAEEPQAPVPSGLWSFQDYYPASLSLF

SEQ ID NO: 45801 - DNA, 712 bp, Panicum virgatum
  misc_feature: Ceres CLONE 2027126
  misc_feature: Encodes the peptide sequence at SEQ ID NO. 45802
gaatcactcgaccgcaagctgtcacagctctcaacaaccacacagcacgctacagctagagataaacagatcgagcgcagtacgcgaccacggaaaccagtgcgatggctcgccggctgctcggtgcttgctgcgtgctcctcgccgccgtcctgctcgtggacgtggcggcgtccgcgcgcgccgacgagccgagcggcatacggcagccgggcggcgagtaccgggggaggaaggtgggggcgaggacggaggtccgggacgtggagcgcgacggggaggtgcaggagctcggccggttctccgtcgccgagtacaaccggcggcgcgtcggcggcgaaaggctcgagttcggaagggtcgtcgcggcgcagcggcaggtggtgtcggggctcaagtactacctccgcgtggccgcggcggcggagaacgccggcggcgagcgcgtgttcgacgccgtcgtcgtcgtcaagccctggctcgagtcgcgcaccctgctcaggttcgcgccggccgccccgaaataagtgtagcgccacccattgagtgcgtgctatgtccgtccgtgactttgggccggtctgctttctcgcagactttggtgagcgaataaaagtcttgtttttgtacaagggtatagtagaggagagtcaagaccaataactttgcgctgcagtagatgtgtctgaaggctattgtacaaagagatgag

SEQ ID NO: 45802 - protein, 140 aa, Panicum virgatum
  misc_feature: Ceres CLONE 2027126
  misc_feature (46)..(138): Pfam Name: Cystatin Pfam Description: Cystatin domain
MARRLLGACCVLLAAVLLVDVAASARADEPSGIRQPGGEYRGRKVGARTEVRDVERDGEVQELGRFSVAEYNRRRVGGERLEFGRVVAAQRQVVSGLKYYLRVAAAAENAGGERVFDAVVVVKPWLESRTLLRFAPAAPK

SEQ ID NO: 45803 - DNA, 599 bp, Panicum virgatum
  misc_feature: Ceres CLONE 2027129
  misc_feature: Encodes the peptide sequence at SEQ ID NO. 45804
aactcgcagctgatccaccgctgaagtaatttgcagatcgagagagaagcgaaaccatggcgtccaaggcgctcctagtgctcgcgctcctgctcgctgctgctttccttgtcgcctcagctaacaacgagcacacccagccgaaggaggaggagagcaagcaggccggcgtgcaggactaccaccgcggcggtggctaccctggccacggcggcggcggcgggtactgccggtgggggtgctgcaaccgcggctactacggcggctgccgctgctgctcgcgccccgacgagatcccggagcccatgtaccgcccggagttcgtcgaggtccacgactgaatgaacaagctagctgcacgtacggcctcgttgccatgtactactactactaagactacgtacacgacctacctagctaataaagtaataataagcagtcgatcggtaaaagtatgggttcaacaataaaggatgcatgtatgcaattgtgcgtgtgatgaatgtatgtccgtgtgtgcttgatgcagtagaatgtaactctcatgcatgtataatcatgcatgccgtcgaataaagaataagagagtcgttgttgcc

SEQ ID NO: 45804 - protein, 94 aa, Panicum virgatum
  misc_feature: Ceres CLONE 2027129
  misc_feature (1)..(71): Pfam Name: GRP Pfam Description: Glycine rich protein family
MASKALLVLALLLAAAFLVASANNEHTQPKEEESKQAGVQDYHRGGGYPGHGGGGGYCRWGCCNRGYYGGCRCCSRPDEIPEPMYRPEFVEVHD

SEQ ID NO: 45805 - DNA, 426 bp, Panicum virgatum
  misc_feature: Ceres CLONE 2027135
  misc_feature: Encodes the peptide sequence at SEQ ID NO. 45806
gggcgcttgggataacgcgaagaagtacattgagactggtgctcttggtggcaaaggcagtgagtctcacaaggctgcggttactggcgacacggttggtgacccattcaaagacacagcggggccttcgcttcatgttcttatcaagatgcttgccacaatcacattggtcatggcgccgatatttttgtgattaaccaaccactcatcaagcttaccctcagagatgtatttaccagactcatttagcatcactaagagaatctccctcctgatatttcacggtaatattgtactggatggtgcaaacgttggagaatgcatatacttgtgacggagattacagagttaatcgcccgagtgtcttgtgtttgacatcggagagtacttatatgcattgatggagattacggaactagtcgcccg

SEQ ID NO: 45806 - protein, 63 aa, Panicum virgatum
  misc_feature: Ceres CLONE 2027135
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
GAWDNAKKYIETGALGGKGSESHKAAVTGDTVGDPFKDTAGPSLHVLIKMLATITLVMAPIFL

SEQ ID NO: 45807 - DNA, 806 bp, Panicum virgatum
  misc_feature: Ceres CLONE 2027137
  misc_feature: Encodes the peptide sequence at SEQ ID NO. 45808
gtcattagtgctagtcgtcgcctgcaaccgcaaagcttctatccaactcctctgcagttgcgagcctcttccattgcgtgtgcgcgagaatgtctgcgctggcgaaggctgtggtcgccctcgtggcgatggccgccgtggccgagctcgccgccgccaagaaccacacgatccagtggtcggcgagcgggaactacggcgactggtcggcctcgaacgcggtcagcgtcggcgacaccgtcgtgttcacgtacgggccgccgcacaccgtggacgagctgccgtcggaggcggactacacggcgtgcagcttcggcggcgcggtgtcgtcggacagcagcggcagcacggccttcacgttcgacaaggccggcacgaggtacttcgcgtgcgccacggggtcgcactgcgccggcgggcagaaggtggccatcacggtctccggcgcctcttcgcagaccccggcgacgccggcggcccccaaggggaactcggcggcgccgatggcaggcgcggccgggatcgccgcgaagctggcgcttggcctcggcgtcggaggagccctgctcatcgctgccttctgatcgaccgagtttcgtgttggttgggccgtctgtcgtcgcgcctgcacagtagcagcacggtcgtcgcctgcacagtagaatttcatgatttgttacattacatgttatcctactcaaaatggttttgtatttcatcctcgccatgtgtgtagaacacggtctcttgtagttgtaatggatttgattggcaagcttatggagtaataaatacaagttcagtgt

SEQ ID NO: 45808 - protein, 164 aa, Panicum virgatum
  misc_feature: Ceres CLONE 2027137
  misc_feature (30)..(111): Pfam Name: Cu_bind_like Pfam Description: Plastocyanin-like domain
MSALAKAVVALVAMAAVAELAAAKNHTIQWSASGNYGDWSASNAVSVGDTVVFTYGPPHTVDELPSEADYTACSFGGAVSSDSSGSTAFTFDKAGTRYFACATGSHCAGGQKVAITVSGASSQTPATPAAPKGNSAAPMAGAAGIAAKLALGLGVGGALLIAAF

SEQ ID NO: 45809 - DNA, 668 bp, Panicum virgatum
  misc_feature: Ceres CLONE 2027140
  misc_feature: Encodes the peptide sequence at SEQ ID NO. 45810
acacatcccgctgtgctctctctctctctctctcgccgccgccgcaaccgccgtctcgcccgcgcccgctcccgctccggaaggaaagctcaggtgaagagctgggtagcaggaaatggcggcgtttctgaggtcaaagtgttcgtcagttggacgtactctgatgggtagctcatctgttgaggcagtgacaagaccttctcattgcgatgctatcagccagcaaatcagaacattcatccagatgagaaccaacctcaaggtcgtggacaactctggagcgaagcgggttatgtgcattcaggccaagaggggcaagtatggagcgaggcttggggacacaattgttggatctgtcaaggaagcacagcctcgtggcaaggtcaagaaaggagatgtcgtgtacggagtggtcgtccgtgctgccatgaagaaaggccgcagtgatggcagcgaggtccagttcgatgacaatgcgatagtccttgtaaacaacaagggcgagctgatcggcactcgcgtctttggtccggtgcctcatgagcttaggaagaagaagcacctcaagatcctggcgttggctgagcacattgtttgagatgtcgtccctcttaggtatctgcctgttagttattcagagtgaaatgaatgtggtgtttcccttaaag

SEQ ID NO: 45810 - protein, 160 aa, Panicum virgatum
  misc_feature: Ceres CLONE 2027140
  misc_feature (42)..(160): Pfam Name: Ribosomal_L14 Pfam Description: Ribosomal protein L14p/L23e
MAAFLRSKCSSVGRTLMGSSSVEAVTRPSHCDAISQQIRTFIQMRTNLKVVDNSGAKRVMCIQAKRGKYGARLGDTIVGSVKEAQPRGKVKKGDVVYGVVVRAAMKKGRSDGSEVQFDDNAIVLVNNKGELIGTRVFGPVPHELRKKKHLKILALAEHIV

SEQ ID NO: 45811 - DNA, 516 bp, Panicum virgatum
  misc_feature: Ceres CLONE 2027149
  misc_feature: Encodes the peptide sequence at SEQ ID NO. 45812
gtctcattccgcaccacctcctctccctcttccccttcctcctccttcccagcctctgctcgtgccgccgccggccatggcctgcctcaccgacctcgtcaacctcaacctctccgacaccacggagaagatcatcgccgagtacatatggtacgtacggcaacgtcctccttgttaatccgcacgctacagccccctctgcgtcgtcggccagaaagaaccgatcttgctggccgccgtcctccttttcatggcggttcggcgtccggaaacgggctcttgtcggccgccgcgtgggaacgaaggatctttgctgcgtttgaggaggggttttgggagattattgcagatttttgccttctttttcgtcctcgacggcacgagcggtgctactattagttgctgtattttccccttcttctctgccaccctgtgcaacctctctgttttctcttggtggtcaattggtttttatctgctcaactcaaataaaaatctgtcatgttttcctgtttc

SEQ ID NO: 45812 - protein, 33 aa, Panicum virgatum
  misc_feature: Ceres CLONE 2027149
  misc_feature: SWISSPROT Homolog: EC 6.3.1.2 Glutamate--ammonia ligase
  misc_feature: Functional homolog of the protein sequence given in SEQ ID NO 50222
  misc_feature: Useful for making plants with modulated water use efficiency
MACLTDLVNLNLSDTTEKIIAEYIWYVRQRPPC

SEQ ID NO: 45813 - DNA, 731 bp, Panicum virgatum
  misc_feature: Ceres CLONE 2027150
  misc_feature: Encodes the peptide sequence at SEQ ID NO. 45814
ctcccctccgccgccgccgaatcagccacacccgccggccaagatgaagaccatcctggcttccgatacgatggacatccccgaggaggtcaccgtcaaggtggcggcgaaggtggtcacggtggaggggccgcgcggcaggctcacccgcaacttcaagcacctcaacctcgacttccagctgcaggacggcggccgcaagctcaaggtcgacgcctggttcggcacccgccgcaccatggccgccatccgcaccgccatctcccacgtccagaacctcatcaccggcgtcaccaagggataccgctacaagatgcgattcgtctacgctcacttccccatcaacgcctccatcaccaacgcaaacaccgccatcgagatcaggaactttctcggagagaagaaggtgaggaaggttgacatgcttgaaggtgtgaccattctgcgttctgagaaggtcaaggatgagctcattcttgatggcaatgatatcgagcttgtctctcgctctgctgccctcataaatcagaaatgccacgtaaagaataaggatatcacgaagttcttggatggtatctatgtgagtgacaagggtccaatcgcggaggagcagtgagctctttgctgctgctagggaaacctgtgttagacagagttgggttcatcgtttttgtgctgtgttttttggttagtcaattacaaacttcacaagtttatcagttttttatctg

SEQ ID NO: 45814 - protein, 190 aa, Panicum virgatum
  misc_feature: Ceres CLONE 2027150
  misc_feature (12)..(86): Pfam Name: Ribosomal_L6 Pfam Description: Ribosomal protein L6
  misc_feature (98)..(177): Pfam Name: Ribosomal_L6 Pfam Description: Ribosomal protein L6
MKTILASDTMDIPEEVTVKVAAKVVTVEGPRGRLTRNFKHLNLDFQLQDGGRKLKVDAWFGTRRTMAAIRTAISHVQNLITGVTKGYRYKMRFVYAHFPINASITNANTAIEIRNFLGEKKVRKVDMLEGVTILRSEKVKDELILDGNDIELVSRSAALINQKCHVKNKDITKFLDGIYVSDKGPIAEEQ

SEQ ID NO: 45815 - DNA, 239 bp, Panicum virgatum
  misc_feature: Ceres CLONE 2027159
  misc_feature: Encodes the peptide sequence at SEQ ID NO. 45816
cggcgctggaccgccggtcacagatcctccaccggctcacggcccgcgcgcgcgacgtcaacgtccaccggcggttctacaagacgaacgggcatggccggtgctacagcaacagcacggggccgccgtgaacggggtgggtggagatgatggcgacggagtgcgcgagcgggggatggcgctactcgagggtcctgttccataaccacctctgctacgcgtgggggatggacttctga

SEQ ID NO: 45816 - protein, 42 aa, Panicum virgatum
  misc_feature: Ceres CLONE 2027159
  misc_feature: Functional homolog of the protein sequence given in SEQ ID NO 50590
  misc_feature: Useful for biocontainment applications
ALDRRSQILHRLTARARDVNVHRRFYKTNGHGRCYSNSTGPP

SEQ ID NO: 45817 - DNA, 628 bp, Panicum virgatum
  misc_feature: Ceres CLONE 2027174
  misc_feature: Encodes the peptide sequence at SEQ ID NO. 45818
actttttgctggttccaaagaattgatggattatgacagaattgccactacattcttcactcctttggaatacagttgcatcggattttccgaaaagaaggctattgagaaattcggcaaggacaaaatctctgcttatcatactactttcaagcctttggaatgggcctttgatgaagaaaagcctggagatgcctgttatgtcaagatggtctgcagaaaagatgaaaatgaaaaagttattggcttgcattatgttggccctaatgctggtgaagttatgcaaggattttctttgggaataaatatgggagcgacaaagcaagatttctttagaacaattggtattcatcctacaagtgctgaagaagttttgaaccctgatattcctaccactgaagattgcgacgctcaagaaggttgcgaaggttgtggtctttaaaattaatcgtatttttatatgatgtaaaataatatttaaaagaaaaaaaagaccttaaaagcactaaattttctcgagaattttgatttttagaagggaaattatttacatgatttcataagacaacaaatgaaccaaataattgcaataatgatgatgataaaaagttacaagttcttgttgaaa

SEQ ID NO: 45818 - protein, 146 aa, Panicum virgatum
  misc_feature: Ceres CLONE 2027174
  misc_feature (14)..(128): Pfam Name: Pyr_redox_dim Pfam Description: Pyridine nucleotide-disulphide oxidoreductase, dimerisation domain
  misc_feature: SWISSPROT Homolog: EC 1.8.1.9 Thioredoxin-disulfide reductase
LFAGSKELMDYDRIATTFFTPLEYSCIGFSEKKAIEKFGKDKISAYHTTFKPLEWAFDEEKPGDACYVKMVCRKDENEKVIGLHYVGPNAGEVMQGFSLGINMGATKQDFFRTIGIHPTSAEEVLNPDIPTTEDCDAQEGCEGCGL

SEQ ID NO: 45819 - DNA, 473 bp, Panicum virgatum
  misc_feature: Ceres CLONE 2027184
  misc_feature: Encodes the peptide sequence at SEQ ID NO. 45820
accttacaatgtcatcaagaactggaactacacgggccttgtggatgccattcacaatggagagggcaagtgctggacctccaaggtgaagtgcgaggaggagctgacaagcgcgatcgagacggcgctgggggagaagaaggattgcctgtgcttcatcgaggtgatcgcgcacaaggatgacaccagcaaagagctgttggagtggggctccagggtctctgctgccaactccaggccaccgaatcctcagtagagcactcttgcaagttccaagcctcgggctctcggtagtggtggtagaacgatggggctcaatcgaataacgtgatcgctttgccctttctgttatgttctcgtttagtgcctggttctcattgttcttgatggtcctgtatctatttgtgacaattcccccgtttcttgcacgtgaatgccgcagagaattatgagaaatttcaggtttcggtacc

SEQ ID NO: 45820 - protein, 84 aa, Panicum virgatum
  misc_feature: Ceres CLONE 2027184
  misc_feature: SWISSPROT Homolog: EC 4.1.1.1 Pyruvate decarboxylase
PYNVIKNWNYTGLVDAIHNGEGKCWTSKVKCEEELTSAIETALGEKKDCLCFIEVIAHKDDTSKELLEWGSRVSAANSRPPNPQ

SEQ ID NO: 45821 - DNA, 680 bp, Panicum virgatum
  misc_feature: Ceres CLONE 2027187
  misc_feature: Encodes the peptide sequence at SEQ ID NO. 45822
ggtgattggaaggaagaacaaaccaaccacaaccagcgaggcggcaagccgacaggcaagcagacgagcaaccgcaccgggagggcggagcgggcgagcgagatgggttccttcttctcgaccatgttcacgccgccgcccgcggacgaccccaactccgccgtcgtcgccgcccactccaaggccgcctacgaccagcactgggaggccgccaagagcagcggcaagctgatggtgatcgacttctcggcgtcctggtgcgggccctgccgcttcatcgagccggccttcaaggagatggcctcccgctacaccgacgtcgtcttcgtcaagatcgacgtcgacgagctcgcggatgtggcaaggacctggaaggttgaggcgatgcctacattcgtactagccaagggtgggaaggaggtgagccgtgtggttggggcgaagaaagatgaactggagaggaagatcggcacgttcagatcatcttagtcatactaacttaacaatgcatgcgatcccatcatagtaccggtgtctggggggtcctgtggtttgcccaggttgaaatgccatgtcgttctcttctcttagtggtgcagaatttatgtgaaccggtcggtgacaaacgttgcctgggttaataagtttctgagacttggatgtgaatgtgtcagtctgcc

SEQ ID NO: 45822 - protein, 128 aa, Panicum virgatum; identical to SEQ ID NO: 12108
  misc_feature: Ceres CLONE 2027187
  misc_feature (21)..(122): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature: Functional homolog of the protein sequence given in SEQ ID NO 50138
  misc_feature: Useful for making plants with modulated nitrogen use efficiency

SEQ ID NO: 45823 - DNA, 663 bp, Panicum virgatum
  misc_feature: Ceres CLONE 2027198
  misc_feature: Encodes the peptide sequence at SEQ ID NO. 45824
gatgttgagggcagaccatggcatgtaacatgtgttagcatgggcaaccctcactgtgtcacatttggtgcaaaggacttagaggttgataatctaaaacttagtgaaattgggcctaaatttgagcatcatgaaatgtttcctgctcgaaccaacacagaatatgtacaggttttgtctcactcacacctcaaaatgcgagtttgggagcgcggtgctggagcaactctcgcttgtggtactggtgcttgtgcagttgttgttgctgctgttcttgagggccgagctgagcggaaatgcgtagttgatttgcctggcggaccattgaaaatagagtggagggaggatgacaatcatgtttacatgactggtccagcagaggctgtcttttatggatctgttgctcactaggtactggggaccaagacagaagggttagctacccactgagagcttgtgagattggttaaacagaatgttctggtaccagtacacctgtttcagatattcttaattatggtttcttaatttgggcagcattaaaggctttattgtcaagtattctagtgctgttcaccttttgtactcttactctgtcaggtttgaacactacattggtagcatacctgccgaaccattttctgtttcttttctttggcaata

SEQ ID NO: 45824 - protein, 136 aa, Panicum virgatum
  misc_feature: Ceres CLONE 2027198
  misc_feature (10)..(129): Pfam Name: DAP_epimerase Pfam Description: Diaminopimelate epimerase
  misc_feature: SWISSPROT Homolog: EC 5.1.1.7 Diaminopimelate epimerase
DVEGRPWHVTCVSMGNPHCVTFGAKDLEVDNLKLSEIGPKFEHHEMFPARTNTEYVQVLSHSHLKMRVWERGAGATLACGTGACAVVVAAVLEGRAERKCVVDLPGGPLKIEWREDDNHVYMTGPAEAVFYGSVAH

SEQ ID NO: 45825 - DNA, 585 bp, Panicum virgatum
  misc_feature: Ceres CLONE 2027208
  misc_feature: Encodes the peptide sequence at SEQ ID NO. 45826
agagcatctggggcgacgactgccgggagtacaggccggagcgctggctccgggacggccgcttcgccggcgagtccgcctacaagttcaccgccttcaacggcgggccgcgcctctgcctcggcaaggacttcgcctactaccagatgaagttcgccgccgcgtccatcctccgccgctaccgcgtccgcgtcgtcgagggccaccccgtcgcgcccaagatggcgctcaccatgtacatgaagcacgggctcaaggtgacgctggccaagagggacaaggccagcagcgggctctgagcttgacaccgttaattcggagctttgctttgcagatgctgatgtggtctgcaagttgcgcaactttgtgagaggaagtggatgatggttgtgtgtgaaaagatgccctctgttttcattctgtttcgtctcttttgtagtgctacttttattattaagtaatggatcttaccgtttacatgtagtgtagacaagtaccgggagtacagaacttttgtatatgtatatgtgtgatgatggcaaaacgctgaagctccagatgatgtaacaggtttattttagcagt

SEQ ID NO: 45826 - protein, 98 aa, Panicum virgatum
  misc_feature: Ceres CLONE 2027208
  misc_feature: SWISSPROT Homolog: EC 1.3.3.9 Secologanin synthase
  misc_feature: Functional homolog of the protein sequence given in SEQ ID NO 51336
  misc_feature: Useful for making plants with modulated heat sensitivity
SIWGDDCREYRPERWLRDGRFAGESAYKFTAFNGGPRLCLGKDFAYYQMKFAAASILRRYRVRVVEGHPVAPKMALTMYMKHGLKVTLAKRDKASSGL

SEQ ID NO: 45827 - DNA, 574 bp, Panicum virgatum
  misc_feature: Ceres CLONE 2027215
  misc_feature: Encodes the peptide sequence at SEQ ID NO. 45828
aatgccgctcgcgtgccctctctctctctcgccgccgccgccgccgcatctgctgcagcatgaccccaccccgccgtcgtcggagacgaacccccagccgccgccatggggcgtatgcacagccgctggaagggtatctcgtcgtcggcgctgccgtacaagaggactcccccgacctggctcaagactgctgcctccgatgtggaggagatgatcaccacggacgcaaacaagggccagatgccgtgacagattggcgtcctcctccgtgaccagcacgggatcccgctagtctagagcgtcactggtagcaagattctcctcgtcctcaaggtccatgggctcgcgccggagatcccggaggacctttacttcctgatcaagaaggcggtggcgattaggaagcatctggagacgaacaggaaggacaaggactccgaattcaggctgattcttgttgagagtaggatccaccgccttgcccgttactacaagcgcaccaagaagctcccggccacctggtaagtatgagtcgaccactgctcatcactctggtgggcttaatgatcatctt

SEQ ID NO: 45828 - protein, 47 aa, Panicum virgatum
  misc_feature: Ceres CLONE 2027215
  misc_feature (1)..(47): Pfam Name: Ribosomal_S13_N Pfam Description: Ribosomal S13/S15 N-terminal domain
  misc_feature: Functional homolog of the protein sequence given in SEQ ID NO 50384
  misc_feature: Useful for making plants with modulated nitrogen use efficiency
MGRMHSRWKGISSSALPYKRTPPTWLKTAASDVEEMITTDANKGQMP

SEQ ID NO: 45829 - DNA, 442 bp, Panicum virgatum
  misc_feature: Ceres CLONE 2027221
  misc_feature: Encodes the peptide sequence at SEQ ID NO. 45830
aacaaacgctaaaaaagtaacagtttctgtactttattggttggtttttcgccatgctcaagtacctcgctgcgttcgcgatcgcgtcgattgccggcaacccgtccaaggacaacgtggtcacgatcctgaaggcgactggcgcgaacttcgacaaggaggagttcgagtccgtctggccgcagctggagggcaagaacatgaactccctcgtcgctgagggtgccgcgaagatctccgcttccagcgcctcggccggtggtgcctctgccgcccccgcggccgctgctggcggtgccgcgccggctgccgctggcaagaaggaggagaagaaggctgagtccgagggcgacgacgacatgggcttcggtctgttcgactaaagtcgcacctgtgctcgctgccacgcaaccaaccccaccatccctctgatcacattccc

SEQ ID NO: 45830 - protein, 109 aa, Panicum virgatum
  misc_feature: Ceres CLONE 2027221
  misc_feature (16)..(108): Pfam Name: Ribosomal_60s Pfam Description: 60s Acidic ribosomal protein
MLKYLAAFAIASIAGNPSKDNVVTILKATGANFDKEEFESVWPQLEGKNMNSLVAEGAAKISASSASAGGASAAPAAAAGGAAPAAAGKKEEKKAESEGDDDMGFGLFD

SEQ ID NO: 45831 - DNA, 500 bp, Panicum virgatum
  misc_feature: Ceres CLONE 2027222
  misc_feature: Encodes the peptide sequence at SEQ ID NO. 45832
gtcagtaaaggagtttgttgaagcctgcaagaaggcgacaggagtcgatatcaaggttgactacttcccccgcagaccaggtgactacgccgaggtgtacagcgaccccgctaagatcaatcgggagctgaactggacggcgcagcacaccgacctccacaagagcctcagggtggcgtggacatggcagaaggcgcaccgaagtgggtacgagccaccccaggccatgattttgtgaagatgatggttgcctcgtagcaagcaaccgtctggccgaagcttaggtgaacataaaattattagagacttctccttgagggctcatagtcggtcactcacatatggtgaattatatatacatagtgctcatggtcatttgttcgattcttgagggttcatatttattgaaggccttagctgatcattgtaatagcattatacatattcattgtatgttatataatataataaataataaaattccaataagctcgtttttt

SEQ ID NO: 45832 - protein, 78 aa, Panicum virgatum
  misc_feature: Ceres CLONE 2027222
  misc_feature: SWISSPROT Homolog: EC 5.1.3.5 UDP-arabinose 4-epimerase
  misc_feature: Functional homolog of the protein sequence given in SEQ ID NO 50607
  misc_feature: Useful for making plants with altered carbohydrate content
  misc_feature: Functional homolog of the protein sequence given in SEQ ID NO 50959
  misc_feature: Useful for making plants with altered cell wall content and/or composition
SVKEFVEACKKATGVDIKVDYFPRRPGDYAEVYSDPAKINRELNWTAQHTDLHKSLRVAWTWQKAHRSGYEPPQAMIL

SEQ ID NO: 45833 - DNA, 613 bp, Panicum virgatum
  misc_feature: Ceres CLONE 2027251
  misc_feature: Encodes the peptide sequence at SEQ ID NO. 45834
atgatgatgaatgcttgctttgtttactcagagaacacacccacaacaaaagaagggtactattatagaatgatattcgagaaagtcttcccaaagcccgcggcaaggtcaactgtccctggaggtccaagtgtggcatgcagcaccgccaaagctgttgaatgggatgctgcctggtcgaagaaccttgatccatctggtcgtgctgctctaggtgtacatgatgctgcgtacgaagatactccaggggaagctcctgctgccatcgatccagttacacataacagccttcgtccagctattggcgaaggcctcgtgaaacctgttgcttaagccactgctttctaagcttctgttgtctcataagaaagctcgaacaataaggttgttctctagttattcagcttcttttcagatcatgttgcaagttccttcagtccggccatggagacattctcatgctccatgcctggcatgttcggtttctattgtacacactgcttgtttgttttatgcactgattagaccgctgtaaatatttgcccatgtgactgatgttgtttatctgatttgcagattgcagtggttaatgtagattcccaatttacacctc

SEQ ID NO: 45834 - protein, 109 aa, Panicum virgatum
  misc_feature: Ceres CLONE 2027251
  misc_feature: SWISSPROT Homolog: EC 6.3.5.4 Asparagine synthase (glutamine-hydrolyzing)
MMNACFVYSENTPTTKEGYYYRMIFEKVFPKPAARSTVPGGPSVACSTAKAVEWDAAWSKNLDPSGRAALGVHDAAYEDTPGEAPAAIDPVTHNSLRPAIGEGLVKPVA

SEQ ID NO: 45835 - DNA, 415 bp, Panicum virgatum
  misc_feature: Ceres CLONE 2027266
  misc_feature: Encodes the peptide sequence at SEQ ID NO. 45836
cgtgtccctccacctgggagttctcgcagctccagggctggtgggactgctgtgaggcctttacctgccctcaaggaaaacgtgaagcgtgtcatgttttactgctaagatggatgctgagctgctgctttgagcgagcagtatcctcctaccttgcctgcctggcgttttatttcgagtgctttctctcttatggtgatgctggggcacttttatgaacctccaaagttaattttctgagctgcgaatttgtggtacctatttataatattgtaaactggttttggaaatattgtactctgaagattggtttgtactggagttatttagacctggtttgtagtggaattatttgaacctgtttgtgtctgcaaatattgccggtctgatatagattggtcactgctggtttgac

SEQ ID NO: 45836 - protein, 35 aa, Panicum virgatum
  misc_feature: Ceres CLONE 2027266
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 2086 in the 10/374,780 US patent application
  misc_feature: The sequence is a functional homolog of SEQ ID NO 102 in the 10/286,264 US patent application
  misc_feature: The sequence is a functional homolog of SEQ ID NO 1579 in the 11/479,226 US patent application
  misc_feature: The sequence is a functional homolog of SEQ ID NO 2084 in the 10/374,780 US patent application
  misc_feature: The sequence is a functional homolog of SEQ ID NO 752 in the 10/412,699 US patent application
RVPPPGSSRSSRAGGTAVRPLPALKENVKRVMFYC

SEQ ID NO: 45837 - DNA, 729 bp, Panicum virgatum
  misc_feature: Ceres CLONE 2027281
  misc_feature: Encodes the peptide sequence at SEQ ID NO. 45838
attgcactacaacacctatgcgttcttcatcgatttggcacagccatcatctagctaggagctcacaattaagttcagctgttgtgtgttcagaccccgggcagctatatggcggcgatcaccggtggaagggcggcgctcgcagtggccgcgctcctctgcgccatggcggcagtggccgctgcgcagcaggcctccaacgtgcgcgcgacgtaccacctgtacaacccggcgcagaacggctgggacctcaaccgcgtcagcgcctactgcgccacgtgggacgccaacaagccgctgtcgtggcggcaaaagtacggctggaccgccttctgcgggccctcgggccctaggggccaggcctcctgcggcaagtgcatcaaggtgacgaaccgtgcgacgggcgcatcgaccgtggcgaggatcgtggaccagtgcagcaatggcggcctggacctggacttcgagacggtgttcaagaagattgacaccaatgggcaaggctaccagatgggccacctcaacgtcgactaccagttcgtctcctgctgagtgagctttgcgcacgcacgatcgaccggggaggaacctggaggatgtaataataattaagcgcctcgcctagatgtttggtgtgatggaataaaagggaacagagacacgaatgatggtagctagtaatacagaataaacaaaacagaattggactaaataaagcgagatttcgat

SEQ ID NO: 45838 - protein, 147 aa, Panicum virgatum
  misc_feature: Ceres CLONE 2027281
  misc_feature (28)..(147): Pfam Name: Barwin Pfam Description: Barwin family
MAAITGGRAALAVAALLCAMAAVAAAQQASNVRATYHLYNPAQNGWDLNRVSAYCATWDANKPLSWRQKYGWTAFCGPSGPRGQASCGKCIKVTNRATGASTVARIVDQCSNGGLDLDFETVFKKIDTNGQGYQMGHLNVDYQFVSC

SEQ ID NO: 45839 - DNA, 681 bp, Panicum virgatum
  misc_feature: Ceres CLONE 2027293
  misc_feature: Encodes the peptide sequence at SEQ ID NO. 45840
actatgtcttcgattaatgagagacccatcatcctcgctctatcaaacccaacgtcacagtctgaatgtactgctgaagaggcatatacatggagtcagggccgtgcgatctttgggagtggaagcccgtttgacccggtgaagtataatgacaagctgtttgtgcctgcccaggcaaacaatgcatacattttcccggggtttggtctaggtgtggtgatctcaggagcggtccgggtgacagacgatatggtccttgctgctgctgaaggactagctgaccaggtaaccccggagcatatcgacaaaggcctcatctacccaccattttccatcatcaggaagatatcagccaacatctctgcccgcgttgccgcaaaagcctacgacctcgggttggctagccagctccctcgcccaaaggacctggtgaagtatgctgagagttgcatgtacacccctgtttaccgatcttacagatgaaggacgataatgctgagttgctgacactggacgaactctgtacgactccacttgaggaaatgcatatgcctattaccgtggcagctattgttgagccactgtgcttccctgtgatcatcgagtaaaatgtctggtaaagttcggtagtaaagagcccattcagcttgttcatatgttcatgtagtcgtgtaataaagt

SEQ ID NO: 45840 - protein, 160 aa, Panicum virgatum
  misc_feature: Ceres CLONE 2027293
  misc_feature (1)..(129): Pfam Name: Malic_M Pfam Description: Malic enzyme, NAD binding domain
  misc_feature: SWISSPROT Homolog: EC 1.1.1.40 Malate dehydrogenase (oxaloacetate-decarboxylating) (NADP(+))
TMSSINERPIILALSNPTSQSECTAEEAYTWSQGRAIFGSGSPFDPVKYNDKLFVPAQANNAYIFPGFGLGVVISGAVRVTDDMVLAAAEGLADQVTPEHIDKGLIYPPFSIIRKISANISARVAAKAYDLGLASQLPRPKDLVKYAESCMYTPVYRSYR

SEQ ID NO: 45841 - DNA, 715 bp, Panicum virgatum
  misc_feature: Ceres CLONE 2027320
  misc_feature: Encodes the peptide sequence at SEQ ID NO. 45842
tcccttctcttcccgatcattccattccggctttccccaacccttcgaccacccgaggaagaaaagaagttgaagcatggggaagagaaagtcagctgctaagccacctcctaagaagcggatggacaagcttgacactgtcttttcctgcccattctgcaatcatgggagcagtgttgagtgccgtattgacatgaagaatttgattggcgaggcttcttgcagaatctgtcaggaaaacttcagcaccactgttaatggtatgtcgaaactgtatataactgcactactttctcctaatttagctgttatgtttactactttggatgtaaaaacttcaaactagaaaatgcaggtgtagttcatcccttctgctcatgcatatccccttgcttcttctttgcctcggacttgatcatggtgatctctgattatgcaagctgtaaaatgtccgaactgcattcatcaaaagtaaacctgcatggaaaaccatgcgtagatagtgtgtggttggtagaagttaaatcattgttaagtagcatttcttcatgtttgtgctaattgtctgatctcttttcttgcagcactcactgagcctattgacatatatagtgaatggattgatgagtgtgagcgtgtcaacactgttgaaggtgatgatgatgcatgagctccccccatgctgatggaaacggtactgggaactgtatgggac

SEQ ID NO: 45842 - protein, 89 aa, Panicum virgatum
  misc_feature: Ceres CLONE 2027320
  misc_feature (8)..(68): Pfam Name: Elf1 Pfam Description: Transcription elongation factor Elf1 like
MGKRKSAAKPPPKKRMDKLDTVFSCPFCNHGSSVECRIDMKNLIGEASCRICQENFSTTVNGMSKLYITALLSPNLAVMFTTLDVKTSN

SEQ ID NO: 45843 - DNA, 692 bp, Panicum virgatum
  misc_feature: Ceres CLONE 2027322
  misc_feature: Encodes the peptide sequence at SEQ ID NO. 45844
acgcagagcaagcgaccgagcttgtacgtgcacaagcagctcgcccggtcgcgatggcagctagagcggtgctcctggctgtgggcctggtcctggccgccgtggcgaacgcgaccaactgcccgcccccgcccgccccgacgccgccgacgccgacgcccagcggcggccaccactgccccagggacgcgctgaagctgggcgtgtgcgccaacgtgctgggcctcgtcaaggccaaaatcggctcgccgccgtacctgccctgctgctcgctgctggacgggctcgtcgacctggaggccgccatctgcctctgcaccgccatcaaggccaacatcctcggcatcaacctcaacctccccatcgacctcagcctcatcctcaacaactgcggcaagagctgccccaacgacttccactgcgcatagatcgtccactgatcgatcgtcctcgctcctccatcgccggcggccgcggtcgtccattctgtcattgcgtggcgagatgatgatgctttgcttgctctgtggctgatcatcttgctgtcagttcgagcttgtttgtttttattcgttttgtgatacaaattgatgagtggttgcacgttacatgtgttttgcctgggtgagggtgatcagttaattactgatcatgttattcctgatctgtttctatggtttgtcccgtaaatg

SEQ ID NO: 45844 - protein, 124 aa, Panicum virgatum
  misc_feature: Ceres CLONE 2027322
  misc_feature (42)..(123): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50545
  misc_feature: Useful for making plants with modulated oxidative stress sensitivity
  misc_feature: Functional homolog of the protein sequence given in SEQ ID NO 50191
  misc_feature: Useful for making plants with modulated salt sensitivity
MAARAVLLAVGLVLAAVANATNCPPPPAPTPPTPTPSGGHHCPRDALKLGVCANVLGLVKAKIGSPPYLPCCSLLDGLVDLEAAICLCTAIKANILGINLNLPIDLSLILNNCGKSCPNDFHCA

SEQ ID NO: 45845 - DNA, 483 bp, Panicum virgatum
  misc_feature: Ceres CLONE 2027324
  misc_feature: Encodes the peptide sequence at SEQ ID NO. 45846
aactaacgctaaaaaagtaacagtttctgtactttattgctcgctccactcaagttcaagatggccaagggtaagaagtccggtgagtcgaaggcccccgtctcgggcaagcgcgccaagaaggtgctccgcgacaacgtgcgcgggatcacgaagggttccgtgcgccgcctcgcgcgccgcgcgggcatcaagcgcgtctcgggcctcctccatgacgaggtccgcggtgtgctcaagtccttcgtcgagaaggtcgtggccgactcggtcgctttcacggagtattcgcgcaagcgcacggtcacgaccggcgccgtcgtcgcggccctgaagaagcgcggccgcatgctctacggctacgcctaagccaatgctctctcgcgagcgccactgttttcgcgcttccggcttcgcactagatccgcggcagacgctatcggcactgcagcgcgacgcgaagtacggggcgcacttgtttcc

SEQ ID NO: 45846 - protein, 102 aa, Panicum virgatum
  misc_feature: Ceres CLONE 2027324
  misc_feature (25)..(94): Pfam Name: Histone Pfam Description: Core histone H2A/H2B/H3/H4
MAKGKKSGESKAPVSGKRAKKVLRDNVRGITKGSVRRLARRAGIKRVSGLLHDEVRGVLKSFVEKVVADSVAFTEYSRKRTVTTGAVVAALKKRGRMLYGYA

SEQ ID NO: 45847 - DNA, 586 bp, Panicum virgatum
  misc_feature: Ceres CLONE 2027335
  misc_feature: Encodes the peptide sequence at SEQ ID NO. 45848
ggccgttgtcgtcccgggcgccgccgccgtggtcgccgcggcggcggagcgggtggcgagggtgcagaggtaccgcgagaagcgcaagaaccgcaagttccagaagaccatccgctacacgtcccgcaaggcctacgccgaggcccgcccgaggatcaagggccgcttcgtcaagcgcgtcgccgctgcatcgtcggacaccgacgccgccgccgccgccgccacgaacgcctccgacacggccaagttctggctctccttctccgacgactcccgcgacgacggcgtcgggttctacgtcgacgccacggcctacggagtcgtgccaaccttctagaatgtttcgcccagcttaaaacaagttaagaaatgggcgtgcgccatgtcgccatgctgtgggcgccatcgttcttgttcgtctcatgtcactcttgttgtcaattgttcgtggtgaaactccgccgccatcgctatttttaaatgatggcccgggatttccatgggtcaaactggtgaactagggattcatgtgttgaaagatagcctaagtagatgttcatttttagtttccatggatcgattttct

SEQ ID NO: 45848 - protein, 111 aa, Panicum virgatum
  misc_feature: Ceres CLONE 2027335
  misc_feature (17)..(61): Pfam Name: CCT Pfam Description: CCT motif
  misc_feature: Functional homolog of the protein sequence given in SEQ ID NO 51045
  misc_feature: Useful for making plants with modulated light quality sensitivity
  misc_feature: The sequence is a functional homolog of SEQ ID NO 1293 in the 11/479,226 US patent application
  misc_feature: The sequence is a functional homolog of SEQ ID NO 598 in the 10/412,699 US patent application
  misc_feature: The sequence is a functional homolog of SEQ ID NO 1522 in the 10/374,780 US patent application
  misc_feature: The sequence is a functional homolog of SEQ ID NO 1593 in the 10/412,699 US patent application
  misc_feature: The sequence is a functional homolog of SEQ ID NO 338 in the 10/666,642 US patent application
AVVVPGAAAVVAAAAERVARVQRYREKRKNRKFQKTIRYTSRKAYAEARPRIKGRFVKRVAAASSDTDAAAAAATNASDTAKFWLSFSDDSRDDGVGFYVDATAYGVVPTF

SEQ ID NO: 45849 - DNA, 508 bp, Panicum virgatum
  misc_feature: Ceres CLONE 2027342
  misc_feature: Encodes the peptide sequence at SEQ ID NO. 45850
gtcacagccacactcgcacggagccagccaccgctcgagcacccggacggccgcgcgtgggagcagaagccatgggcgaggaggccaagaaggaggaggcggagaagcccaaggaggcggcgccggcggaggacaagcccaaggagggcgccggggaggagaagccgggcgccggggaggacaagaaggaggaggcgccgccgccgccgccgccgccgccgccgccggaggaggtggagatgcgggtctacatgcactgcgaggggtgcgccaggaaggtcaagaagatcctcaggcgcttcgacggagtggaggacgtggttgctgactcaaaggcacacaaggtggtggtgaaggggaagaaggcagccgccgacccgatgaaagtggtggagcgtgtccagaagaagaccgggcgcaaggtggagcttctctcgccgatcccgcctccgccgaaggaggagaaggaggaggagaagaagaaggaggagcccgagccgccgaagcc

SEQ ID NO: 45850 - protein, 145 aa, Panicum virgatum
  misc_feature: Ceres CLONE 2027342
  misc_feature (56)..(120): Pfam Name: HMA Pfam Description: Heavy-metal-associated domain
MGEEAKKEEAEKPKEAAPAEDKPKEGAGEEKPGAGEDKKEEAPPPPPPPPPPEEVEMRVYMHCEGCARKVKKILRRFDGVEDVVADSKAHKVVVKGKKAAADPMKVVERVQKKTGRKVELLSPIPPPPKEEKEEEKKKEEPEPPK

SEQ ID NO: 45851 - DNA, 625 bp, Panicum virgatum
  misc_feature: Ceres CLONE 2027353
  misc_feature: Encodes the peptide sequence at SEQ ID NO. 45852
ggacatcaaggagaagctcgcctatgtggcactggactatgagcaggagcttgagactgccaagaccagctcctctgtggagaagagctatgagctgcctgatgggcaggtgatcaccatcggggcagagaggttcagatgccctgaggtcctcttccagccttctttcattggtatggagtcgcctggaatccatgagaccacctacaactctatcatgaagtgtgatgtggatattaggaaggacctctatggtaacatcgtgctcagtggtggctcaaccatgttccctggtattgccgaccgcatgagcaaggagatcactgcccttgcaccaagcagtatgaagattaaggtggtggcaccgcctgagaggaaatacagtgtctggatcggagggtctatccttgcctcgcttagcaccttccaacagatgtggatctcaaagggtgagtatgatgagtcaggcccagcaattgttcaccggaagtgcttctaagccctggattcattgcctttctactttactggggctgttcttttgtcgagtccttgccatgtaagctactgtgtttgagattgctggggttccattgagctatattgccagatttgttggttgggt

SEQ ID NO: 45852 - protein, 165 aa, Panicum virgatum
  misc_feature: Ceres CLONE 2027353
  misc_feature (1)..(165): Pfam Name: Actin Pfam Description: Actin
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
DIKEKLAYVALDYEQELETAKTSSSVEKSYELPDGQVITIGAERFRCPEVLFQPSFIGMESPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 45853 - DNA, 842 bp, Panicum virgatum
  misc_feature: Ceres CLONE 2027355
  misc_feature: Encodes the peptide sequence at SEQ ID NO. 45854
aaaaaacgcctcctagatctcgtctaatcggagcccaggatctaatcagcaggaccacactagcggcgatgatccagctgctgttccttgtgctggtggcggaggtgtccgtggttgcagcgctgctattcaagacgccactgcggaagcttgccgtgctaggcatcgaccgcctgaagcgcggccgccgcgcgcccgtcgccgtcaagacggtcgcgggcgtcgtcctcgctattctcgcctctacgctctacagcatagccgagatcagctgccgcgcgaccgaccccgactccggcggcgggctcacgcccacagatcaggtcctcttttcgcgtcacctcctcgaggcatcccttatggggtactccttatttcttgtgatagtgattgaccggcttcaccaatacatcagagatttgcgtgccttcaagaagaacttagaggctgtatcgaagcataataaaatgttggaggaagcaaaacatggaatttcagaggagacaaagaagtatcaggaagatattgccactctgaacaaggagatgaagaaactgaaactacaagtccaagaaaagacagaagaggtcaatgttgctgaggacaaggcacttgctatccaaaaacaatctgaaggcttgctgatcgaatatgatcgcctgctggaggacaaccagcatcttcggatacagctgcagtcaattgacctcaagctttccagttcttcttgaacgaagagtattaagtcataaaaatatgggttttttagtttcttggctaaaaatattgagcttactttgttgccccttttcaattgaactttgcaatctagccttaaatcg

SEQ ID NO: 45854 - protein, 220 aa, Panicum virgatum
  misc_feature: Ceres CLONE 2027355
  misc_feature (4)..(196): Pfam Name: Bap31 Pfam Description: B-cell receptor-associated protein 31-like
MIQLLFLVLVAEVSVVAALLFKTPLRKLAVLGIDRLKRGRRAPVAVKTVAGVVLAILASTLYSIAEISCRATDPDSGGGLTPTDQVLFSRHLLEASLMGYSLFLVIVIDRLHQYIRDLRAFKKNLEAVSKHNKMLEEAKHGISEETKKYQEDIATLNKEMKKLKLQVQEKTEEVNVAEDKALAIQKQSEGLLIEYDRLLEDNQHLRIQLQSIDLKLSSSS

SEQ ID NO: 45855 - DNA, 1449 bp, Panicum virgatum
  misc_feature: Ceres CLONE 2027377
  misc_feature: Encodes the peptide sequence at SEQ ID NO. 45856
cgagtgcgttgattcctgcgccctccagaggacaggaggagagaagaggaccagcgagcgtggagactggagagggaggaaaattccagtccaactctagagccaattcccttcgccttttcttcttcttcttcttcttcttccccgcagcgccggccctcgcccggccagtcttgccgccagtgcgccacgactcgcagcctcgcagctccccgggcctcctgccttcttgcgtatcctgggttgagccacgctggtagtgaaagaaaccatgtttaggagaaagcacacctctcgtttcgattctactgatgcagatcagcgaaaagcaaagatcaatgaactgaaatctgcactagagcctttgtctgcccgcggtgagaagtactgcagtgtagcatgcttggcaagatatctagaagcccgcaactggaatgttgccaaggcaagaaaaatgttggaagaaagtctcaagtggagggcggcttacaggccggaagatattcgctggcctgaagtttctgttgaagcagaaacaggtaaaatgtacagggcaagttttcaagatagagaggggcgaactgttcttgttatggcaccggcaaagcagaacacatcgtcacacgaagggcagatacggttccttgtatatactttggagaatgctgtcctgaacctgcctgaaggtcaagagaaaatggtctggctgatagacttcacaggatggacaatggcaaatgctgtgcccataaagactgcccgagaaactacaaatatcctgcaaaatcattaccctgagaggctggccgttgcgtttctatttaatcccccgaaagtatttgaagcgttttggaaggttgtcaagtatttcctcgacccaacatcgatcgagaaggtgaagttcgtgtacctgaaggatgaggagagcatgaaggtcatgcacaagtacattgacccgaaagtcattcctgttgagtttgggggcgagagcgatgtggtttacaaccatgagcagtactctgagttgatgacaaaagatgacatcaaaactgctaacatatgggcagaagatgcaaaaactgaccatgttaaccatgccatcggtggggccttggttcctgaggtcacccctgtgccgtctttaattacaacttaagccagttatggagtgtcaacccctcctatgacgagttgctatttcgtataactttcaatcaaggaaggaaatagacaggtagtggaatgttgagttgtggacattcaaacagaaattaatgaataacataaaaaataatgtattacttggccatactcaaacctgttcatgtaatcaaacggtgtatccagagtccaggcgattgtacttcaagagaatttcatcataggtgattgggtgtcagaccccaaccccaaaggaatgaagggtacaatatttcggcaaatttgatc

SEQ ID NO: 45856 - protein, 294 aa, Panicum virgatum
  misc_feature: Ceres CLONE 2027377
  misc_feature (91)..(264): Pfam Name: CRAL_TRIO Pfam Description: CRAL/TRIO domain
MFRRKHTSRFDSTDADQRKAKINELKSALEPLSARGEKYCSVACLARYLEARNWNVAKARKMLEESLKWRAAYRPEDIRWPEVSVEAETGKMYRASFQDREGRTVLVMAPAKQNTSSHEGQIRFLVYTLENAVLNLPEGQEKMVWLIDFTGWTMANAVPIKTARETTNILQNHYPERLAVAFLFNPPKVFEAFWKVVKYFLDPTSIEKVKFVYLKDEESMKVMHKYIDPKVIPVEFGGESDVVYNHEQYSELMTKDDIKTANIWAEDAKTDHVNHAIGGALVPEVTPVPSLITT

SEQ ID NO: 45857 - DNA, 809 bp, Panicum virgatum
  misc_feature: Ceres CLONE 2027379
  misc_feature: Encodes the peptide sequence at SEQ ID NO. 45858
ctttttaatcgatatacaatatggccgctgttgcagctcagatctccaagaagagaaagtttgtcgccgatggtgtcttctacgccgaattgaacgagttcttcactcgtgaacttgctgaagatggttatgctggtgttgaggtccgtgttactcctgcccgtaccgaaatcatcatccgtgccactcacacccaaaacgttcttggtgagaagggccgtcgtattcgtgaattgaccactcttgtccaaaagcgtttcaagttccccgagaacgctgttgagctttatgctgaacgtgtccaaaaccgtggtctctgtgccattgctcaatgtgagtctgtcaagttcaagctccttaacggtttggctgttcgtcgtgcctgttatggtgttgtccgtttcgtcatggaatctggcgccaagggttgtgaagttgtcgtctctggtaaggttcgtgccgctcgtgccaaggccatgaagtttgctgatggtttcatgattcactctggtaaccctgctcgtgaattcattaccactgctgtccgtcacgttgacttgcgtcaaggtgttttgggtatcaaggttaagatcatgttggataacgatcctactggtcgtaacggtcccaagcaatgtcttcccgatattgtcaccatcctcgagcccaaggatgaagccgctatcactgaaccttctgctcaagatttcagacctgctcccgctgctcctgccgctgagcctgttgaagcttaaataaattaaaagatttttttatatatttcaatataaaatgtcttattatcaatt

SEQ ID NO: 45858 - protein, 244 aa, Panicum virgatum
  misc_feature: Ceres CLONE 2027379
  misc_feature (107)..(191): Pfam Name: Ribosomal_S3_C Pfam Description: Ribosomal protein S3, C-terminal domain
  misc_feature (48)..(105): Pfam Name: KH_2 Pfam Description: KH domain
  misc_feature: Functional homolog of the protein sequence given in SEQ ID NO 51097
  misc_feature: Useful for making plants with modulated biomass
  misc_feature: Functional homolog of the protein sequence given in SEQ ID NO 51096
  misc_feature: Useful for making plants with modulated water use efficiency
MAAVAAQISKKRKFVADGVFYAELNEFFTRELAEDGYAGVEVRVTPARTEIIIRATHTQNVLGEKGRRIRELTTLVQKRFKFPENAVELYAERVQNRGLCAIAQCESVKFKLLNGLAVRRACYGVVRFVMESGAKGCEVVVSGKVRAARAKAMKFADGFMIHSGNPAREFITTAVRHVDLRQGVLGIKVKIMLDNDPTGRNGPKQCLPDIVTILEPKDEAAITEPSAQDFRPAPAAPAAEPVEA

SEQ ID NO: 45859 - DNA, 717 bp, Panicum virgatum
  misc_feature: Ceres CLONE 2027391
  misc_feature: Encodes the peptide sequence at SEQ ID NO. 45860
gaagatcgaaatcgcaccgaacaacgcgcacataatctcatctccttttccgatcgcacgcgaacgtttcagattcccattcacagcaacctccgccgacaatgtcgctggtgaggcgcagcagcgtgttcgaccccttctccctcgacctctgggaccccttcgacagcatgctccgttccgtcgtcccgccggccggcgcctccgactccgacaccgccgccttcgccgccgcccgcatcgactggaaggagacgcccgaggcgcacgtgttcaaagccgacctccccggcgtcaagaaggagaaggtcaaggtggaggtggaggacggcaacgtgctggtcatcagcggccagcgcagcaaggagaaagaggacaagaacgacaagtggcaccgcgtggagcgcagcagcggccagttcatgaggcggttccgcctcccggagaacaccaaggtcgaccaggtgaaggctgggttggagaacggcgtgctcaccgtcaccgtgcccaaggcggaggagaagaagcctgaggtcaaggctatcgagatctctggttaagcggccatggacgccggttgaagatggtgcgaatgtgatgctacgaatcgtgcttgcagcttgcttgatctcggtgtgtgtgtgtgttcatgagcgtgtggtgtggacgatgtgtacttcccttgccgctgtacttcctttcgctctgttcttccgt

SEQ ID NO: 45860 - protein, 152 aa, Panicum virgatum
  misc_feature: Ceres CLONE 2027391
  misc_feature (48)..(151): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSSVFDPFSLDLWDPFDSMLRSVVPPAGASDSDTAAFAAARIDWKETPEAHVFKADLPGVKKEKVKVEVEDGNVLVISGQRSKEKEDKNDKWHRVERSSGQFMRRFRLPENTKVDQVKAGLENGVLTVTVPKAEEKKPEVKAIEISG

SEQ ID NO: 45861 - DNA, 616 bp, Panicum virgatum
  misc_feature: Ceres CLONE 2027406
  misc_feature: Encodes the peptide sequence at SEQ ID NO. 45862
atttctcgaggaaatggccgatccaaactgggaacgctctgattttcctattgtctgtgaaacatgccttggtgataatccatacgttagaatgactcgtgcagaattcgataaagaatgcaaagtttgtacccgtcctttcactgtattccgatggagagcaggaaccaaaggccgctacaaaaaaacagaagtttgtcaaacctgtgcaaaactgaaaaatgtctgccaaacctgcttattagatctaaccttcaatttgccagttcaggtccgggatgctgcaatgcccgttggtccaactggacttatgagtgaaactcctcaatctgatgcaaatagacattttatgaataagattgcagatcaacaagcttctcttggaattatgccaatccatcgtgcacaattcaatccaataatcaacaaaatggcaagaacaactccttattatgatagaaacaaagcccacatttgctccttcttcctcaaaggcaactgcaacagaggagaagcctgtccattcagacatgaaaaaccagatgaagagaaaggtgatttggctcatcaaaatattaaggatcgttattatggtgttaatgatcctgttgcaaaa

SEQ ID NO: 45862 - protein, 200 aa, Panicum virgatum
  misc_feature: Ceres CLONE 2027406
  misc_feature (150)..(175): Pfam Name: zf-CCCH Pfam Description: Zinc finger C-x8-C-x5-C-x3-H type (and similar)
MADPNWERSDFPIVCETCLGDNPYVRMTRAEFDKECKVCTRPFTVFRWRAGTKGRYKKTEVCQTCAKLKNVCQTCLLDLTFNLPVQVRDAAMPVGPTGLMSETPQSDANRHFMNKIADQQASLGIMPIHRAQFNPIINKMARTTPYYDRNKAHICSFFLKGNCNRGEACPFRHEKPDEEKGDLAHQNIKDRYYGVNDPVA

SEQ ID NO: 45863 - DNA, 586 bp, Panicum virgatum
  misc_feature: Ceres CLONE 2027408
  misc_feature: Encodes the peptide sequence at SEQ ID NO. 45864
aaaaacacatacacatcaaagatagaaattaaattaatggcgactctaggtggtagcactgaggtggaatatacacaaaacagtgttgagatagataaccttgctatctttgctgttcaagaacacaatatcaaacagaatgcagttctagagtttgtgagggtgttaaatgcaaagaagcaagtggtttctggcaccttgtacgacatcactttagagacaatggatggtgggaagcaaaaggtgtatgaagccaagattttagagaagctatggttgaacttcaaggaggtgcaggaattcaatctcattagccaaaattacgatgctccttctgtatctagcacttagttaggtatttaaatttcaaggagttatatgatatcaaatagtatatatggaataatggtgcatacagttgacatcttgtgtgtctcttgtgcttcaattaagccttattgatggtctagtttattaccttttctggtatagatattgtgatctattcaggttggagattttccaagtcaattgatcaatgtttgtaaataatttgtgaaaaataatcaagattgtatttgaattt

SEQ ID NO: 45864 - protein, 104 aa, Panicum virgatum
  misc_feature: Ceres CLONE 2027408
  misc_feature (5)..(93): Pfam Name: Cystatin Pfam Description: Cystatin domain
MATLGGSTEVEYTQNSVEIDNLAIFAVQEHNIKQNAVLEFVRVLNAKKQVVSGTLYDITLETMDGGKQKVYEAKILEKLWLNFKEVQEFNLISQNYDAPSVSST

SEQ ID NO: 45865 - DNA, 586 bp, Panicum virgatum
  misc_feature: Ceres CLONE 2027411
  misc_feature: Encodes the peptide sequence at SEQ ID NO. 45866
ttttctgccgcacctttgttggcccgcgggctcgagcttgacgacggcttgtggcttggctggctggcccaccggccgcaccccacccggcagcctcggcccgcagtctagcagggatcgcacacgcaagcgcaagcagctggattcgggggctcggctcggtccgtgaggaagctttccggcgagatggcggaggagaagagcgcgctgcagtcggcgagggagtgggtcgtcgaccacaagctccgggccgtcgggacgctgtggctgagcggcatcgtgggctccatcgcctacaactggtccaggccgggcatgaagaccagcgtcaagatcatccatgccaggttgcatgcccaggctctgacactggctgccttggctgggtctgcactggtggagtactatgatcatcagcaaggatcgggatcaaaggttcaccaatatgcaaagcagatcctatcatctgacggcagctcacaaaaagagtaggcagtgtgggtgagttaggcgttggtgacaaattagcagcagtgagacatggaatggatcggatgttattttccgatcaaataatttgtctgtg

SEQ ID NO: 45866 - protein, 101 aa, Panicum virgatum; identical to SEQ ID NO: 18930
  misc_feature: Ceres CLONE 2027411
  misc_feature (4)..(71): Pfam Name: HIG_1_N Pfam Description: Hypoxia induced protein conserved region

SEQ ID NO: 45867 - DNA, 604 bp, Panicum virgatum
  misc_feature: Ceres CLONE 2027421
  misc_feature: Encodes the peptide sequence at SEQ ID NO. 45868
ggtgcaagatgtacccggacatggctgagcagggcaccaccaccaccacccagactgtcatcatgggcgttgcaccaaccaacaaggggcatgccgagggcgggttcgaggccggctgcaagtgcggctccggctgcggagggtgcaagatgtacccggacatggctgagcagggcaccgagaacggcggctgcaagtgcggcgacaactgcacctgcaacccctgcacctgcaagtgaggagctcatggccatggccggaccggaggagatctcggaaggataaaaaagctagtatagcagtgttgtgtatgtgcgtcgttcgtttgtctgaaagtgtgggtggcatgcttagtaacagtgttgcgcgtgctgctagtagatggtactgatgaggaacaataataatgatggtgctgagatgtcgtcggcgtcgccgccgtcgtgtccttcctccccggccggtcgagcacctgtggcggtgctctagcagtgtgtcggtgtgtgcagcaggccatgctctgatctgtggtgtaggtgtgtggcctgcttggtgtcccttgtgtcatgtgtaaccatccatctatatcattatctatctatct

SEQ ID NO: 45868 - protein, 78 aa, Panicum virgatum
  misc_feature: Ceres CLONE 2027421
  misc_feature (37)..(77): Pfam Name: Metallothio_2 Pfam Description: Metallothionein
CKMYPDMAEQGTTTTTQTVIMGVAPTNKGHAEGGFEAGCKCGSGCGGCKMYPDMAEQGTENGGCKCGDNCTCNPCTCK

SEQ ID NO: 45869 - DNA, 672 bp, Panicum virgatum
  misc_feature: Ceres CLONE 2027426
  misc_feature: Encodes the peptide sequence at SEQ ID NO. 45870
aaaaaccctagccccccgccgccgccagccctcgccctcttccaaaccctacccgcacccccgccgccgccgccatgccgccgaagctcgacccgtcgcaggtggtggaggtcttcgtccgcgtgacgggcggcgaggtcggcgcggcgtcgtcgctggcgcccaagatcggcccgctcgggctctccccgaagaagatcggtgaggacatcgccaaggagacggccaaggactggaagggcctccgcgtcaccgtcaagctcaccgtccagaaccgccaggccaaggtctcggtcgtgccctccgccgccgcgctcgtcatcaaggcgctcaaggagcccgagagggacaggaagaaggtcaagaacatcaagcacagcggcaacatcagcctcgacgacgtcatcgagatcgccaggaccatgagggctaggtccatggccaaggagatggccgggaccgtcaaggagatcctcggcacctgcgtcagcgtcgggtgcaccgtcgacggcaaggaccccaaggacctgcagcaggagattgacgacggcgaggtcgagatcccctcagcttaaagtatgcaggctaaggagattgtcattgatgctgctgaagtggtgctctgttctgcatgctgttgttgtaccttaccaaacaatgtgattccacctt

SEQ ID NO: 45870 - protein, 166 aa, Panicum virgatum; identical to SEQ ID NO: 28731
  misc_feature: Ceres CLONE 2027426
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain

SEQ ID NO: 45871 - DNA, 594 bp, Panicum virgatum
  misc_feature: Ceres CLONE 2027477
  misc_feature: Encodes the peptide sequence at SEQ ID NO. 45872
aggcgcagagagcagagcacccagccaggaggaggaagaggaaggcgaagcgagggtcggagcctccgaggatgccgtgcctgaacctggagggggtggacacctctgccatcctcggcgaagcctccacggccgtcgccaacatcatcggcaagccagaggcctacgtgatggttgttctcaagggttcagtgcctatggcatttggaggtacccaggagcctgcagcttatggtgagctggtttccattggagggctgaaccctgatgtcaacaagaagctgagtgctggcattgcttctattctggagtcaaagctgtccattcccaagtcccgcttctacctcaagttccacgactcaaagcgctcagactttggttggaatggctccaccttctagattcgaggtccatgggtgtggctccaccgctccagtgaaggaagatcgtgttccctaattacctaataaggacactgttgtaagatatcagttaatttgtgttgaactgaagtgaaaactgtcatgtggaactggagcacagacttgttcaatgcaacctagcatattcgtgctgtgctgtgttggcttgcac

SEQ ID NO: 45872 - protein, 109 aa, Panicum virgatum
  misc_feature: Ceres CLONE 2027477
  misc_feature (9)..(109): Pfam Name: MIF Pfam Description: Macrophage migration inhibitory factor (MIF)
  misc_feature: SWISSPROT Homolog: EC 5.3.2.1 Phenylpyruvate tautomerase
MPCLNLEGVDTSAILGEASTAVANIIGKPEAYVMVVLKGSVPMAFGGTQEPAAYGELVSIGGLNPDVNKKLSAGIASILESKLSIPKSRFYLKFHDSKRSDFGWNGSTF

SEQ ID NO: 45873 - DNA, 480 bp, Panicum virgatum
  misc_feature: Ceres CLONE 2027493
  misc_feature: Encodes the peptide sequence at SEQ ID NO. 45874
gcaccgacctctcttcctattagaagcagccaggcattctcgcgacgcgctcagagaaggttagggtttaccagttgcgaccgccgccgccaccatgggacactccaacgtgtggaactcgcacccgaagaactatggccctggatccagggtttgccgtgtgtgcgccaacccccacggcctgatccggaagtacgggctcatgtgctgcaggcagtgcttccgcagcaacgccaaggacatcggattcatcaagtaccgctaaaaacttgagaggtccgaagcatcacgagaatgggagcatggatgagcatcttctgcccgtcttttgcttagtactgtgataatcataacatgtaatgaattatttgggtttgaaatggaccaaatcgtattctggctggcactctagtgcaccctagttgagcatgttgaaccgctattatcagactaataaaatattgttactattgaggctgt

SEQ ID NO: 45874 - protein, 56 aa, Panicum virgatum; identical to SEQ ID NO: 9888
  misc_feature: Ceres CLONE 2027493
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency

SEQ ID NO: 45875 - DNA, 688 bp, Panicum virgatum
  misc_feature: Ceres CLONE 2027504
  misc_feature: Encodes the peptide sequence at SEQ ID NO. 45876
ctcttcctcgcctatcgtccctgtggagctctcctccttgacggtaattcatccatcatgctgatccccaagaagagccgcgttgccgtctactcctacgtcttcaagtatggcgtgatcgtcgccaagaaggagttcaccatgaagaagcacaaggacaccaatgtgcccaacctgtgggtgctcaagctcttgacttcgctcaagtccaagggactcgtcaaggagaagttcaactggcagtggtattactggtacctcaccaacgagggtatcgagtacctccgtgactacctcaacctcgacgccaacatcgtccccgccacgctcaagaagcccgccgccgctccccgcgcttaccctccccgcttcggcgctggcgagaggcccgctggtgcccgtggtggtgaccgcgagggtggctaccgtcgccccttcggcgaccaggagaagaagcttgccggtgctggcggcgatttcgctcctcgcttcgctcgtgagggtggtgaccgcgagggtggtcgcggcggtggtttcggcggccgtggtggcagggacagctacaggagggatggtgcccccagcgctggtggcttcggtgaccgtgccccccgtccttcgttcggccgtggtggtggtgcccccagggagtaaataacactacaacacaaataaacctactagctcc

SEQ ID NO: 45876 - protein, 198 aa, Panicum virgatum
  misc_feature: Ceres CLONE 2027504
  misc_feature (3)..(98): Pfam Name: S10_plectin Pfam Description: Plectin/S10 domain
MLIPKKSRVAVYSYVFKYGVIVAKKEFTMKKHKDTNVPNLWVLKLLTSLKSKGLVKEKFNWQWYYWYLTNEGIEYLRDYLNLDANIVPATLKKPAAAPRAYPPRFGAGERPAGARGGDREGGYRRPFGDQEKKLAGAGGDFAPRFAREGGDREGGRGGGFGGRGGRDSYRRDGAPSAGGFGDRAPRPSFGRGGGAPRE

SEQ ID NO: 45877 - DNA, 539 bp, Panicum virgatum
  misc_feature: Ceres CLONE 2027526
  misc_feature: Encodes the peptide sequence at SEQ ID NO. 45878
acatatcacactgattgctgaatgctgaagatgagttcctccacgtccagcgctctcgcgctagcagcagcagtgctcctagcagcactgaccgtagcacagcatggctccctcgccgcagccgccggccccagggtcatcatcgtcggcgccggcatgtccgggatctcggctgctaagacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggagtatatacctactccgttccgttcaaactatacttcactttgattttatttgttataaatcaacatttttaactccaacctaataagtaagtcaaaaaaaacatcaactaatcagttagttcttac

SEQ ID NO: 45878 - protein, 99 aa, Panicum virgatum; identical to SEQ ID NO: 25797
  misc_feature: Ceres CLONE 2027526
  misc_feature: SWISSPROT Homolog: EC 1.5.3.11 Polyamine oxidase

SEQ ID NO: 45879 - DNA, 618 bp, Panicum virgatum
  misc_feature: Ceres CLONE 2027550
  misc_feature: Encodes the peptide sequence at SEQ ID NO. 45880
aaaaccaagaacacaaacacagatgcaaatcttcgtcaagacattaactggaaagacaatcactctcgaagtagaaccagcggattcaattgataacgtcaaacaaaagattcaagataaagaaggaatcccaccagatcaacaaagactcatctttgctggaaaacaacttgaagatggaagaaccctttctgattacaatattcaaaaagaatcaactctccatttagtccttcgtctacgtggtggaatgcaaatttttgtaaaaacacttactggaaagacaattacccttgaagttgaaccagcggattcaattgataacgtcaaacaaaaaatccaagataaagaaggaatcccaccagatcaacaaagacttatctttgctggaaaacaattagaagatggtcgtactctttctgactacaacatccaaaaagaatcaactcttcatttagttctccgtctacgtggtggaatgcaaatttttgtaaagacattaactggaaagacaattacccttgaagtcgaacctgcagattcaattgataacgtcaaacaaaagattcaagataaagaaggaatcccaccagatcaacaaagacttatctttgctgg

SEQ ID NO: 45880 - protein, 198 aa, Panicum virgatum
  misc_feature: Ceres CLONE 2027550
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVEPADSIDNVKQKIQDKEGIPPDQQRLIFAGKQLEDGRTLSDYNIQKESTLHLVLRLRGGMQIFVKTLTGKTITLEVEPADSIDNVKQKIQDKEGIPPDQQRLIFAGKQLEDGRTLSDYNIQKESTLHLVLRLRGGMQIFVKTLTGKTITLEVEPADSIDNVKQKIQDKEGIPPDQQRLIFA

SEQ ID NO: 45881 - DNA, 443 bp, Panicum virgatum
  misc_feature: Ceres CLONE 2027551
  misc_feature: Encodes the peptide sequence at SEQ ID NO. 45882
ccccagcagcggcttcgccttcctggacccctcgccggtgaccttcgacaacgccttctaccggaacctgcaggccgggaaggggctcctcggctccgaccaggtgctctactccgacgtgaggtcccgcggcacggtgaactactacgccacgaaccagggcgccttcttcggcgacttcgtggcggccatgaccaagctcggcagggtcggcgtcaagacggcggccaccggcgagatacgccgagactgccggttccccaactagttgctaccggccagccgatcgacctcgccgctggctggttaatttgacgacgcacatcattgaacgtttgatacatgcatgtaccattagtatagtatataaagactgtaattaaataagctcatggctttgattcatggggcctgatgtgtataatacaaccctccttgtgatt

SEQ ID NO: 45882 - protein, 88 aa, Panicum virgatum
  misc_feature: Ceres CLONE 2027551
  misc_feature: SWISSPROT Homolog: EC 1.11.1.7 Peroxidase
  misc_feature: Functional homolog of the protein sequence given in SEQ ID NO 50951
  misc_feature: Useful for making plants with altered carbohydrate content
  misc_feature: Functional homolog of the protein sequence given in SEQ ID NO 50952
  misc_feature: Useful for making plants with altered cell wall content and/or composition
PSSGFAFLDPSPVTFDNAFYRNLQAGKGLLGSDQVLYSDVRSRGTVNYYATNQGAFFGDFVAAMTKLGRVGVKTAATGEIRRDCRFPN

SEQ ID NO: 45883 - DNA, 481 bp, Panicum virgatum
  misc_feature: Ceres CLONE 2027557
  misc_feature: Encodes the peptide sequence at SEQ ID NO. 45884
actcccgaaaccctagctttcctcacgctgcgccgccgacggtgactaggagcaggagccgccgagccggaagagggatctgcgatggccaagtcaaagaaccacacggcgcacaaccagtcgttcaaggcgcacaagaacggcatcaagaagcccaagcgccaccgccagacctccaccaaggggatggacccaaagttcctgaggaacctgaggtactcgaggaagaacaacaagaagagcggtgaggctgaggctgaggagtaaactggtggaatttcagatgatgaattcctgttttgtatcgctagggtctactgcagtcttgaatttaatgctctgttctgtatgatctaaggagattccttagttggtactaaagctttttttctttcttttttgtcttgctgcctggctggattttgaattaaaatcgttatttgcagcgttatgagaattggtaacctgagtccgtcgttcc

SEQ ID NO: 45884 - protein, 60 aa, Panicum virgatum; identical to SEQ ID NO: 12725
  misc_feature: Ceres CLONE 2027557
  misc_feature (3)..(42): Pfam Name: Ribosomal_L29e Pfam Description: Ribosomal L29e protein family

SEQ ID NO: 45885 - DNA, 637 bp, Panicum virgatum
  misc_feature: Ceres CLONE 2027565
  misc_feature: Encodes the peptide sequence at SEQ ID NO. 45886
actagttccccatccagtccttcagcaccccaattcccgcggcggcggcgatggcggcggctgctgcgaggtcccgtttccagcccatgttctccatctcggccttcgcgccgcctaagccgcccgccccgcaacaccacgccgacccctccccgaacctcttcgtctccggattaaacaagcctaccacaacacatggacttagaaatgcttttgcaaaattcggggaacttgtgcatgctcgagttgagacacaccgtgtcactgattattctagcgggtttggctttgtaaagtatgctacaactgaagaggcaaggaaaggaatacaaagaatggatggaaagttccttgatggatgggttatttgtgcagaatactctaaacccaaaccagcaccccagaaagcatacatgaactcacaaccgctacaatcatggggtcctccgtcaagttcctggggttcacagtatatgaagatctgccagccctctatccagccttggggctcacagtggatcaagaggccatcaattcagcatctaatttatagatattgtgtgtgctgtgcgatgtgtgaatgccctatacgatccgatattcttgccgtgttggagtggacgatggattgccgtgt

SEQ ID NO: 45886 - protein, 195 aa, Panicum virgatum
  misc_feature: Ceres CLONE 2027565
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAAARSRFQPMFSISAFAPPKPPAPQHHADPSPNLFVSGLNKPTTTHGLRNAFAKFGELVHARVETHRVTDYSSGFGFVKYATTEEARKGIQRMDGKFLDGWVICAEYSKPKPAPQKAYMNSQPLQSWGPPSSSWGSQYMKICQPSIQPWGSQWIKRPSIQHLIYRYCVCCAMCECPIRSDILAVLEWTMDCR

SEQ ID NO: 45887 - DNA, 490 bp, Panicum virgatum
  misc_feature: Ceres CLONE 2027569
  misc_feature: Encodes the peptide sequence at SEQ ID NO. 45888
caactgacgcggcggcagcagcaatggaggcctccatgatctcgacggcagctctggcggcaccagccaaggcccatggcctgccctccctctgccgccgcgcttcctccttcgtcgtcgtctgcggcacccgcaagaacatcaagaccgacgcgcccttcgagaatggaagtggcctcaccctccaccacgatgcctccgggaggaaggacaggggcaacgacgagtgccatttcgtccacgaataccgccccgacggcgacggatacagcccagtccacaaagagcaagactggtctcccacccgtgacctctacatcggtggaaccactggacttctgatctgcgccgccaccctcgccgggctcgttggcggcggcgccctccttgttcacaacaccagcgccctcgccagctaagaacactattcatgcctagtccatgcaagcgcttgtggttcatgtacgatcaccgcgcgtgtctgtccccg

SEQ ID NO: 45888 - protein, 131 aa, Panicum virgatum
  misc_feature: Ceres CLONE 2027569
  misc_feature (35)..(131): Pfam Name: PsbR Pfam Description: Photosystem II 10 kDa polypeptide PsbR
MEASMISTAALAAPAKAHGLPSLCRRASSFVVVCGTRKNIKTDAPFENGSGLTLHHDASGRKDRGNDECHFVHEYRPDGDGYSPVHKEQDWSPTRDLYIGGTTGLLICAATLAGLVGGGALLVHNTSALAS

SEQ ID NO: 45889 - DNA, 675 bp, Panicum virgatum
  misc_feature: Ceres CLONE 2027580
  misc_feature: Encodes the peptide sequence at SEQ ID NO. 45890
atcgagattcgcataatggctttcgtctccacggccgcatggatgcctcgcgtcgtcttcgtcgcctctctggtggcggccctcgccatggcctccggcccggcagcggcggcggcgcgcggcggccgccgggtcatccacctgcgcttctacatgcacgacatcacgggcggtcccggccagacggcggtgcaggtcgtcaagggcccggggccggcgcacccggtgatgccgggctcccacttcggcgacaccacggtgatggacgacgccctgacggagggtgccagcgcggcgtcgcggccggtcgggcgcgcgcaggggacgtacacgctggcgtcgctcagggagcccgcgctgtgggtgtccatgaccgtggtgctcacgggcggggcctacaacggcagcaccatcgccgtggttggccgggacgacatctcggcgagcgtcagggagctcgcggtggtcggcggcaccggcgcgttccggggggccacggggcacgtgctgtggcggacggccaggatggagtccagggaccacgtggtgctggagctcgacgtctacgccaccgtgccgggcgctagcccgccgccgcgcgcaggcgccgtgcgtcaggggggggctgaacctcgactgacatgggttttgattccggccatgaactctatgaac

SEQ ID NO: 45890 - protein, 219 aa, Panicum virgatum
  misc_feature: Ceres CLONE 2027580
  misc_feature (13)..(181): Pfam Name: Dirigent Pfam Description: Dirigent-like protein
MAFVSTAAWMPRVVFVASLVAALAMASGPAAAAARGGRRVIHLRFYMHDITGGPGQTAVQVVKGPGPAHPVMPGSHFGDTTVMDDALTEGASAASRPVGRAQGTYTLASLREPALWVSMTVVLTGGAYNGSTIAVVGRDDISASVRELAVVGGTGAFRGATGHVLWRTARMESRDHVVLELDVYATVPGASPPPRAGAVRQGGAEPRLTWVLIPAMNSM

SEQ ID NO: 45891 - DNA, 576 bp, Panicum virgatum
  misc_feature: Ceres CLONE 2027608
  misc_feature: Encodes the peptide sequence at SEQ ID NO. 45892
ctctttgtcttcatccataatttaatatgtccaacaagaaggttgcccccaaggtcgttgagaaggttactctcggtcctcaagttcgtgaaggtgagctcgtctttggtgttgctcatatctttgcttctttcaacgataccttcgttcacgtcactgatctttccggtcgtgaaactatctctcgtgtcactggtggtatgcaagttaaggctgatcgtgatgagtcttctccttatgctgctatgttggctgcccaacaagttgctgccaagtgtaaggaactcggtatcaacgctcttcacattaagctcagagctactggtggtaccggtaccaagactcccggccctggtggtcaagctgccctccgtgctcttgcccgtgctggtatgagaattggtcgtattgaggatgttacccccattcctactgattctacccgtagaaagggtggtcgtcgtggtcgtcgtctctaaacgggtcgcttcttacgcttaccactcttctacaaaaattctgttttttttgcatacaattataaattaataaatattctgtaattgctttacttgt

SEQ ID NO: 45892 - protein, 150 aa, Panicum virgatum
  misc_feature: Ceres CLONE 2027608
  misc_feature (28)..(146): Pfam Name: Ribosomal_S11 Pfam Description: Ribosomal protein S11
  misc_feature: Functional homolog of the protein sequence given in SEQ ID NO 50135
  misc_feature: Useful for making plants with modulated biomass
MSNKKVAPKVVEKVTLGPQVREGELVFGVAHIFASFNDTFVHVTDLSGRETISRVTGGMQVKADRDESSPYAAMLAAQQVAAKCKELGINALHIKLRATGGTGTKTPGPGGQAALRALARAGMRIGRIEDVTPIPTDSTRRKGGRRGRRL

SEQ ID NO: 45893 - DNA, 482 bp, Panicum virgatum
  misc_feature: Ceres CLONE 2027614
  misc_feature: Encodes the peptide sequence at SEQ ID NO. 45894
gacgcttcggagctcgctgccactgcctgccacccaccaatcgtccccctcttatctcctcggctccaccaccacctaccgcagaagcagagatcgatggcactgcaggccccgtcgctcatgcgcgcgccggcggcggcggagccgctccggtcgtcgttcgccgcgccgtgggcggtgcgcctgccggcgccggcgcggcgacgcgtcgcaagagcggccaccgccgcgcggatcaccatgcgggtcgccacccagcaggcctacatctgccgcgactgcgggtacatctacaacgacaggactccgttcgacaagctgcctgacaagtacttctgcgctgtttgtggagctccgaagagaaggttcagaccatatgaaccggcggcatccaagaatgcaaacgccactgatgtccggaaggcgaggaaagagcagctgaagaaggatgaagccatcaggcaagccttaccgatcgccat

SEQ ID NO: 45894 - protein, 128 aa, Panicum virgatum
  misc_feature: Ceres CLONE 2027614
  misc_feature (56)..(91): Pfam Name: Rubredoxin Pfam Description: Rubredoxin
MALQAPSLMRAPAAAEPLRSSFAAPWAVRLPAPARRRVARAATAARITMRVATQQAYICRDCGYIYNDRTPFDKLPDKYFCAVCGAPKRRFRPYEPAASKNANATDVRKARKEQLKKDEAIRQALPIA

SEQ ID NO: 45895 - DNA, 464 bp, Panicum virgatum
  misc_feature: Ceres CLONE 2027627
  misc_feature: Encodes the peptide sequence at SEQ ID NO. 45896
gcttgcattgcattgcatcttgggtttggagattgcacgggcattggttgccctcttcaccaacgtgaaaagaactcgcgtgttccttccatggcggcgagagggggcgaggcgaggccgccggcggtgaagatcatcgagacggtgcacgtcgaggcggaccggtccagcttcaagtcggtcgtgcagaggttcaccgggagggacgcggcggccggcgactggtcggacgtgtcgtccgagcgaagatcaaacgaagcggcggcccagggggctgggtgcctgggtacgtgagcagacaagccgatcgccactcgtgcaaagaagagagctgttgatagccatccgtctatactggctatcgcctctgtacttggtactgtatctatgtgtaactagtttttctctaccgcgactgccaaatttgtatgtttacttcgttgcagaaaagaaaatatttaccc

SEQ ID NO: 45896 - protein, 97 aa, Panicum virgatum
  misc_feature: Ceres CLONE 2027627
  misc_feature (44)..(74): Pfam Name: VQ Pfam Description: VQ motif
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
ACIALHLGFGDCTGIGCPLHQREKNSRVPSMAARGGEARPPAVKIIETVHVEADRSSFKSVVQRFTGRDAAAGDWSDVSSERRSNEAAAQGAGCLGT

SEQ ID NO: 45897 - DNA, 784 bp, Panicum virgatum
  misc_feature: Ceres CLONE 2027637
  misc_feature: Encodes the peptide sequence at SEQ ID NO. 45898
atccaactttctcttcccgcccaacaacacaagcccagacgaccctcggttcatcaagactttcaagtcacattacatattcttcatcttcactcaatttccgagacttccaaaatgcccccgaaggccgctgataagaagcccgcctcgaaggccccggcgactgcctcgaaggctcccgagaagaaggatgccggcaagaagaccgcgccctcgggcgacaagaagaagcggaccaaggcccgcaaggagacttattcctcctacatctacaaggtcctgaagcaggtccaccccgacaccggtatttcgaaccgtgccatgtccatcctcaactccttcgtcaacgacatctttgagcgtgtcgccaccgaggcttccaagctcgccgcgtacaacaagaagtcgaccatctcgtcccgcgagattcagacgtcggtccggcttatcctccccggcgagctggccaagcacgccgtgtcggaaggcaccaaggccgtcaccaagtactcttcgagcacgaaataagcgggcggttccggggtgttttgcttttctcgttttctctctctcttagggcaccgggttttgcttggcatttgggggtcatgacgaggctggccacaaggcgcacgcgcccttttgggagcctctaatgcaatgcgttacggatgggctggcttttgggagcaatgtttttctcatggtttacggggtttgcggttgtacaatacatcccttgatatcagggtttcgggcgaaatgaactcgtgcatatgaccac

SEQ ID NO: 45898 - protein, 137 aa, Panicum virgatum
  misc_feature: Ceres CLONE 2027637
  misc_feature (42)..(112): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MPPKAADKKPASKAPATASKAPEKKDAGKKTAPSGDKKKRTKARKETYSSYIYKVLKQVHPDTGISNRAMSILNSFVNDIFERVATEASKLAAYNKKSTISSREIQTSVRLILPGELAKHAVSEGTKAVTKYSSSTK

SEQ ID NO: 45899 - DNA, 650 bp, Panicum virgatum
  misc_feature: Ceres CLONE 2027648
  misc_feature: Encodes the peptide sequence at SEQ ID NO. 45900
agcatgacatctcgtgcagaccagaatgacagatgggcttcctatgctggacctggtggatggaacgatcctgacatgcttgaagtgggcaacggtggtatgtctgaagtggagtaccgctctcacttcagcatctgggcacttgccaaggctcctcttctgatcgggtgcgatgtacgctcgatgagccagcagacaaaggacatactcaccaactgggaagtcattgctgtcaaccaagatagtctaggcgtccaaggaaagaaagtgcaatccaacaatggcttagaggtatgggctgggccgctcaacaacaacaggaaggctgtggttctctggaaccggcagggctaccaggcaaccatcaccgcccaatggtcaagcatcgggctcgcttcatccactgctgtcactgctcgcgatctatgggcgcattcgtcgttctcagctcagggccaattatcagcttcagtggcacctcatgactgcaagatgtatgttctgacgccgaagtaacttgtggaagaacgagtccgtagcgtgggatgcagccattcaatcaggattcaggaaaagtgtatgcacgcaaggatccttgagagaaggaaatgaaatctcatttgatgatacaagataagagtattatgcag

SEQ ID NO: 45900 - protein, 171 aa, Panicum virgatum
  misc_feature: Ceres CLONE 2027648
  misc_feature: SWISSPROT Homolog: EC 3.2.1.22 Alpha-galactosidase
SMTSRADQNDRWASYAGPGGWNDPDMLEVGNGGMSEVEYRSHFSIWALAKAPLLIGCDVRSMSQQTKDILTNWEVIAVNQDSLGVQGKKVQSNNGLEVWAGPLNNNRKAVVLWNRQGYQATITAQWSSIGLASSTAVTARDLWAHSSFSAQGQLSASVAPHDCKMYVLTPK

SEQ ID NO: 45901 - DNA, 409 bp, Panicum virgatum
  misc_feature: Ceres CLONE 2027664
  misc_feature: Encodes the peptide sequence at SEQ ID NO. 45902
atcgatcgagccagccatccagccagtcgcctatcctcgcctgctgcgcgcgtctctctgctctcctagggagatctcgcgccgcgcggtaacccccttcccacctcgtcgccgtcgcagatggccggcctcgggatgaagctcggccccgccgccgccgtggccgccgcgctcgtggcgtccgccgccgccgtcaccgaggcccccgccccggcgcccgcctccgacgccgccgccgcgcggcccctcgccgcgtcgtccctcggcgccgccgccttcggctacctctgctgcatcatcctccacgcattcccggtgggagctgcagatatgatgattcgttcggacgtgagatgattcccgccggcgaggggaggatggcggtggacgagggtatcgacaaggtcgt

SEQ ID NO: 45902 - protein, 78 aa, Panicum virgatum
  misc_feature: Ceres CLONE 2027664
  misc_feature: Functional homolog of the protein sequence given in SEQ ID NO 50390
  misc_feature: Useful for making plants with altered carbohydrate content
  misc_feature: Functional homolog of the protein sequence given in SEQ ID NO 50827
  misc_feature: Useful for making plants with altered cell wall content and/or composition
MAGLGMKLGPAAAVAAALVASAAAVTEAPAPAPASDAAAARPLAASSLGAAAFGYLCCIILHAFPVGAADMMIRSDVR

SEQ ID NO: 45903 - DNA, 680 bp, Panicum virgatum
  misc_feature: Ceres CLONE 2027665
  misc_feature: Encodes the peptide sequence at SEQ ID NO. 45904
aactaacgctaaaaaagtaacagtttctgtactttattggttgatcccaatggctttcgtgaagaagggcgagaagggcgaggagaccgagcagatccaccagatccgcatcacgctgtcgagccgcaaccccaaggcgctcgagaaggtgtgctccgacctgatggtccgcgccaaggaccagaagatcaagacccgcggcccggtccgcctgccgacccgcacgctgaagatgaccgtccgcaagagcccctgtggcaacggttccgcgacgtgggacacgtaccagatgtccatctacaagcgccttatcgacctctacgcgccgcaggaggtcgtgaagcagatcaccgccatcaacatcgagcccggtgttgacgtcgacgtcgtcgtccacgacgcgtaagcactgtgagtgtttcgcgaatagcccatggttgactaacgatggagcggtttcttcgcggtcactttcgcgggcattgacgtgatgaatccgtgtcgcacggtgttggcagcggcgcacccgcgccggttgcggaactcttccgccacctcgactttccgtcgcgctgccatcacgctgggtttcagcgctcagcatttcatcatctcgacatccttcagcggttgctgccaccctcctcgatcaatcaaaactgaccacctacttgattccg

SEQ ID NO: 45904 - protein, 118 aa, Panicum virgatum
  misc_feature: Ceres CLONE 2027665
  misc_feature (18)..(113): Pfam Name: Ribosomal_S10 Pfam Description: Ribosomal protein S10p/S20e
  misc_feature: Functional homolog of the protein sequence given in SEQ ID NO 50533
  misc_feature: Useful for making plants with modulated phosphate use efficiency
  misc_feature: Functional homolog of the protein sequence given in SEQ ID NO 50532
  misc_feature: Useful for making plants with modulated biomass
  misc_feature: Useful for making plants with modulated flowering time
MAFVKKGEKGEETEQIHQIRITLSSRNPKALEKVCSDLMVRAKDQKIKTRGPVRLPTRTLKMTVRKSPCGNGSATWDTYQMSIYKRLIDLYAPQEVVKQITAINIEPGVDVDVVVHDA

SEQ ID NO: 45905 - DNA, 694 bp, Panicum virgatum
  misc_feature: Ceres CLONE 2027671
  misc_feature: Encodes the peptide sequence at SEQ ID NO. 45906
ggaaggcccaaatatatctcgccgcggcccaaagccctagccgccgtccgccgccttcttcgtcgccgtcttctcgagccctcggcgcgctgccttggaggaacgaggagcgccaccgcacagggcacatcccctacccgtaggagattagcatcgaacagcaatggcgaagcatcatcctgatctcatcatgtgccggaagcagcctggcattgcgatcggtcgcctgtgtgagaaatgtgatggcaagtgcgtcatctgcgactcatacgtgcgcccatgcacgcttgttcgggtctgcgatgagtgcaactacggctcattccagggaaggtgtgtgatctgtggaggagtcggcatctcagacgcctactactgcaaggagtgtacccagcaggagaaggaccgggatggttgtcccaagattgtcaatcttggaagcgccaagactgatctcttctacgagcggaagaagtacgggtttaagaagagatgattgagaggagggagttgctgggttctattgtgttctgccgcactgatactgagagtaggctgctgaggcagcagcgttgtattcatgttatgatttgatattgatgtgagaatacacccctgatatgctttgtaataactggttcaactgtatggtctaagacccccaatactacttaatgcatatgcaacttgtgct

SEQ ID NO: 45906 - protein, 110 aa, Panicum virgatum; identical to SEQ ID NO: 45294
  misc_feature: Ceres CLONE 2027671
  misc_feature (1)..(106): Pfam Name: PHF5 Pfam Description: PHF5-like protein

SEQ ID NO: 45907 - DNA, 808 bp, Panicum virgatum
  misc_feature: Ceres CLONE 2027680
  misc_feature: Encodes the peptide sequence at SEQ ID NO. 45908
atcctcttccccttgtctcaagcacgcataaaacatggcagtaggaaagaataaacgtaagccaaagaagggagcaaaaaagaagaagatcgttgatccattttcccgtaaggactggtacgacatcaaagctccagctatgttcgcaacaaccgatattggaaagaccatgatcaatcaaactcaaggaaaagtcatctcctctgaacaagtcaaaggaagagtttttgaagtttcagttgctgacttgaccaaagatgaagaacgtgcttacagaaccatttcattgattgctgaagatgtccaaggaaaaaccatcctcaccaactttcatggaatgaaattcgcaagtgataaagtcaagagtctcatcaagaaatggcaaacacttattgaaggaaacgtagatgttaaaacaacagatggttacactcttagattgttcgccattgccttcacaaaaaagagaccaaatcaacttagacttaccagctacgcacaaacatcacaaattaaacaaatcagaaagaagatggttgatatcatgcaacgtgaatctgcacattgtgatgtctctcaactgttcaaaaaattcmacacagagaccatgggaaaacttattgaatcagaatgccaaggaatttatcctttaaaggattgttatatccgaaaggctaaaattattcgaagaccaaaattcgatgcatacaagttagctgaacttcattctgaatccgctgcagaagatactggtgccaaagttggccaaccaagcggtgctcaataaattttaaataaaagcgtgctc

SEQ ID NO: 45908 - protein, 250 aa, Panicum virgatum
  misc_feature: Ceres CLONE 2027680
  misc_feature (9)..(221): Pfam Name: Ribosomal_S3Ae Pfam Description: Ribosomal S3Ae family
  misc_feature (188)..(188): Xaa is any aa, unknown, or other
MAVGKNKRKPKKGAKKKKIVDPFSRKDWYDIKAPAMFATTDIGKTMINQTQGKVISSEQVKGRVFEVSVADLTKDEERAYRTISLIAEDVQGKTILTNFHGMKFASDKVKSLIKKWQTLIEGNVDVKTTDGYTLRLFAIAFTKKRPNQLRLTSYAQTSQIKQIRKKMVDIMQRESAHCDVSQLFKKFXTETMGKLIESECQGIYPLKDCYIRKAKIIRRPKFDAYKLAELHSESAAEDTGAKVGQPSGAQ

SEQ ID NO: 45909 - DNA, 628 bp, Panicum virgatum
  misc_feature: Ceres CLONE 2027692
  misc_feature: Encodes the peptide sequence at SEQ ID NO. 45910
gcaacaaaaaattgtcaggaaaccacaatgggtaacgaaccaactcacctctctccaacagaaatcgagaacatgaaactcatgtcaaatttctcggaacgcgaacttaaacgcctccaccgccgtttcaaaaagttggatactgatggatctggaactctcacgatcgacgaatttatgcggattccagaactagctgtgaatcccctgctagagcgagttatccaaatttttgatgaaaacaaagacaacgaaatccaatttgcagaattcatcaaggcactctccattttctcagataaaggaaacaaagaaggaaaactcgaatttgctttccgagtttacgacatggatggagatggttttatttcaaatggggaactttttcaagtcctcaaaatgatggttggtgataacttgacagatgttcaactccaacaaattgttgataaaacgattcttgaaggaaacacaattgataagagtggcagaatttcttatccagaattcaaaaagatgattaccaaccttgatgatattgaagagaagatgactatttccttcaatgaatagacagtctagaaatgtactgaaaaactgaaaatttaataaaaggaaaattaccctg

SEQ ID NO: 45910 - protein, 181 aa, Panicum virgatum
  misc_feature: Ceres CLONE 2027692
  misc_feature (98)..(126): Pfam Name: efhand Pfam Description: EF hand
  misc_feature (29)..(57): Pfam Name: efhand Pfam Description: EF hand
  misc_feature: SWISSPROT Homolog: EC 2.7.11.1 Non-specific serine/threonine protein kinase
MGNEPTHLSPTEIENMKLMSNFSERELKRLHRRFKKLDTDGSGTLTIDEFMRIPELAVNPLLERVIQIFDENKDNEIQFAEFIKALSIFSDKGNKEGKLEFAFRVYDMDGDGFISNGELFQVLKMMVGDNLTDVQLQQIVDKTILEGNTIDKSGRISYPEFKKMITNLDDIEEKMTISFNE

SEQ ID NO: 45911 - DNA, 614 bp, Panicum virgatum
  misc_feature: Ceres CLONE 2027695
  misc_feature: Encodes the peptide sequence at SEQ ID NO. 45912
atccgaatctaaagatggatctatcttcagcttgccttgggttgcagggtttcaggaggaataagcaacggttagccggaatatggcagaggcagcgaacgggaagcatgatgccaagaggacaggactggaaggaacgggcctaccgctacaaggcggttcccacggcaaccttcacagtgctagcaacgaccaacagctgaggcagatgctcgattcgctcaaatcctccaagtcccctgctgtgatcaactatggtgcctcatggtgtcgtgtttgcagtcagattcttccatccttctgcaagttcagcaatgaattcaagaatcttaagttcatctatgcagatattgatgagtgccctgaaacaacacaaagcatacgctacaccccaaccttccatttttatcgagatggagaaagggtagatgagatgcttggcttaggagaagagagattacatgatcggctatggttgcattcttgatggttgtcactggcttctgttgccactgttttcatgaaccgtttatgctgaatgttatttttatttttttttcaattcctgtaattagtaacatagttctgagtcatttccctacaagtccttgtag

SEQ ID NO: 45912 - protein, 134 aa, Panicum virgatum
  misc_feature: Ceres CLONE 2027695
  misc_feature (30)..(133): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAEAANGKHDAKRTGLEGTGLPLQGGSHGNLHSASNDQQLRQMLDSLKSSKSPAVINYGASWCRVCSQILPSFCKFSNEFKNLKFIYADIDECPETTQSIRYTPTFHFYRDGERVDEMLGLGEERLHDRLWLHS

SEQ ID NO: 45913 - DNA, 668 bp, Panicum virgatum
  misc_feature: Ceres CLONE 2027699
  misc_feature: Encodes the peptide sequence at SEQ ID NO. 45914
aatactaaccacacagcactcgagcagcttcagcaggtagaacatacccgctgatcccactcgtcgcaagtcgcaaagatggtcaagaagcgcgcgtccaacggccgcaacaagaacggcagaggccacgtcaagcctgtccgttgctccaactgctcgagatgcacccccaaggacaaggccatcaagagattcaccatccgcaacatggttgagtccgccgccatccgtgacatctctgacgcctccgtcttcgccgagtactcggtccccaagatgtacctcaagctgcagtactgcgtctcctgcgctatccacggcaagatcgtccgtgtccgttcccgcgagggccgccgtaaccgcgctccccctccccgcgtgcgcttcaacaaggacggcaagaagatcaaccccctccagactggcaagaccgctggtggcaactaagcccgtcgcatgactggaaagaagaagttcatttttttcatgcatcacggcgattaggggaaatcatggggcgtctgtctctcgattgagaagagggtacggggaaatcatgtttgcagcccggtggaaataccccgtgccggccatctgaagcgctcggtatagctgcagatagctcagaatccagaacaccttgaaagtcgaattgacgacgtcacacg

SEQ ID NO: 45914 - protein, 122 aa, Panicum virgatum
  misc_feature: Ceres CLONE 2027699
  misc_feature (1)..(114): Pfam Name: Ribosomal_S26e Pfam Description: Ribosomal protein S26e
  misc_feature: Functional homolog of the protein sequence given in SEQ ID NO 50755
  misc_feature: Useful for making plants with modulated nitrogen use efficiency
MVKKRASNGRNKNGRGHVKPVRCSNCSRCTPKDKAIKRFTIRNMVESAAIRDISDASVFAEYSVPKMYLKLQYCVSCAIHGKIVRVRSREGRRNRAPPPRVRFNKDGKKINPLQTGKTAGGN

SEQ ID NO: 45915 - DNA, 661 bp, Panicum virgatum
  misc_feature: Ceres CLONE 2027702
  misc_feature: Encodes the peptide sequence at SEQ ID NO. 45916
gtatccttttcctaggtggtatcatgggtttcgagaagaaagttgttgttgattgtcgtggtcatttgttgggccgattagcgtcggtcatcgccaaacaattacttgaaggacaaaagattgttgctgtccgttgtgaaggaattaacatctcaggacatttccttcgtaacaagcttaaatttttgacctacctcagaaagagaacttcagctaatccacgacatggacatatccatttccgttctccttcaaaaatcttgtggaagacaattcgtggtatgcttcctcacaagactgcaaaaggtgctcatgcacttggacgacttaaggtcttcgaaggagttcctcctccatacgataaaacaaaacgagttgtagttccagctgccttaagaattcttaaacttaaacctcaaagcaaatttacagtccttggaagactttcccacgaagttggctggaaatatcaagatgttgttgctagactcgaagagaagagaaaagttaaggctcttgcttggtactcaagacaaaaacaacttgcaagattcaaggctcaagctgttaaatcctcagaaggacagctcaaggaacacctccctctcgtacgctctgttgctttggaaaatagattatctggaaataaaaaatgcctcct

SEQ ID NO: 45916 - protein, 212 aa, Panicum virgatum
  misc_feature: Ceres CLONE 2027702
  misc_feature (6)..(122): Pfam Name: Ribosomal_L13 Pfam Description: Ribosomal protein L13
  misc_feature: Functional homolog of the protein sequence given in SEQ ID NO 50574
  misc_feature: Useful for making plants with modulated nitrogen use efficiency
MGFEKKVVVDCRGHLLGRLASVIAKQLLEGQKIVAVRCEGINISGHFLRNKLKFLTYLRKRTSANPRHGHIHFRSPSKILWKTIRGMLPHKTAKGAHALGRLKVFEGVPPPYDKTKRVVVPAALRILKLKPQSKFTVLGRLSHEVGWKYQDVVARLEEKRKVKALAWYSRQKQLARFKAQAVKSSEGQLKEHLPLVRSVALENRLSGNKKCL

SEQ ID NO: 45917 - DNA, 423 bp, Panicum virgatum
  misc_feature: Ceres CLONE 2027709
  misc_feature: Encodes the peptide sequence at SEQ ID NO. 45918
aacaaacgctaaaaaagtaacagtttctgtactttattgctttcgttgagacaacatggtcaccatcaccaaggagatgcttgagaagcgcgccgccgccgtccgcacgggtggccccggcaccgtccgccgcaccgtcaaggctgcgcacaagacgtcgagcaacgacaacaagcagatccagggcgccctcaagaagctcggcgtgaccccccttggcgagacggaggaggctttcttcttccgcagcgacaacaccatgttccacttcaagaaccccaaggtccagacctcgatgcagtcccagtgcttcgtcgtctccggcgcgtacgacatcaagacctcggaggctccctcggcctaaaccgaaccccccggaagcaccaccaccctctcatagcttaccacttcaaaagaaaacac

SEQ ID NO: 45918 - protein, 102 aa, Panicum virgatum
  misc_feature: Ceres CLONE 2027709
  misc_feature (37)..(96): Pfam Name: NAC Pfam Description: NAC domain
MVTITKEMLEKRAAAVRTGGPGTVRRTVKAAHKTSSNDNKQIQGALKKLGVTPLGETEEAFFFRSDNTMFHFKNPKVQTSMQSQCFVVSGAYDIKTSEAPSA

SEQ ID NO: 45919 - DNA, 671 bp, Panicum virgatum
  misc_feature: Ceres CLONE 2027718
  misc_feature: Encodes the peptide sequence at SEQ ID NO. 45920
atgcgtccaccttcacacatggcagctgttgaagtaaagctctttaataagtggagttatgatgaggttgtgatccctgatatgacactcagagattacctcgccattgctcaaaaagaaaaggaaaagtttcatcaataccttccacatacagcaggccgttacaacgtcaagcgtttccgtaaggcccaatgtcctattgttgaacgattaacaaactctctcatgatgcacggcagaaacaacggaaagaagcttcttgccgttcgtatcgtcaaacatgcatttgaagttattcacttgttgagtggtgaaaatcctctccaagttttagtcaacgccatcataaatggtgctcctcgtgaagattcaactcgtgttgggaatgcaggaactgcaagacgtcaagctgttgatgtttccccacttcgtagagtaaatcaagccatctacttaatctgtgctggcgctcgaactgctgcatttagaaatgtaaaaacaatctcagagtgtttagctgatgagcttatcaattgttcaaaagaatcccctaacagctatgctttcaaaaagaaggacgagaccgaaagagtagctaaatccaatcgttaaacgaatattattcttaattttgttgttgtggacgtaaataaagcctgccttctcccttt

SEQ ID NO: 45920 - protein, 197 aa, Panicum virgatum
  misc_feature: Ceres CLONE 2027718
  misc_feature (42)..(197): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
MAAVEVKLFNKWSYDEVVIPDMTLRDYLAIAQKEKEKFHQYLPHTAGRYNVKRFRKAQCPIVERLTNSLMMHGRNNGKKLLAVRIVKHAFEVIHLLSGENPLQVLVNAIINGAPREDSTRVGNAGTARRQAVDVSPLRRVNQAIYLICAGARTAAFRNVKTISECLADELINCSKESPNSYAFKKKDETERVAKSNR

SEQ ID NO: 45921 - DNA, 467 bp, Panicum virgatum
  misc_feature: Ceres CLONE 2027746
  misc_feature: Encodes the peptide sequence at SEQ ID NO. 45922
gggaagaggcaagtcatgatccggccctcttcaaaagtgatcatcaagttcctcatcgtcatgcagcgccatggctacattggtgagtttgagtacgttgatgaccatcgggctggtaagatcgtggttgagctgaacgggaggctcaacaagtgcggggtgatcagccctcgcttcgatgttggcgtgaaggagatcgaggggtggactgcccggctgctcccatctcgtcagtttgggtacattgtcctgacaacctctgctggcatcatggaccacgaggaagccaggaggaagaatgttggtggcaaagtgctcggcttcttctattgaatgaaagttttgtgaaagcattctcgatcgatgtatcctgcctattccttcttgattaccgaaagcacttagagggatatttgagctgttttggtagttctgatgaattatgccgttgcaaattttatttccag

SEQ ID NO: 45922 - protein, 110 aa, Panicum virgatum
  misc_feature: Ceres CLONE 2027746
  misc_feature (1)..(110): Pfam Name: Ribosomal_S8 Pfam Description: Ribosomal protein S8
GKRQVMIRPSSKVIIKFLIVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 45923 - DNA, 653 bp, Panicum virgatum
  misc_feature: Ceres CLONE 2027751
  misc_feature: Encodes the peptide sequence at SEQ ID NO. 45924
gcttctgtctcctctctccacacgacttgctcgggccgccgcctacgccgtcgtcgcagcagtcaccgtgacctgcaaccagagaaagcatggatactcaggttaagcttgccgtcgtggtcaaggtgatgggccgcaccggttccaggggtcaggtgacccaggtcagagtgaagttcctggacgaccagaaccgtctcatcatgaggaacgtcaagggccctgtccgtgagggtgacatcctcaccttgctcgagtctgagagggaggccaggaggctgcgctgaagcagctggttgttgtgtcagttgttcgctgttcttgtcttaaacaagttgatgatggattgattaccccttgcctagtgtactgctttcgcatcaagttcttgaagaatgctactttgtcttttgcataggctatggagaatgagttaagagcaatggaaatgtaatttgtgcaaatgtcctgttgcaagttttggtctgttaccctgaatgaatttaagtgcacttatgttgtgttacatggttgtgttgcaatcttgggtaacattataatgaatggcctgtatgagttctgtataatttgaatttattgggtgaatgctagactgtccactgcacatcgaaattgtttgtttggacgtcccg

SEQ ID NO: 45924 - protein, 65 aa, Panicum virgatum; identical to SEQ ID NO: 9766
  misc_feature: Ceres CLONE 2027751
  misc_feature (1)..(65): Pfam Name: Ribosomal_S28e Pfam Description: Ribosomal protein S28e

SEQ ID NO: 45925 - DNA, 573 bp, Panicum virgatum
  misc_feature: Ceres CLONE 2027752
  misc_feature: Encodes the peptide sequence at SEQ ID NO. 45926
agtcacgcccagcgaaacagggtttgggcctccgagtcctgacagccccctcacacgccgcctgcgtcttcttcctcaccatctacggcgaggctggggtggtccttgtcgtcccaatcggagagctgcctcccgctcgccgtcacgagcggcacttctcgtacgccctagcgcagacgctccttcctcgcctccgcccgcggcgatggagggcggatccagctcgaagaagaggagatggaggaagcgaaagctcaagcaggagcggaagccgaatcccgcgacgcagctcaccgacgacctcctcgtcgagatcctgtcgcgcgtgccgtacaggtctctctgccgcttccggtgcgtctccacgcgctggcgcgcgctgatctcccaccccgactaccgaaggaggctcccccagactcttgccggcatcttgcaccgaagccccaccgcaggttgcggagttagttttgtaaattgattttatttagtattttcaattaatagtcaaaatttattagttttgtaaattaattttgtttaatatttttaattaatagtcaaaatttgtgc

SEQ ID NO: 45926 - protein, 91 aa, Panicum virgatum
  misc_feature: Ceres CLONE 2027752
  misc_feature (24)..(71): Pfam Name: F-box Pfam Description: F-box domain
MEGGSSSKKRRWRKRKLKQERKPNPATQLTDDLLVEILSRVPYRSLCRFRCVSTRWRALISHPDYRRRLPQTLAGILHRSPTAGCGVSFVN

SEQ ID NO: 45927 - DNA, 761 bp, Panicum virgatum
  misc_feature: Ceres CLONE 2027758
  misc_feature: Encodes the peptide sequence at SEQ ID NO. 45928
aaaaatttgggatttaggatcatcgattaaacatggttaaaagctacagaaacaagtctagaactgccaagaccccaatcaaccccttcgaaaaggaaagattggacagcgaattggaaatcatcggtagatatggtttaaagaacaagagagaagtctggagagtccaactcaccctcgccaaaatgagaaaggccgcaagagagttattgactcttgacgaaaaggatcccagaagacttttcgaaggtgaagccttgatgagaagatgcttcagattcggtctcttgaacgaaaacgaaaataagctcgattacgtcttgggtttgactcctgctaaattcatggaaagaagactccaaaccgtcatcctcagaaataacttcgaagccagatctatccaccacgccagagtcctcatcagacaaagacacatcagagttggcaagcaactcgtcaacattccttctttcttggtcagagttgatagagaaaagcatattgatttcgctattacttctcccttcggtggtgccagagctggtagagttaagagaagaaacgccaagaaggaaaaacaaggtggcgatgatgagtaatcctccagtttgcaaaatcccacagtttttaaccaagttagaggagttcacaataaatgagatactcgtataaacttattgcataaataccattttatcaaatgttccctcatgtcgtgaaaattcggactcaatgaattcgacttacaatgtcatatcgtc

SEQ ID NO: 45928 - protein, 188 aa, Panicum virgatum
  misc_feature: Ceres CLONE 2027758
  misc_feature (5)..(106): Pfam Name: Ribosomal_S4 Pfam Description: Ribosomal protein S4/S9 N-terminal domain
  misc_feature (107)..(155): Pfam Name: S4 Pfam Description: S4 domain
MVKSYRNKSRTAKTPINPFEKERLDSELEIIGRYGLKNKREVWRVQLTLAKMRKAARELLTLDEKDPRRLFEGEALMRRCFRFGLLNENENKLDYVLGLTPAKFMERRLQTVILRNNFEARSIHHARVLIRQRHIRVGKQLVNIPSFLVRVDREKHIDFAITSPFGGARAGRVKRRNAKKEKQGGDDE

SEQ ID NO: 45929 - DNA, 450 bp, Panicum virgatum
  misc_feature: Ceres CLONE 2027772
  misc_feature: Encodes the peptide sequence at SEQ ID NO. 45930
gtacatacaggagccacagcaaccatcaaagttcaagaacgtggacacaccagcgaaaatgagcagtggcagcggtaagagctcgtggccggaggtggttgggctgccggccgagacggcgaagcagaagatcctggccgaccggccggacgtgcaggtggttgtgctgcccgtgggctccttcgtgaccactgagttcaaccccaagcgcgtccgcgtcttcatcaacccggccggcgacgttgcgcaggtccccaagatcggctaggaccggcgcatggagcacattcgtgatgatccatcgcagataatatacacataatatattattttcatgatgaataatgctctcagggtgatgtctcatttgtgcaatcatgtaaaccagcaaataatgttgttacttcatgtccaataaacaaataaactcttgtgccaggctgcctgttc

SEQ ID NO: 45930 - protein, 69 aa, Panicum virgatum
  misc_feature: Ceres CLONE 2027772
  misc_feature (7)..(69): Pfam Name: potato_inhibit Pfam Description: Potato inhibitor I family
MSSGSGKSSWPEVVGLPAETAKQKILADRPDVQVVVLPVGSFVTTEFNPKRVRVFINPAGDVAQVPKIG

SEQ ID NO: 45931 - DNA, 676 bp, Panicum virgatum
  misc_feature: Ceres CLONE 2027778
  misc_feature: Encodes the peptide sequence at SEQ ID NO. 45932
atccatcaaactccagtcttcccagctttcaatcctcttcaaccccaatccataccaaatctttttacaaagcttttagcttcatacctcaatcaacatgacaggacgcggcaaaggtggcaagggcctcggcaagggtggtgccaagcgccatcgcaagattcttcgtgacaacatccagggtatcaccaagcccgctatccgccgtctcgctcgtcgtggtggtgtcaagcgtatttctgccatgatctacgaggagacccgaggtgtcttgaagaccttccttgagggtgtcatccgtgatgctgtcacatacacagagcacgccaagcgaaagaccgtcacatctctcgatgttgtctatgctcttaagagacaaggccgtaccctctatggtttcggtggttaagcgcatcaatctgatctctgcatcattatcacgacatcacctgggcatatcatgcttgttgtcatccatagcatgatcgtctcttcttttttgctttgagtttcggagtggttgggcacgcaatgggttctcaatggggctgcacggtcatggttatgatgggatggcaaatcaattaaaggtgccttgatgtatcatacaggcatagtatgagcagcctgaacggcgtttgcagatgggctgagagccatgacataagcatcagta

SEQ ID NO: 45932 - protein, 103 aa, Panicum virgatum
  misc_feature: Ceres CLONE 2027778
  misc_feature (25)..(94): Pfam Name: Histone Pfam Description: Core histone H2A/H2B/H3/H4
MTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 45933 - DNA, 695 bp, Panicum virgatum
  misc_feature: Ceres CLONE 2027796
  misc_feature: Encodes the peptide sequence at SEQ ID NO. 45934
agacagcccaccggctctccccttcgccagccgctaccgcccacggagcaccagctcccccactccagtgaggcaggctcccgcacgcagagtggcgcgcgcgactccgccgcaccgcaggcagccatggctctcgccgcctcccaccacggcctcgtcgccgtcgccccctccgcatcccgcgtgccgcggggagggttcctccgcctccacgccgcatcccctgccccgctcgcggccgcacggagaatatgttgccaatctatcaactcagctaatgtgctgggagcttcttcagcaaaagctgatgaggcagtcccagttccagttgtcatgatagatcaagattcagaccgtgatgcgaccattgtgcagttgagtttcggagaccggttgggggcattgcttgacacgatgaaggcactcaaggaccttggccttgatgtcacgaaaggaactgcggtaactgactctgatgtcacacaaacaaagttccacattatgcgattcgggcgcaaagttgaggaccctgacatgttagagaggatacggctaactatcattaacaaccttctgaaatatcatcctgaatctagtgagaagttagcaatgggtgaattttttgggataaaacctcctgaaaagaaggttgatattgacattgcaactcatgtggttgttgaagatgacggacc

SEQ ID NO: 45934 - protein, 189 aa, Panicum virgatum
  misc_feature: Ceres CLONE 2027796
  misc_feature: Functional homolog of the protein sequence given in SEQ ID NO 50834
  misc_feature: Useful for making plants with altered alkaloid content
  misc_feature: Useful for making plants with altered lignin content
MALAASHHGLVAVAPSASRVPRGGFLRLHAASPAPLAAARRICCQSINSANVLGASSAKADEAVPVPVVMIDQDSDRDATIVQLSFGDRLGALLDTMKALKDLGLDVTKGTAVTDSDVTQTKFHIMRFGRKVEDPDMLERIRLTIINNLLKYHPESSEKLAMGEFFGIKPPEKKVDIDIATHVVVEDDG

SEQ ID NO: 45935 - DNA, 436 bp, Panicum virgatum
  misc_feature: Ceres CLONE 2027817
  misc_feature: Encodes the peptide sequence at SEQ ID NO. 45936
agacaccgagatcggtttacaaaacggtcccaaactgtgaaccttgccgacctctccaaaggtcaccgattgaagggttctatctggctggcgattacacaaagcagaaatacttggcttccatggaaggtgcagttttatccgggaagctttgtgcccagtctatagtgcaggattatagcaggctctccctcaggactcagaaaagcttacaatctgaagaagttccggtcgcatcttaattgtagttcaggctctcaccggtgtgtcatcttatcacctatttcatgggaacccaccagctgctcatgttagaggcacctatggtcctttgacaattcccaagagttgaattgtgacagtagctggtatcctcatattgggaagaagtgatatatatgtaaaacgacctgcatagcaattgttagacttttgc

SEQ ID NO: 45936 - protein, 79 aa, Panicum virgatum
  misc_feature: Ceres CLONE 2027817
  misc_feature: SWISSPROT Homolog: EC 1.14.99.30 Carotene 7,8-desaturase
TPRSVYKTVPNCEPCRPLQRSPIEGFYLAGDYTKQKYLASMEGAVLSGKLCAQSIVQDYSRLSLRTQKSLQSEEVPVAS

SEQ ID NO: 45937 - DNA, 695 bp, Panicum virgatum
  misc_feature: Ceres CLONE 2027821
  misc_feature: Encodes the peptide sequence at SEQ ID NO. 45938
caagaatgggggcggagaacatgagagtgaagctgcctcatctcatccgtgctgtccgcaatgctggccagattgtcacatggattactgatcctatgcatggaaacacaatcaaggccccttgtggtttgaagactcgtccatttgactctattctggctgaagtgcgtgcattcttcgacgtgcatgaccaagaagggagccacccagggggtatccacctggagatgaccgggcagaacgtgaccgagtgcattggtggatcacggaccgtgaccttcgatgacttgagcgaccgctaccacacccactgcgaccccaggctgaacgcctcccagtccctggagcttgccttcatcattgccgagaggctcaggaagaggaggatgcggtcaggactcaacaacagtctgccgctgccaccactagctctctaaacggctgatgccgaatagagagggtaggaatagttgcgacgacttgaaagcggtggccgatgcctatttattcgttggtgggtgctcttagcataggtgtaaaactatgtttttgtttgatgctttgggtgtgagacttgccgacttagctgtttctggtgttttgaccttggtaaggagaaaataaagagagaatgggattgcaacgcatgatgaactgatactcaataaattgatcccccggttctgtttggttct

SEQ ID NO: 45938 - protein, 144 aa, Panicum virgatum
  misc_feature: Ceres CLONE 2027821
  misc_feature (1)..(121): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
RMGAENMRVKLPHLIRAVRNAGQIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPPLAL

SEQ ID NO: 45939 - DNA, 727 bp, Panicum virgatum
  misc_feature: Ceres CLONE 2027823
  misc_feature: Encodes the peptide sequence at SEQ ID NO. 45940
gaatctggtcgttttgaatgtcggtttaccagtgtgtccattgggaattctcctgcaatcatgttcaaagggatggaaggttctaccttgggtgtttggagtgctcatggtgagggaagagctttcttcccagatgaaaatgttctagctgcagttgtgaagtctaatctggctcctgtgcgatattgcgatgacggtaacaatataactgagacctatcccttcaatcccaatggttctccactaggcattgcagccctttgctcccctgatggaaggcaccttgccatgatgccacacccagagcgttgcttcatgatgtggcaatatccatggtatccaaaggaatggcaggttgagaagagtggccccagcccttggctgcggatgttccagaatgctcgtgattggtgttcgtagtgcagcttggcacattacgcttacaagttgggctaggattttggagtgcagacgttcaggcccggctgcagggatttggcgtgggttctgggctactagctgtggatggtatggctgtctcatgccatttgagacctcctttagtgaaataattgtatttggctgaccaataatcaaatgttgaaaagctaaaatttgaaatgtggaagaatgtatgactgcctggtcggtcagggccaactttaccatgtactgctggtggtctctaatgattacaataattgtaataagtgggttaaggcatcat

SEQ ID NO: 45940 - protein, 139 aa, Panicum virgatum
  misc_feature: Ceres CLONE 2027823
  misc_feature: SWISSPROT Homolog: EC 6.3.5.3 Phosphoribosylformylglycinamidine synthase
ESGRFECRFTSVSIGNSPAIMFKGMEGSTLGVWSAHGEGRAFFPDENVLAAVVKSNLAPVRYCDDGNNITETYPFNPNGSPLGIAALCSPDGRHLAMMPHPERCFMMWQYPWYPKEWQVEKSGPSPWLRMFQNARDWCS

SEQ ID NO: 45941 - DNA, 629 bp, Panicum virgatum
  misc_feature: Ceres CLONE 2027848
  misc_feature: Encodes the peptide sequence at SEQ ID NO. 45942
aacaaacaggaaggtatcccgccatcacgtcaaaatggctaccacccaggcagttcaggtgttcggcaagaagaagaatgccacagccgtcgcgcgctgtgtgcagggcaagggcctgatcagggtcaacggcaagccgctcaagctgtttgcccctgagatcctccgggcgaagctctacgagcccgttctcatcctcggtaccgataagttcgccgaggtcgacatccgcgtccgcgttaccggtggtggtcacacttcgcaggtctacgcgacgcgccaggctattgccaaggccattgtcgcctactacgccaagtacatcgacgagcactccaagaacctccttaagaccgctcttatccagttcgaccgcaacctgctagtcgccgacccccggcgttgcgagcccaagaagtttggtggaaagggtgcccgtgcgaggttccagaagtcctatcgttgatcggttttttggtcatgttgggaagcggggacttgcgtggacacggacggcgttcggcattgcattgatcagctacgagtcgatattggcctccgacgatggcctgctgaggtgcacatttatggcgcctcgggagataggaataagactcgagtctatctgg

SEQ ID NO: 45942 - protein, 143 aa, Panicum virgatum
  misc_feature: Ceres CLONE 2027848
  misc_feature (11)..(143): Pfam Name: Ribosomal_S9 Pfam Description: Ribosomal protein S9/S16
MATTQAVQVFGKKKNATAVARCVQGKGLIRVNGKPLKLFAPEILRAKLYEPVLILGTDKFAEVDIRVRVTGGGHTSQVYATRQAIAKAIVAYYAKYIDEHSKNLLKTALIQFDRNLLVADPRRCEPKKFGGKGARARFQKSYR

SEQ ID NO: 45943 - DNA, 757 bp, Panicum virgatum
  misc_feature: Ceres CLONE 2027891
  misc_feature: Encodes the peptide sequence at SEQ ID NO. 45944
gtcgggttctccaactctgcgtgactttttgtgcaccagtttggttgagtcttggatagatgttgtcttacttcttctgcttttgttttttacttttttcctcaataaatagaatgagcaggctcaggtgtcgcagcagcaggaaatgtctttacagaacgcaattctatcaaaccttctgacaaccgatgcgctgctccggaacgttgaagaggtagttaggatgcgcttagagttgcaaaggatccgagagaatcaagaaacttcacggcatgcttgggatcaattgctgcagcttgttgttcttgtatatgaaacgaatgaggcacttgtcagaatgattgctacgttgcagcaggaaatgaactcacatgtttcaggccctggagatgaagcatcaagtgtggcaagcagagtcaaccagtactgatcgtacttgtatggtttgcaactctggtggtgcttgtatgatgttgctgtcgtgcaagcacctctgcacctgcaagccatgtgcactccatctcacggcttgcccaatctgcggtgctgtgaaggatgatgcgatcgagacccagttcatatgagaagtgaagaaacaatagcagcgatgggaacctattgtttctgatgtgcctaataagaacatgtgtgttttctttttttcagtgcaagtgtgttggagccttggtttgttatccttcttgtatgctgttctatagtagtcttcatcgtatcaatgtcatatttctgttttctc

SEQ ID NO: 45944 - protein, 70 aa, Panicum virgatum
  misc_feature: Ceres CLONE 2027891
  misc_feature: Functional homolog of the protein sequence given in SEQ ID NO 50826
  misc_feature: Useful for making plants with altered lignin content
MFQALEMKHQVWQAESTSTDRTCMVCNSGGACMMLLSCKHLCTCKPCALHLTACPICGAVKDDAIETQFI

SEQ ID NO: 45945 - DNA, 668 bp, Panicum virgatum
  misc_feature: Ceres CLONE 2027913
  misc_feature: Encodes the peptide sequence at SEQ ID NO. 45946
attttccccttcccgtactctgccctaatggacgccgccatacgggcgtcgactccgccggcggcggccggggaagagccgcgggacgcgcgcttgatgcggacgaacctgcgctctgtgggtctgagggagtacgagtacgacccccgtgtggtggaccgattcgtggagctcgcccgccgctacgcgggcgatgtgctcggcgaggccagggcgtacgccgaccacgccggcagggcgtcgctcgaggccgacgacgtgaacctcgatatccgggccaattccgcgttctcccccgggccgccgcgccgtgagattatctttgacctggcgtgcagcaggaacacgatccctctgcccaaggcggctgctcctcctggatggatccctctcccatctcttgaggacacaacgctgagcccaaattacctagttgttcgtccggttatgccgtcccttgatcaggttgaggaaaccgaggatgacgatgaaggttcagatcctaattccaacactgaacaagagcacaatgtggtagcaccagcaataagcagacccagatcaatgccatggcagttgcagccgtgagacagagaagatgaagactgaccatcaacggttgatcatgggctccttgtctttctttagttagtgcatacctgagtgta

SEQ ID NO: 45946 - protein, 186 aa, Panicum virgatum
  misc_feature: Ceres CLONE 2027913
  misc_feature (7)..(137): Pfam Name: TFIID-31kDa Pfam Description: Transcription initiation factor IID, 31kD subunit
MDAAIRASTPPAAAGEEPRDARLMRTNLRSVGLREYEYDPRVVDRFVELARRYAGDVLGEARAYADHAGRASLEADDVNLDIRANSAFSPGPPRREIIFDLACSRNTIPLPKAAAPPGWIPLPSLEDTTLSPNYLVVRPVMPSLDQVEETEDDDEGSDPNSNTEQEHNVVAPAISRPRSMPWQLQP

SEQ ID NO: 45947 - DNA, 512 bp, Panicum virgatum
  misc_feature: Ceres CLONE 2027916
  misc_feature: Encodes the peptide sequence at SEQ ID NO. 45948
aatatccagaactcgcgccccggcacggacagggcaggagatagagagtgagagtgaccgacattctctggcgccctgaacgtggaggaggaggtcgggaagctcacggaggagatccagaggctcggccagcttcccccccatggctcctacaaggtcatgttcggtgtactcttcaatgatgatcgctgtgctaacttttttgaatcactactcggctccttgagggcctccaagaagaggaaaattttgacatatgatggcgagctgcttctgccgggtgttcatgacaatgcggagatcaccctattgccgcctcctggagttgctgtcgcttgaggtgcacagatccaccagtccgcctattctgtaccgtggatatgctagccctttgttgtgcctatatgtttcatgacctattttgtgttcccagaagactgctattgtatgatgtactaccaagttgtgatgctaaaaaaattggcttgcttgaaaaaagaatacaaaacaac

SEQ ID NO: 45948 - protein, 59 aa, Panicum virgatum
  misc_feature: Ceres CLONE 2027916
  misc_feature: Functional homolog of the protein sequence given in SEQ ID NO 50458
  misc_feature: Useful for making plants with modulated nitrogen use efficiency
MFGVLFNDDRCANFFESLLGSLRASKKRKILTYDGELLLPGVHDNAEITLLPPPGVAVA

SEQ ID NO: 45949 - DNA, 710 bp, Panicum virgatum
  misc_feature: Ceres CLONE 2027942
  misc_feature: Encodes the peptide sequence at SEQ ID NO. 45950
agagagagaggaatcagagagagagagagagagagagagagagaggaatccgagtatccgttccatccggccatggctctccgtaccctggcgtcgaagaagaccctgtccctcgccctcggcggcgcccggccgctggcggcggcggccaggggggtaacgacggtagccctccccgacctctcctacgacttcggcgctcttgagccggccatctccggtgagatcatgcgcctgcaccaccagaagcaccacgccacctacgtcgccaactacaacaaggcgctcgagcagctcgacgccgccatcgccaagggcgacgcctccgccgtcgtccagctccagggcgccatcaagttcaacggcggcggccatgtgaaccattcaatcttttggaagaacctcaagcctattagcgaaggtggtggggagccaccacatggaaaacttggttgggccattgatgaggattttggttcatttgaagcacttgtaaagaagatgaatgcagaaggtgctgctttacaaggatctggatgggtgtggcttgctttggataaagaggcaaaaaagctatcagttgaaactactgctaatcaggaccctctggtgactaaaggagcaagcttggttcctttgttggggattgatgtctgggagcatgcatactacctccagtacaagaatgttaggcctgattacctgaaaca

SEQ ID NO: 45950 - protein, 212 aa, Panicum virgatum
  misc_feature: Ceres CLONE 2027942
  misc_feature (119)..(212): Pfam Name: Sod_Fe_C Pfam Description: Iron/manganese superoxide dismutases, C-terminal domain
  misc_feature (31)..(112): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MALRTLASKKTLSLALGGARPLAAAARGVTTVALPDLSYDFGALEPAISGEIMRLHHQKHHATYVANYNKALEQLDAAIAKGDASAVVQLQGAIKFNGGGHVNHSIFWKNLKPISEGGGEPPHGKLGWAIDEDFGSFEALVKKMNAEGAALQGSGWVWLALDKEAKKLSVETTANQDPLVTKGASLVPLLGIDVWEHAYYLQYKNVRPDYLK

SEQ ID NO: 45951 - DNA, 712 bp, Panicum virgatum
  misc_feature: Ceres CLONE 2027953
  misc_feature: Encodes the peptide sequence at SEQ ID NO. 45952
gcaagaaggcgcgcaccgcctttatctaccgccgcctccggcctcccgcccgctcgtagtccagtccgtccaccgcgtgccaccactttcctgttggctccctgcggcttgccttccacgcgtcccggccggcggcaccagaaccacccgttgctcgctcgctcgctcgctccgggcctccgcgagctggaaccggacaccggccgacccgcggctcgatccgtcgagctcgacatggctactcccctgattgctgggttgtcagtggctgctgctgcgatgagtggaagatacatgattagagcatggcaaaccttccgaacccgggcagcaatgccgcgagtgcgccggttctatcctgggggatttcagggggacatgaacagaagagaagccgcgttgatccttggcgtaagggaacgtgctacaatggacaagatcaaggaggctcacaagagggtcatggtagctaaccaccctgatgctggcgggagccattatgttgcttcgaagataaatgaggcaaaggacatactaatgggaaaagggaagtctggtggttctgtcttttagctgttacaattgaaatcatgctcattttttggtgactgagatgaggctgtaacttttttgaagaaatgacagcagcacgttttcaccctttttaacaatgctgcgctgattgaaccatagatctgaataactacatgtt

SEQ ID NO: 45952 - protein, 112 aa, Panicum virgatum
  misc_feature: Ceres CLONE 2027953
  misc_feature (53)..(106): Pfam Name: DnaJ Pfam Description: DnaJ domain
MATPLIAGLSVAAAAMSGRYMIRAWQTFRTRAAMPRVRRFYPGGFQGDMNRREAALILGVRERATMDKIKEAHKRVMVANHPDAGGSHYVASKINEAKDILMGKGKSGGSVF

SEQ ID NO: 45953 - DNA, 688 bp, Panicum virgatum
  misc_feature: Ceres CLONE 2027954
  misc_feature: Encodes the peptide sequence at SEQ ID NO. 45954
ggttgcagaaaaaaagatggcagagctcttttatgtaatcgttggtttgggtgttgcagcagttgcctattatttttataagcgatcagctccttcaggtcaacagattcatgtcaagccagcaccaacacaacaaaaacaacctgttcttcaagatcacacaactgagtatacaatagaagaaattggaaaacataacaaggaagatgattgttggattattgtcaaaaacaaagtttttgatttgtctgaatttgtcggagatcatccaggagaaattgcccctctcttattacgtagtggagtaggacaagatgcaacaaaaggtttttatggaggacaacatccagagagtgttgaagatcaaattcgtcaataccagattggatacctcaagggatttccactggaagaaatcaaaagacacaacaaggaagatgattgttggattatcgttaatgataaagtttatgatgtcactgcatttattccaagtcatcctggaaagaaagcaatcctcagaaatgcaggaggagattcaactgatggattcaaaaaagttggatcacattttaatgccccaaatgatcttaataactactcaaacgcagatctcgccatggcaaaatatctaattggttgtgtcgaccataaaaaaaaaaactaaataaaggtctttgtcgtcttt

SEQ ID NO: 45954 - protein, 216 aa, Panicum virgatum
  misc_feature: Ceres CLONE 2027954
  misc_feature (128)..(211): Pfam Name: Cyt-b5 Pfam Description: Cytochrome b5-like Heme/Steroid binding domain
  misc_feature (51)..(127): Pfam Name: Cyt-b5 Pfam Description: Cytochrome b5-like Heme/Steroid binding domain
  misc_feature: SWISSPROT Homolog: EC 1.8.3.1 Sulfite oxidase
MAELFYVIVGLGVAAVAYYFYKRSAPSGQQIHVKPAPTQQKQPVLQDHTTEYTIEEIGKHNKEDDCWIIVKNKVFDLSEFVGDHPGEIAPLLLRSGVGQDATKGFYGGQHPESVEDQIRQYQIGYLKGFPLEEIKRHNKEDDCWIIVNDKVYDVTAFIPSHPGKKAILRNAGGDSTDGFKKVGSHFNAPNDLNNYSNADLAMAKYLIGCVDHKKKN

SEQ ID NO: 45955 - DNA, 529 bp, Panicum virgatum
  misc_feature: Ceres CLONE 2028000
  misc_feature: Encodes the peptide sequence at SEQ ID NO. 45956
ctgcctcctctctccacacgacttctcccgccgccgccgccgtcgcagcagtcgccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggtcgcgccagttgttggccattcctgtactgctttcgtatcaagttattgaagaatgctactttgtcttttgcataggctatggagaatgagttaagagcaatggaaatgtaatttgtgcacatgtcctgttgcaagttttggtctgttaccctgaatgaatttaagtgcacttatgttgttacatggttgtgttgcaatcttgggtaacattataatgaatggcctgtatgagttctgtat

SEQ ID NO: 45956 - protein, 65 aa, Panicum virgatum; identical to SEQ ID NO: 9766
  misc_feature: Ceres CLONE 2028000
  misc_feature (1)..(65): Pfam Name: Ribosomal_S28e Pfam Description: Ribosomal protein S28e

SEQ ID NO: 45957 - DNA, 652 bp, Panicum virgatum
  misc_feature: Ceres CLONE 2028001
  misc_feature: Encodes the peptide sequence at SEQ ID NO. 45958
accagccactcgtgctcgcgaatacgcgggctttaaagggcttctccgcaaaaacgccaccccttcacggatccaaaggaaggctcggctcctctctcgcggcggcggcgcacccctcttctccatctccggcaaggcatttggcatctgacctcaacagcaagcaaatggcaggtggcagggttgcacatgccaccctcaagggcccgagcgtggtgaaggagatcttcattggagtcaccctcgggctgattgccggtggcatgtggaagatgcaccactggaacgagcagaggaagactagatccttctacgacatgctggacaagggccagatcagcgttgttgtcgaggagtagctttcacgcgccaagtctgaagttattttctcacagttgtttctgaaactctggagagcatgatgaagtgaatgctgtggagatttgtcttgaaaaataagcataaccatttgaggacaccagattttgttgaatttccttccgtttcatgaatattagaacatgtccaggtcataccgatcaactgaatatctgatctagttttacataagttaatgtgattgtgaaatttgcaagtaattgtgatcgagtttgcccttttatgtgaatcgattggtgggttacctaacagc

SEQ ID NO: 45958 - protein, 63 aa, Panicum virgatum; identical to SEQ ID NO: 9844
  misc_feature: Ceres CLONE 2028001
  misc_feature (2)..(63): Pfam Name: COX5C Pfam Description: Cytochrome c oxidase subunit Vc (COX5C)
  misc_feature: SWISSPROT Homolog: EC 1.9.3.1 Cytochrome-c oxidase

SEQ ID NO: 45959 - DNA, 707 bp, Panicum virgatum
  misc_feature: Ceres CLONE 2028018
  misc_feature: Encodes the peptide sequence at SEQ ID NO. 45960
aactggaagctgatgatgatttgctcatagggcccccaccacctgcagtagttgcagaagctgcatctgcaaatgaagctgagcgatttgaagaggttactcgaatattagctgctgatacaaattcaccatatgatgttctgggggtaaattggaagatgtcagctgataacatgaagaaaaggtattggaagttgtctcttttagtgcatccagacaaatgtcctcatccttcagcacaggaggcgtttgtgaaactgaacaatgccttcaaagacttacaagaccctgataagagaggtgcaatagatgagaagataaagaagaaagaggagatggaacaatttgagattgagcttaaagcaatgcgtgaagctgccgaatggagacgattacaaggtatatcacttgctggtgatgaggaacttttagcaggtcctaaggaggcacaggcacctaagagagatgaatggatgaccacgttgccacctgagagaaaagcaggagtgcctatgcactctactacatcatttagtatgaaaggtaaagaaggacgaggagacacaagtgtctggactgatactcctcttgatagagcacagaaagcacaacaaagctatttagaagcctacaataaaacaaaggcgattgcagaaagagatgacgtgaagagcaaaaacctggatgcttcaatcgtagataaatac

SEQ ID NO: 45960 - protein, 234 aa, Panicum virgatum
  misc_feature: Ceres CLONE 2028018
  misc_feature (42)..(103): Pfam Name: DnaJ Pfam Description: DnaJ domain
LEADDDLLIGPPPPAVVAEAASANEAERFEEVTRILAADTNSPYDVLGVNWKMSADNMKKRYWKLSLLVHPDKCPHPSAQEAFVKLNNAFKDLQDPDKRGAIDEKIKKKEEMEQFEIELKAMREAAEWRRLQGISLAGDEELLAGPKEAQAPKRDEWMTTLPPERKAGVPMHSTTSFSMKGKEGRGDTSVWTDTPLDRAQKAQQSYLEAYNKTKAIAERDDVKSKNLDASIVDK

SEQ ID NO: 45961 - DNA, 571 bp, Panicum virgatum
  misc_feature: Ceres CLONE 2028023
  misc_feature: Encodes the peptide sequence at SEQ ID NO. 45962
agcgaaggcgccgtggacctcccgcggtgggtgcagtcggtggtgcgggaggagtggacggcggaggtgttcgacgcggagttgctgctgatgggcgggagcgccgaggaggagatggtggcgctgctgcaggtggccatggcgtgcgtatccaccgcgccggacgcgcgcccggacgcccccgacgtcgtcaggatgatcgaggagatcggcggcgggcacgggcgcacgacgacggaggagagcgaggggacgaggggcgcgtcggaggaggagcggtccaggggcccgactccgtgacgccgccggtgcaacgcaacgcagtgcaatgctgcatcaaagttgtttcctttcgatccatttatatagcatttgttttcatcctctagtctctaaccgctcagcctggctgcttctcaggcatccattgtcacgccaatcagataccttcccccctccctaccagcctttgttcctccaagtgtatgcagcaattttttccccgtttggttcttgttgggaccattgcaagtgtctgctccaaaatccagtcagtccaccatcatgcact

SEQ ID NO: 45962 - protein, 99 aa, Panicum virgatum
  misc_feature: Ceres CLONE 2028023
  misc_feature: SWISSPROT Homolog: EC 2.7.11.1 Non-specific serine/threonine protein kinase
SEGAVDLPRWVQSVVREEWTAEVFDAELLLMGGSAEEEMVALLQVAMACVSTAPDARPDAPDVVRMIEEIGGGHGRTTTEESEGTRGASEEERSRGPTP

SEQ ID NO: 45963 - DNA, 534 bp, Panicum virgatum
  misc_feature: Ceres CLONE 2028027
  misc_feature: Encodes the peptide sequence at SEQ ID NO. 45964
ctccagttctctccctgcgccgccgccaccgacgccctcttcgctcctcgtgctcgtgagcgcgtcggcctccgtcctcgcgggaacgagagtatggacacccaggtgaagcttgctgttgtggtgaaggtgatgggcagaaccggctccaggggtcaggtgacccaggtcagagtgaagttcctggatgaccagaaccgtctcatcatgaggaacgtcaagggcccggttcgtgagggtgacatcctcaccctgctcgagtccgagagggaggccaggaggctgcgctgaggccgcttgggggggtcttagtgcttcttgtatggagttggatgtcgttgaatttgtgctatgcttgtcaaactttgtgtggcccttagaacacttgccgtatgattagcaagcctggtgataagattgcagttttgctttgtgatccaggttgaaagtgcacttgttgtgctgagacatcagacatggttatcctttgctttggtagctcattctcatgaattaaataccagttaaatctcg

SEQ ID NO: 45964 - protein, 65 aa, Panicum virgatum; identical to SEQ ID NO: 9766
  misc_feature: Ceres CLONE 2028027
  misc_feature (1)..(65): Pfam Name: Ribosomal_S28e Pfam Description: Ribosomal protein S28e

SEQ ID NO: 45965 - DNA, 601 bp, Panicum virgatum
  misc_feature: Ceres CLONE 2028031
  misc_feature: Encodes the peptide sequence at SEQ ID NO. 45966
aacgccgctcgcgtcccctctcgctgccgtacaagaggactcccccgacctggctcaagatcgccgccaacgatgtggacgagatgatcaccaaggccgcgaagaagggccagatgccgtcgcagattggcgtcctcctccgtgaccagcacggtatcccgctcgtcaagagcgtcactggtagcaagatcctccgcatcctcaaggcccatgggctcgcacccgagatcccggaggacctttacttcctgattaagaaggcggtggcgattaggaagcatctggagaggaacaggaaggacaaggactccaaattcaggctcattcttgttgagagcaggatccaccgccttgcccgttactacaagcgcaccaagaagctcccgccaacctggaagtatgagtcgaccactgccagcactctggtggcctaagtgatcccatcagatggtgtggtccttaccttctttgagattggcttgttctagatatgaaatttatgtaatgcttaatgagtctggagcgggttagatggacaaggaacctcaactttttctatgtttacttttggagaatcccataaaccatttttggtttctcg

SEQ ID NO: 45966 - protein, 143 aa, Panicum virgatum
  misc_feature: Ceres CLONE 2028031
  misc_feature (57)..(143): Pfam Name: Ribosomal_S15 Pfam Description: Ribosomal protein S15
  misc_feature (1)..(52): Pfam Name: Ribosomal_S13_N Pfam Description: Ribosomal S13/S15 N-terminal domain
  misc_feature: Functional homolog of the protein sequence given in SEQ ID NO 50384
  misc_feature: Useful for making plants with modulated nitrogen use efficiency
RRSRPLSLPYKRTPPTWLKIAANDVDEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTASTLVA

SEQ ID NO: 45967 - DNA, 709 bp, Panicum virgatum
  misc_feature: Ceres CLONE 2028035
  misc_feature: Encodes the peptide sequence at SEQ ID NO. 45968
gtgcggcttctgccgtcccctgcggtgctccggtcggggtcacctttgcctcgctgccgccgcgtccgcctcgtccgagccgaacacggggaagagaagagaagcccgtgcgccatgttcaagaagttctcttcggaagatatatctgggcagaatcaagttaaggcctctgtacagcgaaggattcggcaaagtattgctgatgagtaccctagccttgaacctttgctagatgacttactccccaagaagtcacctatgattgttgttaaatgccaaaaccatctgaatcttgtggtggtgaataatgttccactgtttttcaacatccgggatggtccttatatgccaaccttgcgtcttcttcatcaatatcctgatatcatgaaaaagttccaagtggacagaggtgctatcaaatttgtgctctctggcgcaaacataatgtgtcctggattgacatcaccaggtggtgtcttggatgatgaagtcgaggaggaaacaccagtggctataatggcggaaggaaaacaacatgcactggcaattgggtttacaaagatgtcagcgaaggacataaggaccatcaacaaagggattggagttgacaatatgcactatctaaatgatggcctatggaagatggagaagctggaatgaggataattcagtgaggggtgctgagcttgcgttattctcgtattgagat

SEQ ID NO: 45968 - protein, 181 aa, Panicum virgatum; identical to SEQ ID NO: 31980
  misc_feature: Ceres CLONE 2028035
  misc_feature (92)..(170): Pfam Name: PUA Pfam Description: PUA domain

SEQ ID NO: 45969 - DNA, 687 bp, Panicum virgatum
  misc_feature: Ceres CLONE 2028050
  misc_feature: Encodes the peptide sequence at SEQ ID NO. 45970
cttcgtcggcgtctccatcgccgccaacatctccggcggccacctgaaccccgccgtgaccttcggcctcgccgtcggcggccacatcaccatcctcaccggcctcttctactgggtcgcccagctgctcggcgcctccgtggcgtgcctgctcctcaagttcgtcacccacggcaaggccatcccgacccacggcgtcgccggcatcagcgcgctggagggcgtggtgttcgagatcatcatcaccttcgcgctcgtctacaccgtgtacgccaccgccgccgaccccaagaagggctccctcggcaccatcgcccccatcgccatcggcttcatcgtcggcgccaacatcctcgccgccgggcccttcagcggcggctccatgaaccccgctcgctccttcggccccgccgtcgccgcgggcaacttcgccggcaactgggtctactgggtcggcccgctcatcggcggtggcctcgctggcctcatctacggcgacgtgttcatcggcggctcctaccagcaggtcgccgaccaggactacgcctaagtccgatggactcaaccgatcgagtgcagcgtttcagtgtctcaatcgtcgtttgctttgctcttcaccacgtcacatggtgacaaatttgtatttacgaatgatgtgtcgtccatggttcttctgttcatttccct

SEQ ID NO: 45970 - protein, 182 aa, Panicum virgatum
  misc_feature: Ceres CLONE 2028050
  misc_feature (1)..(164): Pfam Name: MIP Pfam Description: Major intrinsic protein
FVGVSIAANISGGHLNPAVTFGLAVGGHITILTGLFYWVAQLLGASVACLLLKFVTHGKAIPTHGVAGISALEGVVFEIIITFALVYTVYATAADPKKGSLGTIAPIAIGFIVGANILAAGPFSGGSMNPARSFGPAVAAGNFAGNWVYWVGPLIGGGLAGLIYGDVFIGGSYQQVADQDYA

SEQ ID NO: 45971 - DNA, 533 bp, Panicum virgatum
  misc_feature: Ceres CLONE 2028057
  misc_feature: Encodes the peptide sequence at SEQ ID NO. 45972
acttgcagccaacaactctctccctctcgtcttctcaattggcagattcggagatggcatctggggcggcggagaaggggaaggccctggcggatggttcggagtcggcggcggagagcgcggcgcggcgggcacgggagtggagcacgtggttgatgaagaaggccaaggtggtggcccactacggcttcatccccttcgtcatcctcgtcggcatgaactccgagcccaagccccgcctcgcccagctcctctcccccgtgtaggcctcaccgattgattccgctcggttctcttcggtctccccgtccccgatccgcgccgcacggacgcgtgcgcgttcgattcctgtaattcattgttaccattttcttcccgtttaatctgatttgatctcaatttagttgtgccagtgattttgtgataaagccataaagggggttttgagtccaaatcctgagaattgctgacttgcttgtacactctcacttccaatttgggactagcttgatatgttgacctgttgtttgtct

SEQ ID NO: 45972 - protein, 70 aa, Panicum virgatum
  misc_feature: Ceres CLONE 2028057
  misc_feature (28)..(67): Pfam Name: Tom7 Pfam Description: TOM7 family
MASGAAEKGKALADGSESAAESAARRAREWSTWLMKKAKVVAHYGFIPFVILVGMNSEPKPRLAQLLSPV

SEQ ID NO: 45973 - DNA, 421 bp, Panicum virgatum
  misc_feature: Ceres CLONE 2028066
  misc_feature: Encodes the peptide sequence at SEQ ID NO. 45974
gattccgcatccgtcacctcgtcatcatcaatgggtaaacgaacaaagaaagttggtatcactggtaaatatggaactagatatggtgctagtttaagaaaacaagttaaagaaagcgaaatcaatcagcattctagatacacttgccaattttgtggaaaggatgctgttaaaagacaagccgtcggtatctggcattgttccggatgcaaaagatcaagcgctggaggagcttacacaccaaccactgcttcagccgtaacagttcgatcaactattagacgacttcgcgaagttcaagaattgtaaaaaaatccaggatgaccaaaacgaagacggatacaataaacggaacttgttttaattgtttcaaaagatggaccaggcactttattggaataaataaaatgatagttctggg

SEQ ID NO: 45974 - protein, 92 aa, Panicum virgatum
  misc_feature: Ceres CLONE 2028066
  misc_feature (2)..(91): Pfam Name: Ribosomal_L37ae Pfam Description: Ribosomal L37ae protein family
  misc_feature: Functional homolog of the protein sequence given in SEQ ID NO 50139
  misc_feature: Useful for making plants with modulated cold sensitivity
MGKRTKKVGITGKYGTRYGASLRKQVKESEINQHSRYTCQFCGKDAVKRQAVGIWHCSGCKRSSAGGAYTPTTASAVTVRSTIRRLREVQEL

SEQ ID NO: 45975 - DNA, 570 bp, Panicum virgatum
  misc_feature: Ceres CLONE 2028078
  misc_feature: Encodes the peptide sequence at SEQ ID NO. 45976
gcagatgaattcatgcaaaagctaccatcctttgatgaggactgggccaaacaacgtagcgaggcagaggctgcaggcgcagtcttacggtacgtcggagttgtggatgcggtgaaccagaagggacaggtggagctgcgcaggtacaagagggaccacccgtttgctcagctctccggctccgacaacatcatcgccttcaccacgtcaaggtacaaggagcagccgctgattgtgcgggggccaggtgcaggcgcggaggtgacggccggaggcgtcttctgcgacatcctgcggctggcatcttccctcggcgccccctcataggtctgggctgctgacaaatttctagaggcagacggacaccattgtcctgtatgatccctccgtttgatcccgtttatggatggacttgcattgttctcaataataagtgcccggaaataaggcctctctggttagcaaaggttcggctttgggctagccgactaggcggtgtggtgtggtgtggtggtgtggtgtttcatcgaatccagaattcatatcgaattggtaatgaagtgccaactc

SEQ ID NO: 45976 - protein, 108 aa, Panicum virgatum
  misc_feature: Ceres CLONE 2028078
  misc_feature (1)..(98): Pfam Name: Homoserine_dh Pfam Description: Homoserine dehydrogenase
  misc_feature: SWISSPROT Homolog: EC 1.1.1.3 Homoserine dehydrogenase
ADEFMQKLPSFDEDWAKQRSEAEAAGAVLRYVGVVDAVNQKGQVELRRYKRDHPFAQLSGSDNIIAFTTSRYKEQPLIVRGPGAGAEVTAGGVFCDILRLASSLGAPS

SEQ ID NO: 45977 - DNA, 750 bp, Panicum virgatum
  misc_feature: Ceres CLONE 2028086
  misc_feature: Encodes the peptide sequence at SEQ ID NO. 45978
gcgcggcatcggccgtcccctcccctgctccgctcaaggtcacctttgcctcgctgccgccgcgtccgcctcgtccgagccgaacacggggaagagaagagaagcccgtgcgccatgttcaagaagttctcttcggaagatatatctgggcagaatcaagttaaggcctctgtacagcgaaggattcggcaaagtattgctgatgagtaccctagccttgaacctttgctagatgacttactccccaagaagtcacctatgattgttgttaaatgccaaaaccatctgaatcttgtggtggtgaataatgttccactgtttttcaacatccgggatggtccttatatgccaaccttgcgtcttcttcatcaatatcctgatatcatgaaaaagttccaagtggacagaggtgctatcaaatttgtgctctctggcgcaaacataatgtgtcctggattgacatcaccaggtggtgtcttggatgatgaagtcgaggaggaaacaccagtggctataatggcggaaggaaaacaacatgcactggcaattgggtttacaaagatgtcagcgaaggacataaggaccatcaacaaagggattggagttgacaatatgcactatctaaatgatggcctatggaagatggagaagctggaatgaggataattcagtgaggggtgctgagcttgcgttattctcgtattgagatgtaaggaccagtagaattatgtatctgcacagctggttttg

SEQ ID NO: 45978 - protein, 181 aa, Panicum virgatum; identical to SEQ ID NO: 31980
  misc_feature: Ceres CLONE 2028086
  misc_feature (92)..(170): Pfam Name: PUA Pfam Description: PUA domain

SEQ ID NO: 45979 - DNA, 702 bp, Panicum virgatum
  misc_feature: Ceres CLONE 2028093
  misc_feature: Encodes the peptide sequence at SEQ ID NO. 45980
aagaagaagacagctccagcgacgaagaggagggccaccaccaccacgatggtcatgatcacgaccacgaccacgatcacgaacacccccacagaggtgacaagaaagccaacaagggtgaaaagaagttcaagaaggccatgactaagtacggcatgaagcccgtcactggtatcaacagagttaccatcaagaagtccaaggctttcttcctctacatcgatgacccagaagtcttgaagagccctggcgcagataacacctacgttatcttcggtgaggccaagatccaagatttctccaaccttggagctgaaaatgaagctagaaacttcgcccctgaaaaggccgtccccactcaaactggtgaaaaggctgctgaaaagcccgctgaagaagaaaagggtgctgaagatgaaggtgaagaactcagtgaggaaggtcttgctgctgacactattgaaatggttatgagtcatactaagtgcaccagaagagaagctgttaaggctttgagagaaactaacggcgactccgttactgccattatcaacttgactaagtaaacagaattgacgttctgcaaagtttgtcatttgtgcagtttatttttaagtatataaaatgtattgttgttagtccttttgataaaacctggtttctcggcgtagaaatatcctgaaccctcagttcgacacaacg

SEQ ID NO: 45980 - protein, 187 aa, Panicum virgatum
  misc_feature: Ceres CLONE 2028093
  misc_feature (38)..(98): Pfam Name: NAC Pfam Description: NAC domain
EEDSSSDEEEGHHHHDGHDHDHDHDHEHPHRGDKKANKGEKKFKKAMTKYGMKPVTGINRVTIKKSKAFFLYIDDPEVLKSPGADNTYVIFGEAKIQDFSNLGAENEARNFAPEKAVPTQTGEKAAEKPAEEEKGAEDEGEELSEEGLAADTIEMVMSHTKCTRREAVKALRETNGDSVTAIINLTK

SEQ ID NO: 45981 - DNA, 350 bp, Panicum virgatum
  misc_feature: Ceres CLONE 2028116
  misc_feature: Encodes the peptide sequence at SEQ ID NO. 45982
aactaacgctaaaaaagtaacagtttctgtactttattggagttcctccatgaccaagggtaccacctcgcagggtgcgcgccacggccgcactcacatcctgtgccgccgctgcggctcgacgtcgtaccaccgccaatggaagcgctgctcggcgtgcggctacccggacgcgaagcgccgccgctacaactggtccgtgaagtcgatcaagcgccgcacgcccggcactggccgccagcgctacaccaaggtggtgaaccgccgcatcaagaaccacttccgcacgaccatcaaggcgtaagtgcggcggacccggaactctccttcatccccacgctttttgattg

SEQ ID NO: 45982 - protein, 84 aa, Panicum virgatum
  misc_feature: Ceres CLONE 2028116
  misc_feature (2)..(55): Pfam Name: Ribosomal_L37e Pfam Description: Ribosomal protein L37e
MTKGTTSQGARHGRTHILCRRCGSTSYHRQWKRCSACGYPDAKRRRYNWSVKSIKRRTPGTGRQRYTKVVNRRIKNHFRTTIKA

SEQ ID NO: 45983 - DNA, 412 bp, Panicum virgatum
  misc_feature: Ceres CLONE 2028161
  misc_feature: Encodes the peptide sequence at SEQ ID NO. 45984
ataaaagatacagtttctgtactttattgggattgccgccttcacaatgacccaacagctcgcctgcacctacgctgccatcatcctggccgacggtaagactgatgccgacaccctgatcgccgtcgccaaggccgctaaggtcgacgtgagcaagggcatggcctccgccttcgccgccctcctgaaggacgtcaaggtcgaggacgtgctgaagaacgtgagcttcggtggcggtgctgctgcccccgctggtgccgccgcacccgctgccgccgccgctgcccccaaggccgctgctgccgccgccgcccccgctgaggaggaggacgacgacttcggcatgggaggtctgttctaagcacttgctatgactaggcaatactcatcttcggttaccgttagttgaatc

SEQ ID NO: 45984 - protein, 104 aa, Panicum virgatum
  misc_feature: Ceres CLONE 2028161
  misc_feature (18)..(104): Pfam Name: Ribosomal_60s Pfam Description: 60s Acidic ribosomal protein
MTQQLACTYAAIILADGKTDADTLIAVAKAAKVDVSKGMASAFAALLKDVKVEDVLKNVSFGGGAAAPAGAAAPAAAAAAPKAAAAAAAPAEEEDDDFGMGGLF

SEQ ID NO: 45985 - DNA, 537 bp, Panicum virgatum
  misc_feature: Ceres CLONE 2028178
  misc_feature: Encodes the peptide sequence at SEQ ID NO. 45986
ggcgtctgctccccgcgcgcaccgcggcacccgctgctacacattcaatagctacagggatcagttcgatcatccaatcaacaaggatctaaaagttgatcccaaggatgagttccttgcaaccctgcgagcgatcattcgttgcttcacttgccctgacagatactttgagaaagtccttcgattggctcttggaggcatgggcacagatgaggatgatctcaccagggtcataactactcgcgccgaggtcgacctgaagctgattaaggaggcctaccagaagaggaacagcgtgccgctggagcgtgcagttgctaaagatacaaccagagactacgaggatattctcctcgcactgttaggagcagagtgaggaggcgtgtctcagcaccatctcatgtgttcctccttgtctaatgggaagatgaaactgcataaaagttctgaacgcatggttgtgtttctgaacaataataagttcgtgacctagcctgcatatatagcagtgctcgttaaataaaagatgttttcttg

SEQ ID NO: 45986 - protein, 124 aa, Panicum virgatum
  misc_feature: Ceres CLONE 2028178
  misc_feature (55)..(120): Pfam Name: Annexin Pfam Description: Annexin
ASAPRAHRGTRCYTFNSYRDQFDHPINKDLKVDPKDEFLATLRAIIRCFTCPDRYFEKVLRLALGGMGTDEDDLTRVITTRAEVDLKLIKEAYQKRNSVPLERAVAKDTTRDYEDILLALLGAE

SEQ ID NO: 45987 - DNA, 726 bp, Panicum virgatum
  misc_feature: Ceres CLONE 2028187
  misc_feature: Encodes the peptide sequence at SEQ ID NO. 45988
atcaacgccggctagtggtggatcgatgacgcctcccacggcccgcgtcctggccgccgcggccctcgtcgcggcgctcgcgctgagcgtccccggcgccggtgccaccccggagacgacgtgcgcggcggcggcggcccgcgaccgtcgcgtggactacggcttctgcgtggcgcggctgagccaccaccacgacagccccgacgcggacacctggggcctggcgaaggtggccgccgacgtgggcatcgccaccgcgggggacgcggtctacgacatcaaggccctgctcgccgccaagccgcccggcggcgacgccgacgccaaggcgcgggcggcgctggagcagtgcaaggggctgtacgacgcggcggagatggcattcgcggaggcctacgacggcatcaaccggcgcgactacgcggccggaaaggcggaggccgcggagggggcgtccctggcgcgccggtgcggcggcgccttcgcgctggccggcgccgcgccgccgccgcaggtcgcgcggtggggcgaggagtccgccaagatcgccgtcgtctgcgaggccatcaccgacctcatcaagtgacgggggttctgcttctgcacttctgctgcatgcgtcggttacttacaacccgcggtcgacatggcagttaaccgcgagagttgtcgtcgccggaaaatggtgatggaataatagaagcgtttcgtttccccttgctgctc

SEQ ID NO: 45988 - protein, 186 aa, Panicum virgatum
  misc_feature: Ceres CLONE 2028187
  misc_feature (23)..(181): Pfam Name: PMEI Pfam Description: Plant invertase/pectin methylesterase inhibitor
MTPPTARVLAAAALVAALALSVPGAGATPETTCAAAAARDRRVDYGFCVARLSHHHDSPDADTWGLAKVAADVGIATAGDAVYDIKALLAAKPPGGDADAKARAALEQCKGLYDAAEMAFAEAYDGINRRDYAAGKAEAAEGASLARRCGGAFALAGAAPPPQVARWGEESAKIAVVCEAITDLIK

SEQ ID NO: 45989 - DNA, 627 bp, Panicum virgatum
  misc_feature: Ceres CLONE 2028189
  misc_feature: Encodes the peptide sequence at SEQ ID NO. 45990
gccggcggcgtcttcttcaacttctgggtgctcttccacctctaccccttcgccaagggcatcctggggaggcacggcaagacccccgtggtggtgctcgtctggtgggccttcaccttcgtcatcaccgccgtgctctacatcaacatcccccacatccacgggcccggcggcaagcacgcccacggcggcgccatgggcaggcacgcccaccaccacgccggcaataacaagttccaggagatctacggctggccgtaggctcagctcgcgacctgctgcacattacgccctgaccgtcaagacgacaagagtacgttccgttccgttccagtccattccattccattacgctctgctgctgctgctacatacaacatgcgaccgacgacgtacccgccaccacaatttgatctttctttggttctttttttttctagttttgtccagaaattgaaagatggtgttgatttgatttagttctttttttcaattaattaccgtacccgtggtaattaatcatgtacctactacttatatatacattacgccaagaggaagagggatcatcatcacttgtaagtgaggaggagggagtgtgagatgagctggagggtgagtggggcc

SEQ ID NO: 45990 - protein, 86 aa, Panicum virgatum
  misc_feature: Ceres CLONE 2028189
  misc_feature: SWISSPROT Homolog: EC 2.4.1.12 Cellulose synthase (UDP-forming)
AGGVFFNFWVLFHLYPFAKGILGRHGKTPVVVLVWWAFTFVITAVLYINIPHIHGPGGKHAHGGAMGRHAHHHAGNNKFQEIYGWP

SEQ ID NO: 45991 - DNA, 699 bp, Panicum virgatum
  misc_feature: Ceres CLONE 2028203
  misc_feature: Encodes the peptide sequence at SEQ ID NO. 45992
actcagcaatgaccatgaagagtgttggcagtgcagcactcaagatggttgaggaagtccgcaggcagttcaacaccatccctgggctcatggagggcaccaccaagcctgactatgcaacgtgtgtcaagatctccactgatgcatccatcaaggagatgatccccccaggtgcacttgtcatgctcacccctcttattgttgggatcttgtttggtgttgagaccctctctggagttcttgctggtgctcttgtttctggtgtccagattgccatctctgcatctaacactggaggtgcctgggataatgcaaagaaatacatcgaggctggtgcatctgagcatgcaagaaccctaggcccgaaaggctcagccccacacaaggctgccgtcatcggtgacaccattggtgatcccctcaaggacacctcaggaccctcactgaatatcctcatcaagctcatggccgtcgagtccctggtctttgctcccttcttcgccacccatggaggcatcctattcaaatggctttagaggaagattgatgggtcggctactttaattttgccggggagagcactagatttatctatgccatagagaagtttcagtttacccatatagtgcctttcttcatttctgtctcacctgtactgtattacgtcatgttgaaacctacaagccaccaagttttcgg

SEQ ID NO: 45992 - protein, 177 aa, Panicum virgatum
  misc_feature: Ceres CLONE 2028203
  misc_feature (1)..(163): Pfam Name: H_PPase Pfam Description: Inorganic H+ pyrophosphatase
  misc_feature: SWISSPROT Homolog: EC 3.6.1.1 Inorganic diphosphatase
  misc_feature: Functional homolog of the protein sequence given in SEQ ID NO 50264
  misc_feature: Useful for making plants with modulated water use efficiency
SAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSAPHKAAVIGDTIGDPLKDTSGPSLNILIKLMAVESLVFAPFFATHGGILFKWL

SEQ ID NO: 45993 - DNA, 426 bp, Panicum virgatum
  misc_feature: Ceres CLONE 2028210
  misc_feature: Encodes the peptide sequence at SEQ ID NO. 45994
agagagagagagagagagagagagagagagagcgaaaccctagctcgcggctcgccggatggaccctcagcagccggaaccggtcagctacctctgcggagattgtggagccgagaacacgctgaagccgggtgatgtgatccagtgccgcgagtgtggctaccgcatcctctacaagaagcggacccgccgaattgtccaatatgaagcgcgctgaagaaaagggggcaacatcctgtgctgttggcggtgcctcaagcagtgtaacaggccgcctgggagaaggaatgactagtggtgattcgtatggtactaggttgtaaccgtgcactggactgcacctggaagcgttgaaacactctgaaatatggatggatgtcagacacttcacaagtattgaaatagcttatgatttgctgggaaccc

SEQ ID NO: 45994 - protein, 52 aa, Panicum virgatum; identical to SEQ ID NO: 17825
  misc_feature: Ceres CLONE 2028210
  misc_feature (11)..(42): Pfam Name: DNA_RNApol_7kD Pfam Description: DNA directed RNA polymerase, 7 kDa subunit

SEQ ID NO: 45995 - DNA, 432 bp, Panicum virgatum
  misc_feature: Ceres CLONE 2028212
  misc_feature: Encodes the peptide sequence at SEQ ID NO. 45996
atgggacactccaacgtgtggaactcgcacccgaagaactatggccctggatccagggtttgccgtgtgtgcgccaacccccacggcctgatccggaagtacgggctcatgtgctgcaggcagtgcttccgcagcaacgccaaggacatcggattcatcaagggacggccaaaaccttccggcccttgcttccttccctgcaacatagtaccgctaaaaacttgagaggtccgaagcatcacgagaatgggagcatggatgaggagcatcttctgcccgtcttttgctaagtactgtgataatcataacatgtaatgaattatttgggtttgaaatggaccaaatcgtattctggctggcactctagtgcaccctagttgagcatgttgaaccgctattatcagactaataaaatattgttactattgaggc

SEQ ID NO: 45996 - protein, 74 aa, Panicum virgatum
  misc_feature: Ceres CLONE 2028212
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency
MGHSNVWNSHPKNYGPGSRVCRVCANPHGLIRKYGLMCCRQCFRSNAKDIGFIKGRPKPSGPCFLPCNIVPLKT

SEQ ID NO: 45997 - DNA, 720 bp, Panicum virgatum
  misc_feature: Ceres CLONE 2028213
  misc_feature: Encodes the peptide sequence at SEQ ID NO. 45998
agcgttttccactctgctatccctatccgtatcccaatcccctgtaaccgctccattcttggaagccccggagagcggagacggtcccatcccagcgcccgcgcggcctcgaggtcccagcccaaagatggcaactttgacacctccagttctctgcaacttcctggccatcgcacagaacaacacccttccgctgaacaagagcacgaaccggcccctgcagctgagcttccgcaggagcacgccggcattgccgggcttcagagcgaggcaagacgtctgcgtcgccgccgtccacaaggtgaagctcatcgggccggaggggaaggagagcgtgatcaaggtgccggaggacagctacatcctggacgcggccgaggaggccgggctcgacctgccctgctcctgccgcgccggcgcctgctcctcgtgcgccggcaaggtcctgcagggctccgtcgaccagtcggaccagtcgttcctcgacgacgagcaggtcggcgccgggtacttgctcacctgcgtcgcgtacccgacctccgactgcgtcatccagacgcaccgggaggcggacctgtactagctagtagcccggtgtcactccccacagctccattcagattcgatctcgagttctcttgacattgcgattcgcatctgtagttgtcgctggatctacgtaattttggcacgagcaaactgtaggtgcccgtgtgatgg

SEQ ID NO: 45998 - protein, 151 aa, Panicum virgatum
  misc_feature: Ceres CLONE 2028213
  misc_feature (62)..(138): Pfam Name: Fer2 Pfam Description: 2Fe-2S iron-sulfur cluster binding domain
MATLTPPVLCNFLAIAQNNTLPLNKSTNRPLQLSFRRSTPALPGFRARQDVCVAAVHKVKLIGPEGKESVIKVPEDSYILDAAEEAGLDLPCSCRAGACSSCAGKVLQGSVDQSDQSFLDDEQVGAGYLLTCVAYPTSDCVIQTHREADLY

SEQ ID NO: 45999 - DNA, 627 bp, Panicum virgatum
  misc_feature: Ceres CLONE 2028222
  misc_feature: Encodes the peptide sequence at SEQ ID NO. 46000
aatccctaaattgcaaaattgaatccgccccccccccccaccacacccacacccacacaatcaagaaccttagggccgaccgcggcgcccagcggctgccatcctgcctccacgcccgcgggaggcttgcagcatggcgagggtgacgcttgctacgaccggcacgtttgtgctggccgtggcgctggcgctgacgctggcggcgccgccggccatctgcatcgagttcacggcggaggatatggagtctaacgactccatgtgggccctgtacgagcgctggagcgcgcactacgaggtggcgcgcgacgccggcgacaagctccggcgcttccgcgtcttcaaggagacggcgcgcagcgtctacgcccgccacctaggggacagacactacatgctcggcctcaacagcttcgctgacatgacgatggacgagttcagggacgccttcgcctgcaagaggcccgccaatggcggggagcgtcacttcgacatcacgcagcaagttcggtgcggttaagattggtcagcatgcacctaatccatcaaagattacccatgtctaatgaatgaaaatcagtactctgtaactcatattgctatctggataaaacaaagttacatggg

SEQ ID NO: 46000 - protein, 128 aa, Panicum virgatum
  misc_feature: Ceres CLONE 2028222
  misc_feature (47)..(102): Pfam Name: Inhibitor_I29 Pfam Description: Cathepsin propeptide inhibitor domain (I29)
  misc_feature: SWISSPROT Homolog: EC 3.4.22.14 Actinidain
MARVTLATTGTFVLAVALALTLAAPPAICIEFTAEDMESNDSMWALYERWSAHYEVARDAGDKLRRFRVFKETARSVYARHLGDRHYMLGLNSFADMTMDEFRDAFACKRPANGGERHFDITQQVRCG

SEQ ID NO: 46001 - DNA, 780 bp, Panicum virgatum
  misc_feature: Ceres CLONE 2028235
  misc_feature: Encodes the peptide sequence at SEQ ID NO. 46002
aactccccaccccaggtcgcagtcagtcccagcactcgccccccaacactccgcccgcctgagctagggtttccgcaccgcgatcgatccaagctgcatccatgtccaccgcggcggcgcagggcggcgacaagccggcgctccgcaagcccgtcttcaccaaggtcgaccagctcaggccgggcaccaacggccacaccctcactgtcaaggtcgtcagcgccacccccgtccctggacgcgcgcgcccaggagcgaccgccaccgcatccccccgcgcgccacgcatcgccgagtgcctcgtcggggatgagaccggcgccatagtcttcacagcccgcaacgaccaagttgatttgctgaagcctgatgccaccgtgatcttgcgcaatgctaaaattgacatgttcaaaggatcaatgaggcttgcagttgataaatgggggcggattgaggctacagaacctgccagcttcacagtgaaggaggacaacaacctgtcactagtagagtatgaattggttaatgtggctgagtaattggccaagcgtttctgccccttttccgtgccataagaaggaagtaccatgaatgaacatcataaagcctctctaagcgagtttatttgttacagtagtacagtagtagataattacggtgaaggttgtatcgctgctttccattcatcttgttactgcctgtgttgctgcactcgctggagatgagtggcgtctttttttttttttggcgatgctaatgattgaagatgagcgacccgtt

SEQ ID NO: 46002 - protein, 145 aa, Panicum virgatum
  misc_feature: Ceres CLONE 2028235
  misc_feature: Functional homolog of the protein sequence given in SEQ ID NO 50161
  misc_feature: Useful for making plants with modulated drought sensitivity
  misc_feature: Useful for making plants with modulated water use efficiency
MSTAAAQGGDKPALRKPVFTKVDQLRPGTNGHTLTVKVVSATPVPGRARPGATATASPRAPRIAECLVGDETGAIVFTARNDQVDLLKPDATVILRNAKIDMFKGSMRLAVDKWGRIEATEPASFTVKEDNNLSLVEYELVNVAE

SEQ ID NO: 46003 - DNA, 633 bp, Panicum virgatum
  misc_feature: Ceres CLONE 2028263
  misc_feature: Encodes the peptide sequence at SEQ ID NO. 46004
cttttagcttcgatatagtccaacaatgagcgccgaagaacagaaggttaccaagaaccccatgcgcaacctccaaattgagaagttggttctcaacatttgtgttggtgagtctggtgatagacttactcgtgctgccaaggttcttgaacaattgactggtcaaactcccgtctactccaaggctcgttacactgtccgtactttctctattcgtcgtaacgaaaagatttccgttcatgtcactgtccgtggtcctaaggccgaagagatcctcgaacgtggtttgaaggtcaaggaatacgaactcaaggcccgtaacttctctcaaaccggtaactttggtttcggtattgatgaacacattgatttgggtatcaagtacgatccttccattggtatctacggtatggactactacattgtcatgggccgtcccggtaaccgtgtctctcgcagaaagcactgtaaggccaaggtcggtgtcaagcaccaaatcaagaaggaagaagctatggaatggttcaagcaacgtttcgatggtgtcatctcctacaaggcttaattttcccccacctttttttttatatatatatataataaaaaacaatccagagatcatttatatacttc

SEQ ID NO: 46004 - protein, 179 aa, Panicum virgatum
  misc_feature: Ceres CLONE 2028263
  misc_feature (68)..(167): Pfam Name: Ribosomal_L5_C Pfam Description: ribosomal L5P family C-terminus
  misc_feature (11)..(64): Pfam Name: Ribosomal_L5 Pfam Description: Ribosomal protein L5
MSAEEQKVTKNPMRNLQIEKLVLNICVGESGDRLTRAAKVLEQLTGQTPVYSKARYTVRTFSIRRNEKISVHVTVRGPKAEEILERGLKVKEYELKARNFSQTGNFGFGIDEHIDLGIKYDPSIGIYGMDYYIVMGRPGNRVSRRKHCKAKVGVKHQIKKEEAMEWFKQRFDGVISYKA

SEQ ID NO: 46005 - DNA, 642 bp, Panicum virgatum
  misc_feature: Ceres CLONE 2028265
  misc_feature: Encodes the peptide sequence at SEQ ID NO. 46006
atcgtcaagtcgcatttccgcaaccacattcacaatggccaagctttcacgtggtgcccctggtgggaaggtgaagatgaccctcggtcttcccgttggtgctatcatgaactgcgcggacaactcgggcgcgcggaacctctacattatctcagtcaagggcatcggtgcccgcctgaacaggctgcccgccggtggtgtcggcgacatggtgatggcgacggttaagaagggaaagcccgagctccggaagaaggtccacccggcagtcatcgtccgccaggccaagccctggaagcgcttcgacggcgtcttcctctacttcgaggacaacgctggtgtgattgtcaaccccaagggtgagatgaaaggctccgccatcaccggccccgtcgggaaggaggccgccgagctctggccccgtattgccagcaactctggtgttgtgatgtgagagggtttctcgcgggagcgatgggtcattggcatgcggaatttcgagggacggatgagaaggacaggatgagggccgcaaaaggctcgggctggatcggcaggcttgcatttctggctgcggcgtgctagggagtcataccactgcatgatatacaggtcaattcggaattcgttcttcgaacctgg

SEQ ID NO: 46006 - protein, 139 aa, Panicum virgatum
  misc_feature: Ceres CLONE 2028265
  misc_feature (18)..(139): Pfam Name: Ribosomal_L14 Pfam Description: Ribosomal protein L14p/L23e
  misc_feature: Functional homolog of the protein sequence given in SEQ ID NO 50297
  misc_feature: Useful for making plants with modulated biomass
  misc_feature: Useful for making plants with modulated heat sensitivity
MAKLSRGAPGGKVKMTLGLPVGAIMNCADNSGARNLYIISVKGIGARLNRLPAGGVGDMVMATVKKGKPELRKKVHPAVIVRQAKPWKRFDGVFLYFEDNAGVIVNPKGEMKGSAITGPVGKEAAELWPRIASNSGVVM

SEQ ID NO: 46007 - DNA, 674 bp, Panicum virgatum
  misc_feature: Ceres CLONE 2028290
  misc_feature: Encodes the peptide sequence at SEQ ID NO. 46008
atcccatctccatctcccatcaactgccactcgctaccagccgatctctagcgctttagccttcagccagccgatctttcagagttgatctttcagagtcagagagcaagatcaaaggaaagatgtcgactgtgagccgtgcctccctggaccagaagcttgccatggccaagcgctgctctcgagaggcaaccattgcaggaactaaggcggcagctgtggcaaccgtcgcctctgcgattccaactctggcgagcgtgaggatgctgccatgggcgaaggccaacatcaaccccaccggccaggccctcatcatctccacagttgccgggatggcctacttcatcgcggccgacaagaagatcctgtcgctggcgaggcgccactcgtatgaggaagcgcccgagcacctcaagaacacatccttccaaggaaccggccgcccgcacccagctttcttcaggccatgagacaattatggagctcttcttcagtactcagtaccctctagtactatacatgccgtcgtcccgttgatgatgtctgaataaactaccagtcccagctattagcccactaatcctagagggccccggcctgtaattagtttgtactgttggtgatccaattcaaagggaatgaaacttgatgctgctgatcatcactgaagtttc

SEQ ID NO: 46008 - protein, 115 aa, Panicum virgatum
  misc_feature: Ceres CLONE 2028290
  misc_feature (11)..(89): Pfam Name: ENOD93 Pfam Description: Early nodulin 93 ENOD93 protein
MSTVSRASLDQKLAMAKRCSREATIAGTKAAAVATVASAIPTLASVRMLPWAKANINPTGQALIISTVAGMAYFIAADKKILSLARRHSYEEAPEHLKNTSFQGTGRPHPAFFRP

SEQ ID NO: 46009 - DNA, 677 bp, Panicum virgatum
  misc_feature: Ceres CLONE 2028299
  misc_feature: Encodes the peptide sequence at SEQ ID NO. 46010
agcgagagagatggagcagcagcagcgcgacggcgatggcggcgcggcggaggcggacatcgagcggctccccgccgacctcctcgcgcacgtcctctccctcctccccaccttccgcgacctctccatggcggggggagtgagccggagatggcgccgggcggtggagcggtcgctggcgtcgcggcggcggctgagcttcgcggggcagcgcaccggcgacgacaccgccgcgcgcctcgtccgcgccgccgtcaacctccgcgacctcgacatctgctggggctgccaaatcaccgacgaaggcttgatcaagatttcgtccgcggattgcgtcgggaacctcacgtccatatcgctgtgggggttggctggaattacggataaaggcgttgtccagctggtttcaagggcttattctctgcagcacctgaatattggtgggacattcatcacagacgaatccctgaatgcagtcgcaaatagctgcacaaatctgaagagcatcatcctgtggagctgccgccacgtgacggaggccgggctggtggcgctggtgaataagtgccggcggctggagtgcatcaacgtgggcggcatgcgggtgccgccggagagcttcgtgggcctgctctccatcagccccgccctgcggatcaggtccatccccccagatc

SEQ ID NO: 46010 - protein, 222 aa, Panicum virgatum
  misc_feature: Ceres CLONE 2028299
  misc_feature (15)..(63): Pfam Name: F-box Pfam Description: F-box domain
MEQQQRDGDGGAAEADIERLPADLLAHVLSLLPTFRDLSMAGGVSRRWRRAVERSLASRRRLSFAGQRTGDDTAARLVRAAVNLRDLDICWGCQITDEGLIKISSADCVGNLTSISLWGLAGITDKGVVQLVSRAYSLQHLNIGGTFITDESLNAVANSCTNLKSIILWSCRHVTEAGLVALVNKCRRLECINVGGMRVPPESFVGLLSISPALRIRSIPPD

SEQ ID NO: 46011 - DNA, 858 bp, Panicum virgatum
  misc_feature: Ceres CLONE 2028304
  misc_feature: Encodes the peptide sequence at SEQ ID NO. 46012
gatcggccggcggcagcagaggagagcgagccgaggacgaagaagcttccgagaaacctccctagctcccctgctgagcttgagactgagactgagagtgacaaagagccatccatgtccacggcttagcttagcttagctagccaccccacccaactcatcctatgatcctaagctaataagatccagcagcgaagagaagaagggaccgctggcgatcgagatggcgccgccgacagtaccgccaccccgcggcgaccggcacgcggcgtcagagtcggcttccgtgcaggcgatgtcgtccctgttctggggcgaccgcgcggtggtgctgttcccgggctggcccggcgcgcgcggcctcgggtcatacctcctctgcctcctcttcgtgctcgccctcgccgcgctcgccgaggcgctccacgcggtgtccgcctacgtcgcccaccgccgccgcggcagcgcccttgcccccgcggtgctgctgacggcggtccacgcggcgcggatgggcgcggcctacctgctgatgctggccgtcatgtcgttcaacggcggcgtgctcctggccgccgtggccggccacgcgctcggcttcctcctcacccgtagctgggccaccagggcgtcggcggagctggagcctggacatggagccggggccggcggtggcgcccgtggccgtggccgcgacctcggccctcccggggatgacgccgccaaggcctagattacggtgcaaatcaataggaaatgtctttttctttggtagataataatgaatccatgtccttttcctctgtgtgtgatatatttgaagaaaaaaataaaaacttgaggtcggaattttgtctt

SEQ ID NO: 46012 - protein, 169 aa, Panicum virgatum
  misc_feature: Ceres CLONE 2028304
  misc_feature (23)..(137): Pfam Name: Ctr Pfam Description: Ctr copper transporter family
MAPPTVPPPRGDRHAASESASVQAMSSLFWGDRAVVLFPGWPGARGLGSYLLCLLFVLALAALAEALHAVSAYVAHRRRGSALAPAVLLTAVHAARMGAAYLLMLAVMSFNGGVLLAAVAGHALGFLLTRSWATRASAELEPGHGAGAGGGARGRGRDLGPPGDDAAKA

SEQ ID NO: 46013 - DNA, 688 bp, Panicum virgatum
  misc_feature: Ceres CLONE 2028331
  misc_feature: Encodes the peptide sequence at SEQ ID NO. 46014
accgtgccatgcgcgcgctgctcctcttccaccagctcctcccaagatcacaacaccttctccgtccatcagccagtagtagtagaggagccgcgctcgattccttcgcggccaggtcttggggtagtagagctagggcgatcaggccgtcgccgccgccgccggtccgcgccatggcgtcgcagcagcagttcccgccgcagcagcaggggtcccagcccgggaaggagcacgccatggacccccggccggaggccatcgtccagaactacaagtcggcggagaaactcaagggcaaggtggctctggtgaccggcggcgactccggcatcgggcgcgcggtgtgcctgtgcttcgcgctggagggcgcgacggtggccttcacctacgtcaagggccacgaggaccgggacgccgaggagaccctgcgggcgctgcgcggcatccagtcccgcacgggcgcccgcgacccgatggcggtggccgccgacctgggctacgaggagcactgccgccgcgtggtggaggaggtcgccggcgcctacggcgggcgcatcgacgtgctggtgaacaacgccgccgagcagtacgagcggccgtcgctggcggaggtgacggaggcggacctggaccgcgtcttccgcaccaacatcttctcctacttcctggtgaccaagcacgcgctgcg

SEQ ID NO: 46014 - protein, 171 aa, Panicum virgatum
  misc_feature: Ceres CLONE 2028331
  misc_feature (42)..(171): Pfam Name: adh_short Pfam Description: short chain dehydrogenase
  misc_feature: SWISSPROT Homolog: EC 1.1.1.100 3-oxoacyl-[acyl-carrier-protein] reductase
  misc_feature: The sequence is a functional homolog of SEQ ID NO 2 in US patent 7189890
MASQQQFPPQQQGSQPGKEHAMDPRPEAIVQNYKSAEKLKGKVALVTGGDSGIGRAVCLCFALEGATVAFTYVKGHEDRDAEETLRALRGIQSRTGARDPMAVAADLGYEEHCRRVVEEVAGAYGGRIDVLVNNAAEQYERPSLAEVTEADLDRVFRTNIFSYFLVTKHAL

SEQ ID NO: 46015 - DNA, 456 bp, Panicum virgatum
  misc_feature: Ceres CLONE 2028333
  misc_feature: Encodes the peptide sequence at SEQ ID NO. 46016
tacggcgctggcatcggcccaggtgtctatgacatccactctcccaggatcccatctaccgaggagatcgctgaccgtattaacaagatgcttgccgtgcttgacaccaacatcctatgggtgaaccctgactgtggtctcaagacccgcaagtacacagaggtgaagcccgccctgaccaacatggtttctgcaaccaagctcatccgcacccagcttgccagcgcgaaatgagttgtttgttagctccacggtttgttgatcacaaagccaacagggccaattgtttttgaataatttgggtctcatccctgttccatggttaggttagtctcattggtatggtatgctgttatagttgtattctatgtttggtgtgtcttttcttttaggctgttttcaggcatgagctttgggtataaacagaaatgaaatatgcagtcctcaaattgcatc

SEQ ID NO: 46016 - protein, 77 aa, Panicum virgatum
  misc_feature: Ceres CLONE 2028333
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
YGAGIGPGVYDIHSPRIPSTEEIADRINKMLAVLDTNILWVNPDCGLKTRKYTEVKPALTNMVSATKLIRTQLASAK

SEQ ID NO: 46017 - DNA, 566 bp, Panicum virgatum
  misc_feature: Ceres CLONE 2028354
  misc_feature: Encodes the peptide sequence at SEQ ID NO. 46018
aaaaaaagcttctgcctcctctctccacacgacttctcccgccgccgccgccgtcgcagcagtcgccgtgaccagcaaccggacaaaggtggctgatctcgctccctgccgtgctcgctcgcaacactgcctgccagctagccagccctgccagccagccaactgaacaggagctttgtgggcagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggtcgcgccagttgttggccattcctgtactgctttcgtatcaagttattgaacaatgctaccttgtcctttgagtaggctatggagaatgggcttaagcaatcgaattgtaatttaagcactcgtcttattgcaagttttggtctgttattgcctgaatgaatttaagtgc

SEQ ID NO: 46018 - protein, 65 aa, Panicum virgatum; identical to SEQ ID NO: 9766
  misc_feature: Ceres CLONE 2028354
  misc_feature (1)..(65): Pfam Name: Ribosomal_S28e Pfam Description: Ribosomal protein S28e

SEQ ID NO: 46019 - DNA, 667 bp, Panicum virgatum
  misc_feature: Ceres CLONE 2028359
  misc_feature: Encodes the peptide sequence at SEQ ID NO. 46020
tggtaaattcattgtgaggagggccaggcaaccagtggtaatatctcagaggcgtccagtaactcaagaagagaaggaccttgctcttaaaagggctaaggaatttaaatcagagaatccttttgccgtgcaaacaatgatggaatcttatgtctatgtgggatttttcatgaacatcacatgcgaatttgtcagagaatcacttcctcggacaagcaagaagatgacgctctgggatcccctagggaagccttgggaagttaactatgtttactatagcggccgctcggtcgcctctttcagcggtggctggggtaaatttgctctaggaaacaatctggagaagtttgatgtttgtgtctttgaacttttcaaggaggacaacattagagtgcacatctacagggttgtctccgagataaccccgctcctccgtgccagcagtaaagactagggtgtcattcgcacgttggagagtgcgatcccgtcgacctgtggctagagaataagaacactggtcactcattcacatgctggaaagtgcttctatgctccttgaagagggagagcttcacaaaaataagtgacaataaacataacatatgttgtaccggttaaatatgtcgttgtgaacctattatggtaatttgatgtgcccctgttaatt

SEQ ID NO: 46020 - protein, 150 aa, Panicum virgatum
  misc_feature: Ceres CLONE 2028359
  misc_feature (54)..(139): Pfam Name: B3 Pfam Description: B3 DNA binding domain
GKFIVRRARQPVVISQRRPVTQEEKDLALKRAKEFKSENPFAVQTMMESYVYVGFFMNITCEFVRESLPRTSKKMTLWDPLGKPWEVNYVYYSGRSVASFSGGWGKFALGNNLEKFDVCVFELFKEDNIRVHIYRVVSEITPLLRASSKD

SEQ ID NO: 46021 - DNA, 601 bp, Panicum virgatum
  misc_feature: Ceres CLONE 2028369
  misc_feature: Encodes the peptide sequence at SEQ ID NO. 46022
gaggcatgcagatcttcgtgaagaccttgaccggcaagactatcaccctcgaggtggagtcctccgacaccattgacaacgtcaaggcaaagatccaggacaaggatggccgcacccttgcggactacaacatccagaaggagagcaccctccacctggtgctccgcctgaggggagggatgcagatctttgtgaagaccttgactggcaagactatcactcttgaggttgagagctccgacaccattgacaacgtgaaggccaagatccaggacaaggagggcatccccccggaccagcagcgtctgatcttcgccggcaagcagctggaggatggccgcactcttgcggactacaatatccagaaggagtccactctccacctggtgcttcgtctccgtggtggccagtaagccatcggtcgtctaagctgctgctgtacctgggtctcctggtctctgccatgaagggtgtcgtcttttaagtatctgtgtcatttgacgtcgaatttgtgtatggtttcatgaactggttgtctacctaaaacagttattgcagtgcagcagtatggcttaagcatgaataaatgatgtttgaactt

SEQ ID NO: 46022 - protein, 136 aa, Panicum virgatum
  misc_feature: Ceres CLONE 2028369
  misc_feature (65)..(133): Pfam Name: ubiquitin Pfam Description: Ubiquitin family
  misc_feature (7)..(57): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
GMQIFVKTLTGKTITLEVESSDTIDNVKAKIQDKDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 46023 - DNA, 590 bp, Panicum virgatum
  misc_feature: Ceres CLONE 2028409
  misc_feature: Encodes the peptide sequence at SEQ ID NO. 46024
caccatcgcccttccctcggtaaggaatccctacctcgatccgtctcagctccgcaagaatatctcttttccgcgccgggagcatttagatcgggggtcgttcttgcgaggatccatccgagatccattctttttcccccctcctcttcttggaacaccacatctcgctcacccggatcttggttcttggttcgtggcagaggatggattggcaggggcagaagctcgcggagatgctgatgcaggtgctgcttgtggcgtcggccgtggcggcgttcctggcgggctacgtgcgcggggacttccagctcatgctgctcgtctacgccgctggcgtcgtgctcacggcgctcgtcaccgtccccaactggcccttcttcaaccgcaacccgctcaagtggctcgacgccgccgaggccgagcgccacccgcgcccgcaggtcagcgccaccggcgcgggggcagggggtaagaagaagtccgggaagaacaagtagttggtctttcagaggcaatatgtgttgtcggcccatatgactcgacttgttttggtactgttttcagctatatatgacattgaaatattagac

SEQ ID NO: 46024 - protein, 97 aa, Panicum virgatum
  misc_feature: Ceres CLONE 2028409
  misc_feature (1)..(80): Pfam Name: SPC12 Pfam Description: Microsomal signal peptidase 12 kDa subunit (SPC12)
MDWQGQKLAEMLMQVLLVASAVAAFLAGYVRGDFQLMLLVYAAGVVLTALVTVPNWPFFNRNPLKWLDAAEAERHPRPQVSATGAGAGGKKKSGKNK

SEQ ID NO: 46025 - DNA, 716 bp, Panicum virgatum
  misc_feature: Ceres CLONE 2028417
  misc_feature: Encodes the peptide sequence at SEQ ID NO. 46026
gagaacctgcacatcacaacgatccgcctgtcgacgacgacgcagagaaaccgccaaaatgaccaagggtacctccagcttcggcaagcgccacaacaagacccacggtctctgcagacgctgcggccgccggtctctccacaaccagaagaaggtctgcgctgggtgcggctaccccgctgctaagatccgcaagtacaactggtccgagaaggcgaagcgcagaaaggtcaccggtaccggccgcatgcggtacctcagcacagtctcgaggaagttcaagaacggcttccagaccggtgtgcccaagggcgctcagggccccacggtttcggcttcttcataatcggttatcatgacagacgggggcatggacaatgggatgggtcaattccggcaagcgatgtaacatggatcgaacaatattcggacgggcctactcgctttttgctggaataccacaaatggcatgatttcgcgcgcgcggggctcgattcagtggtcaatgcatcgagcacaggtcatgaaaacggcgtaacgtttgggatcaatcacactgcttcttttttggccaagtttcttgtgcaggggcaaaagaagaggatctctgaaggcgcaagcacagccggcaaaccagccgagtcaggctagtcccagtcttcagcaagctagtagcgaggaaaacagatgtgactctcagattatgaggggtatcg

SEQ ID NO: 46026 - protein, 95 aa, Panicum virgatum
  misc_feature: Ceres CLONE 2028417
  misc_feature (2)..(55): Pfam Name: Ribosomal_L37e Pfam Description: Ribosomal protein L37e
MTKGTSSFGKRHNKTHGLCRRCGRRSLHNQKKVCAGCGYPAAKIRKYNWSEKAKRRKVTGTGRMRYLSTVSRKFKNGFQTGVPKGAQGPTVSASS

SEQ ID NO: 46027 - DNA, 463 bp, Panicum virgatum
  misc_feature: Ceres CLONE 2028418
  misc_feature: Encodes the peptide sequence at SEQ ID NO. 46028
gactgagaacactccagatgatcctcgccagaggaagccagacatcacaaaggccaaggaagttcttgggtgggagcccaaggtcgtcctgcacgacggtttggtgctcatggaggatgatttccgggagcgcctggcggtgcccaagaagactaaggcctaaaccgccctgcttttgcctaaaccgccctgcttttggcgagaaggatatccaagggggggagcatactcatagttgggttcgtcattattcgtggccacatttcattacggaatttgagttccaataaactgaatacacctttgtcgttcaccttgaaagattgtactattagaattcccatacagggccggccgttttgcgtctctctgctcccgcagatcttgtggtacttgtgtttgtagcctgtgtactccctgaatcgattatagcaatgttgatgccattttgagcttttgttcc

SEQ ID NO: 46028 - protein, 53 aa, Panicum virgatum
  misc_feature: Ceres CLONE 2028418
  misc_feature: SWISSPROT Homolog: EC 4.1.1.35 UDP-glucuronate decarboxylase
  misc_feature: Functional homolog of the protein sequence given in SEQ ID NO 51574
  misc_feature: Useful for making plants with altered carbohydrate content
  misc_feature: Functional homolog of the protein sequence given in SEQ ID NO 51713
  misc_feature: Useful for making plants with altered cell wall content and/or composition
TENTPDDPRQRKPDITKAKEVLGWEPKVVLHDGLVLMEDDFRERLAVPKKTKA

SEQ ID NO: 46029 - DNA, 371 bp, Panicum virgatum
  misc_feature: Ceres CLONE 2028432
  misc_feature: Encodes the peptide sequence at SEQ ID NO. 46030
gacgcgcacgcgctcgcgctcgcgctcgcgctccgatccccaggctagcgagggcctcggctgtccgctccccctagcccaacgaccccggtcgagcctgttgcatgctgcgcggtcgccgcccgtgagcctgatcgatggcgtcggcggaggcgcgccgcctcgcggtcgtgccgcagctagatatcgagcagatactgaaggaggctcaacaccgttggttacgccctgctgaaatatgtgaaatacttaaaaactacaggaacttccgtattgctccagaaccaccaaacaggccaccaagtggttcactttttttatttgatcggaaagtattgaggtacttcaggaaggatggccataattggcgg

SEQ ID NO: 46030 - protein, 77 aa, Panicum virgatum
  misc_feature: Ceres CLONE 2028432
  misc_feature (20)..(77): Pfam Name: CG-1 Pfam Description: CG-1 domain
  misc_feature: The sequence is a functional homolog of SEQ ID NO 1308 in the 10/666,642 US patent application
  misc_feature: The sequence is a functional homolog of SEQ ID NO 588 in the 10/666,642 US patent application
MASAEARRLAVVPQLDIEQILKEAQHRWLRPAEICEILKNYRNFRIAPEPPNRPPSGSLFLFDRKVLRYFRKDGHNW

SEQ ID NO: 46031 - DNA, 701 bp, Panicum virgatum
  misc_feature: Ceres CLONE 2028436
  misc_feature: Encodes the peptide sequence at SEQ ID NO. 46032
catccatccatcccagttacatacaccgacctacgtgcaacgacgaacaacagcatgctgcccaaccgcgacaactccatctgcccggccaacgggttctacacctacgacgccttcatccaggccgccgccgccttcccgggctttggcaccggcggcggcggcgacgacaagaacaagcgcgacctcgccgccttcttcggccagacctcccacgagaccaccggtggcactaggggcgccgccgaccagttccagtggggctactgcttcaaggaagagatcacccccaccgatcctccctactatggacggggacccattcaattgacagggcaggccaactaccagcaggccggcgacgcgatcggcgtggacctggtgggcaacccgggcctggtggcctccgaccccgtggtctccttcaagacggccatctggttctggatgacggcgcaggggaacaagccgtcgtgccacgacgtcgccctcggcaactggacgccctccgacgccgacaccgccgccgggcgggtgccggggtacggctgcatcaccaacatcatcaacggcgggatcgagtgcggcgtcggcgccaacgacgccaacgtcgaccgcatcggctactaccagcggtactgcggcatgctcggcatcgacgccggcgctaacctcgactgctacacccagcagcatttctg

SEQ ID NO: 46032 - protein, 215 aa, Panicum virgatum
  misc_feature: Ceres CLONE 2028436
  misc_feature (1)..(209): Pfam Name: Glyco_hydro_19 Pfam Description: Chitinase class I
  misc_feature: SWISSPROT Homolog: EC 3.2.1.14 Chitinase
MLPNRDNSICPANGFYTYDAFIQAAAAFPGFGTGGGGDDKNKRDLAAFFGQTSHETTGGTRGAADQFQWGYCFKEEITPTDPPYYGRGPIQLTGQANYQQAGDAIGVDLVGNPGLVASDPVVSFKTAIWFWMTAQGNKPSCHDVALGNWTPSDADTAAGRVPGYGCITNIINGGIECGVGANDANVDRIGYYQRYCGMLGIDAGANLDCYTQQHF

SEQ ID NO: 46033 - DNA, 604 bp, Panicum virgatum
  misc_feature: Ceres CLONE 2028447
  misc_feature: Encodes the peptide sequence at SEQ ID NO. 46034
aaaaccgcaaacaaaaccagccgcgtggcggccatatccaaccaaagatcaagatgaagattgcactagtcgtcctggcgctcgcgctcttcgcctccatcgtggctgccgccaacatggacaagtacaacctgcgcaagggcaaagaattcctcgccaagaatgccgagaaggagggcgtggtggttctgcccagcggactgcagtacaaggtcctcactgagggccccgctgacggcaagtctccctccaaggaggacagcgtctcggtccactaccgcggcaccctcatcgatggcactgagttcgacagctcctacaagaggggccagcccgccaagtttggcgttggtcaggtgatcaagggctggactgaggctctgcagcttatgtccgagggcgacaagtgggagctgtacattcccgctgacctcgcctacggcccctctggtcccggagccatcggccccaaccaagcgctcatcttcaccgtggagctgctggacgttgttggtgccaaagaagccggcggcgccgttcccgacgctcctgccgccaggagggtcaagaagaacaagaagaagcagtccaaggaagagctcta

SEQ ID NO: 46034 - protein, 183 aa, Panicum virgatum
  misc_feature: Ceres CLONE 2028447
  misc_feature (60)..(150): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MKIALVVLALALFASIVAAANMDKYNLRKGKEFLAKNAEKEGVVVLPSGLQYKVLTEGPADGKSPSKEDSVSVHYRGTLIDGTEFDSSYKRGQPAKFGVGQVIKGWTEALQLMSEGDKWELYIPADLAYGPSGPGAIGPNQALIFTVELLDVVGAKEAGGAVPDAPAARRVKKNKKKQSKEEL

SEQ ID NO: 46035 - DNA, 693 bp, Panicum virgatum
  misc_feature: Ceres CLONE 2028472
  misc_feature: Encodes the peptide sequence at SEQ ID NO. 46036
ggggagtatggtcgcaaggctgaaacttaaaggaattgacggaagggcaccaccaggcgtggagcctgcggcttaatttgacaacacggggaaacttaccaggtccagacatagcaaggattgacagactgaaacaccgatggtcttgtggacttcaaagagttcgttgcagcaactctccatatacatcagatggccgagctagactctgaaaggtggggcattcgatgccaagctgctttcagcaaatttgatctggatggtgatggatacatcacgccagaggagcttagaatgcacactggcttaaagggatctattgagccgctgctggaggaggccgacatcgataaagatgggagaataagcctgtctgaattccgcaagctcctgcgaactgcgagcatgagcaatgttcccagcccaagggggcctccaccaaatcctcaagctctgtgaactgcggcgaggccattagaggagcaaatttaggaagataccgtacagtagtcaatgtgttttttagcgtgccatgtgatgtttctgaatttagcatccaggttatgtgtgcagcagtgagataaatctcaaagtaaatatttagtttttttctttctttcatggagaagtatgagaggtcgagatctaaatggcaaatgagactcagcatcctctttctgtacagtactaaat

SEQ ID NO: 46036 - protein, 88 aa, Panicum virgatum
  misc_feature: Ceres CLONE 2028472
  misc_feature (12)..(40): Pfam Name: efhand Pfam Description: EF hand
  misc_feature (42)..(70): Pfam Name: efhand Pfam Description: EF hand
  misc_feature: SWISSPROT Homolog: EC 2.7.11.1 Non-specific serine/threonine protein kinase
MAELDSERWGIRCQAAFSKFDLDGDGYITPEELRMHTGLKGSIEPLLEEADIDKDGRISLSEFRKLLRTASMSNVPSPRGPPPNPQAL

SEQ ID NO: 46037 - DNA, 453 bp, Panicum virgatum
  misc_feature: Ceres CLONE 2028496
  misc_feature: Encodes the peptide sequence at SEQ ID NO. 46038
cccccatatccactcgtcgcgcaaacgaagagagcgtctctcccggtctcccccctcccccaccagcaccaacgaaacactcgggccggagcagcaacttctcgaagtcagcaacgaaacaattcccgctccaattctgggggcatgggctccaacggccacccactggcggcgagcgtcgccgcgcagaacgggtcccactccggcggcggcggcggcggaggaggaggagggggaggtggagggggcacgaaccctagcaacggcggcacggcggcggcgctccagcacgaccctggcctggcgcgggagtggtcgccggaggagcaggccaccctcgacgagctgatcgccaagtatgcatctgatgcgcctgtcatccgttatgcaaagatagccatgaaattgccagagaaaacagttcgggatgtagccttgcgctgcagatggatg

SEQ ID NO: 46038 - protein, 102 aa, Panicum virgatum
  misc_feature: Ceres CLONE 2028496
  misc_feature: Functional homolog of the protein sequence given in SEQ ID NO 50581
  misc_feature: Useful for making plants with altered lignin content
MGSNGHPLAASVAAQNGSHSGGGGGGGGGGGGGGGTNPSNGGTAAALQHDPGLAREWSPEEQATLDELIAKYASDAPVIRYAKIAMKLPEKTVRDVALRCRW

SEQ ID NO: 46039 - DNA, 691 bp, Panicum virgatum
  misc_feature: Ceres CLONE 2028500
  misc_feature: Encodes the peptide sequence at SEQ ID NO. 46040
gttagcctcctccaccatggctgccctcggcatcacctccccgccggcgccgtccgccttcgcgtccgcaacatcgtcctgctcccactcttcgcactccatcccccgcccccgcctccgcctccgctccctccccacccggttcgcggctgcggcgtcgttccgcgcgcggtgcgccgccgccgcagccggcggggccgcgggctcggagggcgccgccgcggtggccgaggtggatgaggcgggaaccgacgtcgccgggggcgccgcgacctccacgcggccgccctactcgctcatctccgcggagaatgtgcagaaggcgatgcgcggcctcgctattacagatgctgatcactatgggaggcttggagtcacaagactagcttctactgatgaggtaaacgccgcctatgagaaaaggtgtgaagaactaaatagcaaaaaactggaagaggaggagctcaacaaggaacttgacctcctaaaggaatcatttaccatactatcaactgaggaagagcgaagattatacgattggagcatatccagaagtgggcaacctgagcgatatgtctggccttttcaagtagatcccttggagtcggcaccggatcctccacaggaacccgaagacgaggtcccgacaaagctcgttggctacttcttcctggcgtggttcatactctct

SEQ ID NO: 46040 - protein, 224 aa, Panicum virgatum
  misc_feature: Ceres CLONE 2028500
  misc_feature (113)..(174): Pfam Name: DnaJ Pfam Description: DnaJ domain
MAALGITSPPAPSAFASATSSCSHSSHSIPRPRLRLRSLPTRFAAAASFRARCAAAAAGGAAGSEGAAAVAEVDEAGTDVAGGAATSTRPPYSLISAENVQKAMRGLAITDADHYGRLGVTRLASTDEVNAAYEKRCEELNSKKLEEEELNKELDLLKESFTILSTEEERRLYDWSISRSGQPERYVWPFQVDPLESAPDPPQEPEDEVPTKLVGYFFLAWFIL

SEQ ID NO: 46041 - DNA, 389 bp, Panicum virgatum
  misc_feature: Ceres CLONE 2028513
  misc_feature: Encodes the peptide sequence at SEQ ID NO. 46042
aacaaacgctaaaaaagtaacagttttctgtactttattggttgacaccatgtccgcccctgccccaaagcaggccaagcccgcgaaggctgacgccgccgccgccgccgcccccgtcgaggagacgtcggccgaccaggcgaagctcggtgttgtcgtcaagatcctgggccgcacgggctcgcgcggtaacgtgacgcaggtgcgcgtcaagctgctggctgaggagggccgtgacgccggccgccacatcgtccgcaacgtcaagggcccgtgccgcgagggcgacatgctggcgctgatggagactgagcgcgaggctcgccgcatgcgctaagcgtgtgttcgtcgacggtgtcatccgctgtccactccgctttcttgatttc

SEQ ID NO: 46042 - protein, 95 aa, Panicum virgatum
  misc_feature: Ceres CLONE 2028513
  misc_feature (24)..(95): Pfam Name: Ribosomal_S28e Pfam Description: Ribosomal protein S28e
MSAPAPKQAKPAKADAAAAAAPVEETSADQAKLGVVVKILGRTGSRGNVTQVRVKLLAEEGRDAGRHIVRNVKGPCREGDMLALMETEREARRMR

SEQ ID NO: 46043 - DNA, 667 bp, Panicum virgatum
  misc_feature: Ceres CLONE 2028514
  misc_feature: Encodes the peptide sequence at SEQ ID NO. 46044
gcgtcatgctctgtatcaaaccaggggaacatggaagtacatttggtggtaatccgttggctagtgctgtggcagttgcatcactgaaagtggtgagagacgaaggtcttgttgaaagggctgcaaagttaggacaagagttcagggaccagctacagaagatccagcggaaattccctcaaatcataagagaagtgcgcggaaggggtttgctgaatgcagtggacttaaacaatgatgcgctgtctcctgcttctgcatatgacatttgcatcaagttgaaggagagaggcattctagcaaaacccacacatgacaccataattcgattagcccctcccctttcaatcagtcatgaggagcttgcagaagcatcaaaggcgctcagtgatgtgctggagattgacttgccacagatgcagaagcagatcaagaagccagaatcagaggcagagaagccagtctgtgacagatgcggcagggacttgtacggatgagcgatttccagcgatgcctcggagcatagatagctgcattttcacaacagattctcgataatctcagacaccgtagtattagcatcgcgttgcatgtatattctgggaatattgttgcttgtgctgttaccgtgattaatggcaaataaatgggggtagcattcacctgc

SEQ ID NO: 46044 - protein, 164 aa, Panicum virgatum
  misc_feature: Ceres CLONE 2028514
  misc_feature: SWISSPROT Homolog: EC 2.6.1.13 Ornithine aminotransferase
VMLCIKPGEHGSTFGGNPLASAVAVASLKVVRDEGLVERAAKLGQEFRDQLQKIQRKFPQIIREVRGRGLLNAVDLNNDALSPASAYDICIKLKERGILAKPTHDTIIRLAPPLSISHEELAEASKALSDVLEIDLPQMQKQIKKPESEAEKPVCDRCGRDLYG

SEQ ID NO: 46045 - DNA, 658 bp, Panicum virgatum
  misc_feature: Ceres CLONE 2028537
  misc_feature: Encodes the peptide sequence at SEQ ID NO. 46046
atcgacaacatcagtctcaccgccgccaaaatgcctacgagactgacgaagacgaggaagcaccgcggtcatgtatccgccggccacggtcgtgtaggaaagcatcgcaagcatccaggtggtcgtggtcttgccggtggccagcaccatcatcgaacaaacatggacaaataccatcctggttacttcggaaaggtcggtatgcgccactttcacctactccgaaaccatgactggaagcctacgatcaatcttgacaagctctggtcgttggttcccgaagagtcgcgcgacgcatacatttcgggcaagaagaccgacaccgcccccgtcctcgacctcctgccgctcggatattccaaagtcctcggcaagggccgaatccccgagatcccaattgtcgtaagagcaagatggttcagcaaagaggccgaacgaaagatcaaggaggctggtggtgtcgttgagctggtcgcatgaaaagagaggtttatggacagttgatttcccaccgggttgatgcaacgggatggacttattgagtgcatgaaaggctggctttccggcgtgcattgaaagcgagatcattgacttgaccccgtattgacggaggtgacagcaaaaatcaaaagtgaaagaaacaacgtctctagctctc

SEQ ID NO: 46046 - protein, 149 aa, Panicum virgatum
  misc_feature: Ceres CLONE 2028537
  misc_feature (111)..(143): Pfam Name: L15 Pfam Description: Ribosomal protein L15
MPTRLTKTRKHRGHVSAGHGRVGKHRKHPGGRGLAGGQHHHRTNMDKYHPGYFGKVGMRHFHLLRNHDWKPTINLDKLWSLVPEESRDAYISGKKTDTAPVLDLLPLGYSKVLGKGRIPEIPIVVRARWFSKEAERKIKEAGGVVELVA

SEQ ID NO: 46047 - DNA, 512 bp, Panicum virgatum
  misc_feature: Ceres CLONE 2028551
  misc_feature: Encodes the peptide sequence at SEQ ID NO. 46048
ctctctttctctcctttctacatcaccatcaccatgggttctggcaagcctaggggtatccgcgctgcgcgcaagctcaagaaccaccgcagggttgagaggtgggccgacaagcagtacaacaaggctcacttgggcacccagctgaaggctaaccccttcggaggctcgtcgcacgccaagggcatcgtgctcgagaagctcggcattgaggctaagcagcctaactctgccatccgtaagtgcgtccgtgtccagctcatcaagaacggtaagaagatcgcttgcttcgtcccccgtgacggttgccttaacttcatcgaggagaacgacgaggtgctcgttgccggtttcggtcgtaagggtcactccgtgggtgatattccaggcgtccgtttcaaggtcgtcaaggtctccaacgtcggtctctacgctctctggagggagaagaaggagaagcccaggtcttaaattgacggctccactctgttcttcttctgtcctgcacacat

SEQ ID NO: 46048 - protein, 145 aa, Panicum virgatum
  misc_feature: Ceres CLONE 2028551
  misc_feature (10)..(144): Pfam Name: Ribosomal_S12 Pfam Description: Ribosomal protein S12
MGSGKPRGIRAARKLKNHRRVERWADKQYNKAHLGTQLKANPFGGSSHAKGIVLEKLGIEAKQPNSAIRKCVRVQLIKNGKKIACFVPRDGCLNFIEENDEVLVAGFGRKGHSVGDIPGVRFKVVKVSNVGLYALWREKKEKPRS

SEQ ID NO: 46049 - DNA, 484 bp, Panicum virgatum
  misc_feature: Ceres CLONE 2028563
  misc_feature: Encodes the peptide sequence at SEQ ID NO. 46050
ggaaggaaatattttagactttatcctgcttctgtatctgtggaactgtaccctcagacagagacaatactgagcaatactagtcaggtagatcttgacaagtttgacgagaaggaattctcgacggcagcagatcttgaattcatagatggcatattagaggaaggtgacctgctttacattccaccaaaatggtggcattacgtgagatctctttctgttagcttttctgttagcttctggtggcgaacgtcacatcttccttcaggaagttcataataccattgttttgattgtccatgatgtttctatcatcggattggtagagacttagtaaaacctcattaagcccatgtttcctgatccattggtgtgtgggtatggcctcgccacgctgatgtatattgtaagattgtgtatattgcgtgagatgtattgcaatgagcctttagggcaaatatatagagataaggaaggttatccc

SEQ ID NO: 46050 - protein, 92 aa, Panicum virgatum
  misc_feature: Ceres CLONE 2028563
  misc_feature: SWISSPROT Homolog: EC 1.14.11.16 Peptide-aspartate beta-dioxygenase
GRKYFRLYPASVSVELYPQTETILSNTSQVDLDKFDEKEFSTAADLEFIDGILEEGDLLYIPPKWWHYVRSLSVSFSVSFWWRTSHLPSGSS

SEQ ID NO: 46051 - DNA, 715 bp, Panicum virgatum
  misc_feature: Ceres CLONE 2028567
  misc_feature: Encodes the peptide sequence at SEQ ID NO. 46052
agagcgctagatttccaagcgaaaaccctctcgcatctaaaccctcttcctcccttccccacctctccagcggatcactcgccgccgccgccgccgccggacgccgccgccgccgccgtgatgctgtccctgtcgagggctctcgggaggcggctcttctcatccgccgcggcggtgtccgagtccgccgcggccgcgtcgacgtcggcggtgaggaaggcgcagaaccctctcgaggagttcttcgaggttgagcggagcaccgaggaggacaagccccgtccctactacggtcgtagttggaaggcttctgaattgcgcctaaaatcgtgggatgatcttcagaagcattggtatgttcttatgaaggaaaagaacatgcttatgactcagcgacagatgctgcatgcagagaacttgcattttccaaatccagagcgtatttccaaggtgaagaaatcaatgtgccggataaagcatgtcttgactgagagggccatagctgagccagacccaaggaggtcagcagaaatgaagcggatgatcaacaccctctgattcactcacatgcttttctgtgggactaaggttgaaaggctaagtagcacttagaaagatttgcttcgttgtgttgtatgtttatcctagaagacgtgtaagaccgatccttttttatgtccgtggtatgcctgcaacacgccttgttgacattaac

SEQ ID NO: 46052 - protein, 145 aa, Panicum virgatum; identical to SEQ ID NO: 40922
  misc_feature: Ceres CLONE 2028567
  misc_feature (38)..(125): Pfam Name: MRP-L47 Pfam Description: Mitochondrial 39-S ribosomal protein L47 (MRP-L47)

SEQ ID NO: 46053 - DNA, 543 bp, Panicum virgatum
  misc_feature: Ceres CLONE 2028572
  misc_feature: Encodes the peptide sequence at SEQ ID NO. 46054
gaggacggccacatggctcgcgactgctcgcagaacggcggtggcggcggctacggaggaggcggcggctacggtggcggcggaggcagccgcaactgctacacgtgcggcggggagggccatattgccagggactgcaaccagaacggcggcggcggctacggaagcggtggcggccgcggctgctacaactgtggcgaggagggccacatctcccgcgagtgccccaaccccaagaagcgctaggcacgtcgttggatccggttcgagtcccacctcctggctctcgcgtgaagccatagccaccatctatatatcctatctatcagtagttgtagtgtttcgttgtcgtcgtcgctcgtgtcgcagtaaggaagaaggcgtatggagtggtggtttggatctgtctcgacatctcgagtagtagtaatgtttctgtttgcatcaactgtaaggcagccatgatcgtatatggctctgcccgatctacctatctcgttatcgcactcagattgtatgccaggatgcctctgttgttgattc

SEQ ID NO: 46054 - protein, 81 aa, Panicum virgatum
  misc_feature: Ceres CLONE 2028572
  misc_feature (60)..(77): Pfam Name: zf-CCHC Pfam Description: Zinc knuckle
  misc_feature (31)..(48): Pfam Name: zf-CCHC Pfam Description: Zinc knuckle
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 468 in the 11/479,226 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50178
  misc_feature: Useful for making plants with modulated nitrogen use efficiency
  misc_feature: Functional homolog of the protein sequence given in SEQ ID NO 50142
  misc_feature: Useful for making plants with altered lignin content
  misc_feature: Functional homolog of the protein sequence given in SEQ ID NO 50180
  misc_feature: Useful for making plants with altered alkaloid content
  misc_feature: The sequence is a functional homolog of SEQ ID NO 644 in the 10/666,642 US patent application
EDGHMARDCSQNGGGGGYGGGGGYGGGGGSRNCYTCGGEGHIARDCNQNGGGGYGSGGGRGCYNCGEEGHISRECPNPKKR

SEQ ID NO: 46055 - DNA, 462 bp, Panicum virgatum
  misc_feature: Ceres CLONE 2028583
  misc_feature: Encodes the peptide sequence at SEQ ID NO. 46056
gactacaagtgttcttggttagttgtgcaagctcttgaacgtactgatgaggaccaaaagaaaatcctatttgaaaattatgggaagtccgatccagcatgtgttgcaaaggtgaacgacttgtacaaagagcttaatctggaggaggttttccatgagtacgagagggagagttacaacaagctgacggccgacatcgaggcccagccgaacaagacggttcagaccgttctgaagtccttcctgcacaagatctacaagagggacaagtagagctcagctgcgtgtgtggagaaccttttccacctatgctcgcgacgttttcgacgcactatgctttctgtgtttcgtgggtagcagcatgtatttcgttcactctgtaccgtactagcggttttatatatgtaatgtaataaagcacatgctcccggtttcacaggcttgtgtcgctagcattttccc

SEQ ID NO: 46056 - protein, 90 aa, Panicum virgatum
  misc_feature: Ceres CLONE 2028583
  misc_feature: SWISSPROT Homolog: EC 2.5.1.67 Chrysanthemyl diphosphate synthase
  misc_feature: Functional homolog of the protein sequence given in SEQ ID NO 51086
  misc_feature: Useful for making plants with modulated salt sensitivity
DYKCSWLVVQALERTDEDQKKILFENYGKSDPACVAKVNDLYKELNLEEVFHEYERESYNKLTADIEAQPNKTVQTVLKSFLHKIYKRDK

SEQ ID NO: 46057 - DNA, 699 bp, Panicum virgatum
  misc_feature: Ceres CLONE 2028598
  misc_feature: Encodes the peptide sequence at SEQ ID NO. 46058
gaggaagagcgacgaagccgaactagtgccggcacggcggacggagaaacatggcagggaaagccggcggactcaagggggttgccctcatcggcggcggggccaacagctcggtcgccggcgccctacacttcttccaggaccccgccaccgggtacaccgaggtgaggggcaaagtcacgggcctggctccgggcatgcatggattccacatccacgtcttcggcgacaccaccaacggctgcaactccaccgggccccattttaaccctcacaataagccccatggagcaccatttgatgatgaacgacatgtgggtgacctgggaaacatagcagccaacaaagatggagttgcagaagtgttcataagggacctacagatttcattgagtgggcctcattccatactgggaagggcagttgttgttcatgctgatccggatgacctagggaggggtggccatgaactcagcaagtcaacaggaaatgcaggagctagagttggatgtggtatcattggaattcagtcttcagtttagcaacagcctagttccaccagaaaaaagggccaagggatatgtcatggtatatgcagattgtgcggagacatggaaatgatgtgcattgttctggaacatctcaaaactaaacagtttagtaccctatctacagtgatgtatacaataatcttgttac

SEQ ID NO: 46058 - protein, 163 aa, Panicum virgatum
  misc_feature: Ceres CLONE 2028598
  misc_feature (8)..(161): Pfam Name: Sod_Cu Pfam Description: Copper/zinc superoxide dismutase (SODC)
  misc_feature: SWISSPROT Homolog: EC 1.15.1.1 Superoxide dismutase
MAGKAGGLKGVALIGGGANSSVAGALHFFQDPATGYTEVRGKVTGLAPGMHGFHIHVFGDTTNGCNSTGPHFNPHNKPHGAPFDDERHVGDLGNIAANKDGVAEVFIRDLQISLSGPHSILGRAVVVHADPDDLGRGGHELSKSTGNAGARVGCGIIGIQSSV

SEQ ID NO: 46059 - DNA, 704 bp, Panicum virgatum
  misc_feature: Ceres CLONE 2028647
  misc_feature: Encodes the peptide sequence at SEQ ID NO. 46060
gtcccactaccctttccccacgcagaaacgcgcagagaccttttcgatacccccaatcgccgccgcctcctcgactcttcgccgctccgctcccctccccccgcgacctcgctgccggcttcgccaaatcgccgcctccccgactctcgccgctcccgccgcctccatcccgcccgcgagtcgccgccggcttcgggtcgccccgctcccctccatggctgggagacacaccattatcctgatgcaaccatcccaaaatagggcttctaggacatttatggattataattcaattaaccatgcattggatggaatctgtgggctttatgaaaggaaaattagggatatcaaccccacggcccccataacctatgatatcagtgacctttataatttcattgatggcctagctgacataagtgcactggtttatgatcactcaattcaggcatttctgccatatgatcgacagtggatcaagcaaaagttgctccaacacctgaagaagctggctcagcggtagcatgactgtttgtttgctccggtgccttgtcaccaacaagcaagcatgtgtggtaatgggtgtccagtgagtgtatcgggtggtctttcttgtaaaattatgaaatgttacacttacattgcagattgcacccttgtgctgtggatgttggactcgggtattagtggattgcctgtggcac

SEQ ID NO: 46060 - protein, 102 aa, Panicum virgatum
  misc_feature: Ceres CLONE 2028647
  misc_feature (3)..(102): Pfam Name: ER Pfam Description: Enhancer of rudimentary
MAGRHTIILMQPSQNRASRTFMDYNSINHALDGICGLYERKIRDINPTAPITYDISDLYNFIDGLADISALVYDHSIQAFLPYDRQWIKQKLLQHLKKLAQR

SEQ ID NO: 46061 - DNA, 666 bp, Panicum virgatum
  misc_feature: Ceres CLONE 2028651
  misc_feature: Encodes the peptide sequence at SEQ ID NO. 46062
aactccttgtcctcagtcggcacgatcaatcacaatggtcaaggttagcgcaaacatctcgtcgtcgaggcgcaagtctcggaaggctcacttcagtgcgccttcgagcatccggcgcaatattatgagcgcccccctcagcaaggagctccgtgagaagtacaacgtccggagcattcccatccgcaaggacgacgaggttcagattgtccgtggcctgaacaaggacaaggagggcaaggtcacctcggtctaccgtctcaaatatgtcatccacattgagcgtgtcacccgcgacaaggccagcggccagagcgtccccctgggcatccaccccagcaacgttgtcatcaccaagctcaagctcgacaaggaccgcgaggacatcctggcccgcatcaaggccggccgtgaccaggtcgctcgtgcccagggcaagaacaaggcttgaattccctgagccggtgttggaggaatgacaaaaaggacgacaagaaggaacaactcggttcggttgcgacgaagagaaatacccagcattacttttcgtcgaaggtttacccggtcggcacctggcctttgcggctttggtttacggatgcatacttagggcggttgtctgtctgtcaacgtgacatgacataactgcacgcacgggacggaccc

SEQ ID NO: 46062 - protein, 138 aa, Panicum virgatum
  misc_feature: Ceres CLONE 2028651
  misc_feature (52)..(83): Pfam Name: KOW Pfam Description: KOW motif
  misc_feature: Functional homolog of the protein sequence given in SEQ ID NO 51460
  misc_feature: Useful for making plants with modulated biomass
MVKVSANISSSRRKSRKAHFSAPSSIRRNIMSAPLSKELREKYNVRSIPIRKDDEVQIVRGLNKDKEGKVTSVYRLKYVIHIERVTRDKASGQSVPLGIHPSNVVITKLKLDKDREDILARIKAGRDQVARAQGKNKA

SEQ ID NO: 46063 - DNA, 608 bp, Panicum virgatum
  misc_feature: Ceres CLONE 2028665
  misc_feature: Encodes the peptide sequence at SEQ ID NO. 46064
agtatctccactggatagtgactaatataccagggggaacagatgcatcaaaaggggaggaggaagtggactacatgggcccgcggccgccggtggggatccaccgctacgtgctggtgctgttcgagcagaagacgcgcgcgcgcgcggaggcgccggcggagcgcgccaacttcaacacgcgcgccttcgcggcggcgcacgagctcggcctccccaccgccgtcgtctacttcaacgcccagaaggagcccgccaaccgccgccgctaatcaacagctacctctgcctccactccacggcgcgccagctgctagctgctgcgagtgcgtgcgtgcgtgcgccggccgccggcggttatattataattaccgccgccggtgaatgaataagtgctttactatactgtcccgttaagtaccttattaattaccgtatactcgtatattttctctgctgctgtgtgtaagtgtgttcgtatacgtatggctgtctgtgtacttgtacgcttgcttgtatatgcagcatgcgtcttgcatggactgtggcttttggagttgatttcgtcactagctcgcttctgggtaataacagctgttggctctttc

SEQ ID NO: 46064 - protein, 89 aa, Panicum virgatum
  misc_feature: Ceres CLONE 2028665
  misc_feature (1)..(81): Pfam Name: PBP Pfam Description: Phosphatidylethanolamine-binding protein
  misc_feature: The sequence is a functional homolog of SEQ ID NO 2 in US patent 7208653
  misc_feature: Functional homolog of the protein sequence given in SEQ ID NO 51458
  misc_feature: Useful for making plants with modulated flowering time
  misc_feature: The sequence is a functional homolog of SEQ ID NO 2 in US patent 7196246
YLHWIVTNIPGGTDASKGEEEVDYMGPRPPVGIHRYVLVLFEQKTRARAEAPAERANFNTRAFAAAHELGLPTAVVYFNAQKEPANRRR

SEQ ID NO: 46065 - DNA, 456 bp, Panicum virgatum
  misc_feature: Ceres CLONE 2028666
  misc_feature: Encodes the peptide sequence at SEQ ID NO. 46066
ggaagcgaaagcgaaagcgacggcgccgccagagatggagacggaggcggctgcggcgaggcaggccaaggagtccctggagctggcgttccagatgtcccagatcctcgacaccggcctcgaccgccacaccctgtcgctgctcatggcgctgtgcgaccgcggcgccaaccccgaggccctcgccgccctcgtccgcgagctctcctccgccgctcccccaaccgccgcggcggcgaccccctctcccgtgagcaacggcaccgcggccccggccccggcatccgtgtcgctgttcccctccggccttcgccgttcctagggtttgtgatatccccttctgctccggtgagattgcttatcagtagtcaaactagatcccactaattgcatttggccgtcgtgaatgcctgaatgtagcatttcctctgttcagtaattttgcgtcctgggctc

SEQ ID NO: 46066 - protein, 106 aa, Panicum virgatum
  misc_feature: Ceres CLONE 2028666
  misc_feature: Functional homolog of the protein sequence given in SEQ ID NO 50417
  misc_feature: Useful for making plants with modulated nitrogen use efficiency
EAKAKATAPPEMETEAAAARQAKESLELAFQMSQILDTGLDRHTLSLLMALCDRGANPEALAALVRELSSAAPPTAAAATPSPVSNGTAAPAPASVSLFPSGLRRS

SEQ ID NO: 46067 - DNA, 644 bp, Panicum virgatum
  misc_feature: Ceres CLONE 2028686
  misc_feature: Encodes the peptide sequence at SEQ ID NO. 46068
gttcttctcgctgaaatcgattctgtgattggaggtccaagagtaatcaattgacaatgggtattgatatcaagagaaagcacgtcagaaagggaagcagaactgccccagatagccaaaatgtttatttaagattgttagtaaaattatacacctttctttctcgtagaaccggtagcaacttcaacaaagttgttttgaagcgtttgtttatgtccaaaacaaacagacctccagtgtcagtcagaaagattgttgactacatgaccaacaaaaaagagaaccaaatcgctgttgttgttggtacagtaactgatgacaagagacaactcgatttaccaaaggtcactgtttgtgctttacgcttcaccaaaactgctcgtgctagaattacaaaggctggtggtgcttgtttaacattcgatcaattggctattcaaagaccaaagggaaccaactgtttattaatcagaggtccaaagaatacccgtgaagccgttaaacactttggaacacctggagctaaacacagccacgctaaaccatatctcacttctgaaggaagaaagttcggacgtgccgatagaggaaagagataaattattaatgttattagtaccaacacaggattataataaacacac

SEQ ID NO: 46068 - protein, 180 aa, Panicum virgatum
  misc_feature: Ceres CLONE 2028686
  misc_feature (11)..(180): Pfam Name: Ribosomal_L18e Pfam Description: Eukaryotic ribosomal protein L18
  misc_feature: Functional homolog of the protein sequence given in SEQ ID NO 50173
  misc_feature: Useful for making plants with modulated nitrogen use efficiency
MGIDIKRKHVRKGSRTAPDSQNVYLRLLVKLYTFLSRRTGSNFNKVVLKRLFMSKTNRPPVSVRKIVDYMTNKKENQIAVVVGTVTDDKRQLDLPKVTVCALRFTKTARARITKAGGACLTFDQLAIQRPKGTNCLLIRGPKNTREAVKHFGTPGAKHSHAKPYLTSEGRKFGRADRGKR

SEQ ID NO: 46069 - DNA, 625 bp, Panicum virgatum
  misc_feature: Ceres CLONE 2028688
  misc_feature: Encodes the peptide sequence at SEQ ID NO. 46070
tgatcccgcaaaccccacccccaacattccaacaaggcctcttcgctctcccactcttgtcatcccggcggcggcggcggcggcggcgcggaagcggaagcaggaggaggagcagcagtaggcggagccgaagatcagcaaaccacccccagctcgaccatggctgctgtgccagtcaaccctaaacctttcttgaacaacctaacagggaagcctgtaattgtcaaacttaagtggggtatggagtacaaaggttatcttgtttctgtggagtcctacataaatcttcagcttgctaacacagaggagtacattgatgggcaattctctgggaacctgggagagattttgatcaggtgcaacaatgttctgtacctccgaggtgttccagaggatgctcagatagatgatgcggactgagaagacttgaacggtgcttagatggattgatcatttatgtaattttattctgacgtgtgtttgggtgtgccggggacaacctattctgccgggggacccacgaccgtctttgtgtcgcttgctaccatgtacttacaaatgcaaatgcaaatgcagacatcttgtcaccccgagggccaaggcggcgatactactccaccagctc

SEQ ID NO: 46070 - protein, 86 aa, Panicum virgatum
  misc_feature: Ceres CLONE 2028688
  misc_feature (10)..(75): Pfam Name: LSM Pfam Description: LSM domain
MAAVPVNPKPFLNNLTGKPVIVKLKWGMEYKGYLVSVESYINLQLANTEEYIDGQFSGNLGEILIRCNNVLYLRGVPEDAQIDDAD

SEQ ID NO: 46071 - DNA, 802 bp, Panicum virgatum
  misc_feature: Ceres CLONE 2028699
  misc_feature: Encodes the peptide sequence at SEQ ID NO. 46072
ccatatcgtccccaagctcctgaatcttttcttccccctccctacctatcccctcgcctatcgacccttcccaccatcagaagaaatctcggtccccccacgcgttcggatcaaagtttcagcggtgcgtgcgtgcgtaagttcatcggaacaggaagatgggtaaaacgtgggcgctcgtcacccacctccacgctctcgcagggccgacgctcactctgatttaccctctgtacgcatcaatctgcgcgatggagagcacgtgcaagctggacgacgagcagtggctggcctactggataatctactccttcatcgccctcttcgaaatggcggccgagaacgtcctctactggataccgctgtggtacgaggcgaagctgctgctggtggcgtggctggtgctgccgcagttcaggggcgcctccttcatctacgacaagctcgtcagggagcagctgctgaggcacggggtgaggctgcacgatcgccacggtcacaccggtgaacacgagccgccgcacgtcctcaacctcaaggctgagcatggcgcgcactgaggagcccaacaatccgagaagtaacctgatgaccggcaccggccggagtggttccgtcttgccgtacgaaagggcaaacggtttgtgctgtaacaacattgcgagaacactggggcattgcatccgatccaccaatatgtgctcagcaagctaactccgatggtcctgattgttcagcgggaggagcgagtgcccctgttctttgtcacgaataaatccgaacagaaattgcattgctgtgc

SEQ ID NO: 46072 - protein, 133 aa, Panicum virgatum
  misc_feature: Ceres CLONE 2028699
  misc_feature (4)..(101): Pfam Name: TB2_DP1_HVA22 Pfam Description: TB2/DP1, HVA22 family
MGKTWALVTHLHALAGPTLTLIYPLYASICAMESTCKLDDEQWLAYWIIYSFIALFEMAAENVLYWIPLWYEAKLLLVAWLVLPQFRGASFIYDKLVREQLLRHGVRLHDRHGHTGEHEPPHVLNLKAEHGAH

SEQ ID NO: 46073 - DNA, 483 bp, Panicum virgatum
  misc_feature: Ceres CLONE 2028702
  misc_feature: Encodes the peptide sequence at SEQ ID NO. 46074
attgtgtcgtccttacgcatagctagggtttgcgactgcagcgctcgtggcctctcccaagcgcagcaatcatgccaaagcaaatccatgagatcaaggacttccttctcacagcgagaaggaaggatgcccgctccgtgaggatcaagaggagcaaggatgccgtcaagttcaaggttcgctgctccaagtacctctacacactgtgtgtctatgacactgagaaggccatcaagctgaagcagtctctgcctcctggcttgagcgtgcaggaggtttaagctttggaaatagtgactacagcaccggtgctggttgcttcaaagatttgccaatctaccttaaatttagtttctgtatgtgacctccgactgttttaaatgaattgctgtgattgagacgaaatgttatgtggaagtaatgtgatggctggctagcctcgatttgatattcgaatgactcgttcttctcttttctcttttc

SEQ ID NO: 46074 - protein, 69 aa, Panicum virgatum; identical to SEQ ID NO: 12202
  misc_feature: Ceres CLONE 2028702
  misc_feature (2)..(69): Pfam Name: Ribosomal_L38e Pfam Description: Ribosomal L38e protein family

SEQ ID NO: 46075 - DNA, 601 bp, Panicum virgatum
  misc_feature: Ceres CLONE 2028725
  misc_feature: Encodes the peptide sequence at SEQ ID NO. 46076
acgcagagcaagcgagcgcagcagcagctgtagctagcttgtacgtgcacaaggagctcgctcggtcgcgatggcagctagagcggcgctcctcctggccgtgagcctggtcctggccgccgtggcgagcgcgaccaactgcccgccgccgccggccccgacgccgccgacgccgacgccgccgacgccgacgccgacgccgccgccggccccgacgccgccgacgccgacgccgacgcccagcggcggcggccaccactgccccagggacgcgctgaagctgggcctgtgcgccaacgtgctgggcctcgtcaaggccaagatcggctcgccgccctacctgccctgctgctcgctgctggacgggctcgtggacctggaggccgacgtctgcctctgcaccgtcatcaatgccaacatcctcggcatcagactcaacctctccatcgacctcagcctcatcctcaacaactgcggcaagagctgccccaacgacttccactgcgcatagatcgcccactgatcgaccgtcctcgctcctccatcggcggcggccgcgggtcgtccatctttccattctgtcattccgtggcggctctgt

SEQ ID NO: 46076 - protein, 146 aa, Panicum virgatum
  misc_feature: Ceres CLONE 2028725
  misc_feature (64)..(145): Pfam Name: Tryp_alpha_amyl Pfam Description: Protease inhibitor/seed storage/LTP family
  misc_feature: Functional homolog of the protein sequence given in SEQ ID NO 50191
  misc_feature: Useful for making plants with modulated salt sensitivity
  misc_feature: Functional homolog of the protein sequence given in SEQ ID NO 51501
  misc_feature: Useful for making plants with modulated biomass
  misc_feature: Useful for making plants with modulated flowering time
MAARAALLLAVSLVLAAVASATNCPPPPAPTPPTPTPPTPTPTPPPAPTPPTPTPTPSGGGHHCPRDALKLGLCANVLGLVKAKIGSPPYLPCCSLLDGLVDLEADVCLCTVINANILGIRLNLSIDLSLILNNCGKSCPNDFHCA

SEQ ID NO: 46077 - DNA, 680 bp, Panicum virgatum
  misc_feature: Ceres CLONE 2028740
  misc_feature: Encodes the peptide sequence at SEQ ID NO. 46078
agaaatccagcccagaatacccacttcgggtcgtctgctcggccgatctcgcgcagcgccggcgccgccgcatccctgaatctgagcccctttcgtcttgcccagcctcgagcacgtcccccttcccctcctctaccctccctccattcgattcgagcttatcgctagggttcctgaccccgctccaccttctcccatggcggacgaagccaaccgaacggcgttcatggagctgcaggcccggatgttcgataccaccgggaagatcaaacagttacaaacccaaatgcgttctaaagagggggaaaagaagcgtgcttacctcactctggaggaactccgccaattgccagatgacactaacacctacaagactgttggaaaagtgtaagtaatccaacaagatctttcaccatggagagtcaatttcgtggtcttcaatggtataaatataatatctttgcatttcatttcattttctgggcacccatttacctgcaggtttattttggagccaaaatcagttcttttgaacgagcaagagcaaaaatttaatgaaagtgagagcgcgatagcatcaatgcagacttcgaaggaataccttgagaaacaggtgggagaagtggagaacaacatcagagagctgcttcaacaggaccccgggccttgcacgccagatt

SEQ ID NO: 46078 - protein, 64 aa, Panicum virgatum
  misc_feature: Ceres CLONE 2028740
  misc_feature: Functional homolog of the protein sequence given in SEQ ID NO 51316
  misc_feature: Useful for making plants with altered terpenoid content
MADEANRTAFMELQARMFDTTGKIKQLQTQMRSKEGEKKRAYLTLEELRQLPDDTNTYKTVGKV

SEQ ID NO: 46079 - DNA, 558 bp, Panicum virgatum
  misc_feature: Ceres CLONE 2028741
  misc_feature: Encodes the peptide sequence at SEQ ID NO. 46080
aacacagcttaaagttataggaaaagaaaggaacacagctgaagcaaaacagaccttgactacgtatgtatgttcaactctgagctctgcaggcagcccgtcagctgaaacccatacaggaacatgaaaccaagaacggtgaacaaagtcttctgaataatgtagcggtgggcagggaacttacaagtaatgtccagataataagcaacgaggacctcgaagatctccgtgagatgggatccggtgcattcggaacagttttccatggaagatggaaggggaccgatgttgctattaaacagataaagaatagttgttttatgttaccatcacctcaagcagataagctggtaagcctatataaattcatcagcattttttaaagtcgcagcaaaggggctggtccatggtcactttaggagagaacctatagctttgcaatcttaggtaacaaaacaccatcatgattctgcaagtgtatcgtgttaccattaagctacctctgtactgattcattatctgaaccgagaaataagattatagatcactgattccgcg

SEQ ID NO: 46080 - protein, 49 aa, Panicum virgatum
  misc_feature: Ceres CLONE 2028741
  misc_feature: SWISSPROT Homolog: EC 2.7.11.1 Non-specific serine/threonine protein kinase
MGSGAFGTVFHGRWKGTDVAIKQIKNSCFMLPSPQADKLVSLYKFISIF

SEQ ID NO: 46081 - DNA, 638 bp, Panicum virgatum
  misc_feature: Ceres CLONE 2028758
  misc_feature: Encodes the peptide sequence at SEQ ID NO. 46082
gacaaaaccctagccccgagcagccgcagcggccagcacttcacgtcccctgcctccctctcgtcacctggcggcggcggcggcggcggcagcggcagcggcaggatggcggcttcgacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgaccctgactggtactacaccagggctgcctcaattgcaaggaagatctacctcaggcaaggcattggtgtaggtggattccagaagatctatggtggccgccagaggaatggctcccgcccaccacacttctgcaagagcagtggtgccatttcacgtaacatcttgcagcagttgcagaagatgggcatcattgatgttgatcccaagggtgggcggctcatcacctcccagggaaggcgtgatcttgaccaagtggctggaagagttgctgttgacgcttaagcatctctgttttctgttttgtccgtgtttgatggtatggctacactttatttgcagttttgaactaggacttgtcctgccttggttcagagaat

SEQ ID NO: 46082 - protein, 145 aa, Panicum virgatum; identical to SEQ ID NO: 12938
  misc_feature: Ceres CLONE 2028758
  misc_feature (7)..(145): Pfam Name: Ribosomal_S19e Pfam Description: Ribosomal protein S19e

SEQ ID NO: 46083 - DNA, 678 bp, Panicum virgatum
  misc_feature: Ceres CLONE 2028764
  misc_feature: Encodes the peptide sequence at SEQ ID NO. 46084
atccattgcactacaacatcatccttagcattcttcatcgatttggcacagccatcatctagctacgagctcacaacttcaacgacccctggcagcaatggcggcgatcaccggtggaagggtggcgctcgcggtggccgcgctcctctgcgccatggcggcgacggccgctgcgcagcaggcctccaacgtgcgcgcgacgtaccacctgtacaacccggcgcagaacggctgggacctcaaccgcgtcagcgcctactgcgccacgtgggacgccaacaagccgctgtcatggcggcagaagtacggctggaccgccttctgcgggccctcgggccctaagggccaggcctcctgcggcaagtgcatcagggtgacgaaccgtgcgacgggcgcgtcgatcgtggcgaggatcgtggaccagtgcagcaatggcgggctggacctggacttcgagacggtgttcaaggagatcgacaccaacgggcagggctaccagaggggacacctcaacgtcgactaccagttcgtctcctgctgagtgagcacgcgcacacatggaccgggaggaacccggccggatgtagtaacaagcctcgctttatattagatatgtgtggggtgatggaataaaagataatagagactcggatgatgtggtagcttagtatacagaat

SEQ ID NO: 46084 - protein, 147 aa, Panicum virgatum
  misc_feature: Ceres CLONE 2028764
  misc_feature (28)..(147): Pfam Name: Barwin Pfam Description: Barwin family
MAAITGGRVALAVAALLCAMAATAAAQQASNVRATYHLYNPAQNGWDLNRVSAYCATWDANKPLSWRQKYGWTAFCGPSGPKGQASCGKCIRVTNRATGASIVARIVDQCSNGGLDLDFETVFKEIDTNGQGYQRGHLNVDYQFVSC

SEQ ID NO: 46085 - DNA, 568 bp, Panicum virgatum
  misc_feature: Ceres CLONE 2028765
  misc_feature: Encodes the peptide sequence at SEQ ID NO. 46086
accccaccagtccaccaccagcgaagatctcgtgctcgccgccctcattccccgcagcaaccagatcgccttccagaaccttctcgccgccgccgaagtcgaagccgaagcatggccggagtcggatcgaaggccctcgccgtggtcgccgtcctggcggccgccgccctctctgtggcctccgcggccgacgcgccggcgcccagccccgtctccgccgccggcgccgcggccccgcccctcgccgccgccctcgtcgcctccgccgccgccttcctcttcgccgccgtccgccactgagcccgtccgcggacagtaccgctaccgccccgcctagatctatttatttagtaatattactagagatggatttcttccttggttgctcgtgtcgtcgtcgcattttggtcggatctgggatgagtttctaccgtgtcgtcgtgtcgggtggtgtgatccccctgtagatactctgctatctcgttcctgagtgggatggttctgtctggttgctactgatattatcattgtttatctgtcccgtttgagatgatgatgccttgctgtt

SEQ ID NO: 46086 - protein, 62 aa, Panicum virgatum
  misc_feature: Ceres CLONE 2028765
  misc_feature: Functional homolog of the protein sequence given in SEQ ID NO 50452
  misc_feature: Useful for making plants with altered carbohydrate content
MAGVGSKALAVVAVLAAAALSVASAADAPAPSPVSAAGAAAPPLAAALVASAAAFLFAAVRH

SEQ ID NO: 46087 - DNA, 514 bp, Panicum virgatum
  misc_feature: Ceres CLONE 2028773
  misc_feature: Encodes the peptide sequence at SEQ ID NO. 46088
gacttgtccttcttaccgttgcttgagtatttactccaagatggcccaagttactccaccttctctcaatttaaccgaatccgacatccaaaagatgattgtttgcagcgttcatctcggtagtgaaaatttggatgcatcaatggaacgatacgtctatggacgtaatgctgatggtgttcacattattgatgtcagaaaaacctgggaaaaactccaactcgctgctagaatcattgctgctgttgacaacccaaaagatgtctgtgtcgttgctcttgctcaacactctcgtgaacaaccaccacatgctcaaagagctgttctcaaattcgcaaaatactgccaaactcgtgcaattgctggacgattcactcctggaacattcaccaatcaaatgcaagctgctttttttgaacctcgtgtcttgatcgtttccgacccaattaaagatcatcaaccaattgttgaatcatcatatgtcaacgtcccagtcattgctttctgtaacacc

SEQ ID NO: 46088 - protein, 157 aa, Panicum virgatum
  misc_feature: Ceres CLONE 2028773
  misc_feature (19)..(157): Pfam Name: Ribosomal_S2 Pfam Description: Ribosomal protein S2
MAQVTPPSLNLTESDIQKMIVCSVHLGSENLDASMERYVYGRNADGVHIIDVRKTWEKLQLAARIIAAVDNPKDVCVVALAQHSREQPPHAQRAVLKFAKYCQTRAIAGRFTPGTFTNQMQAAFFEPRVLIVSDPIKDHQPIVESSYVNVPVIAFCN

SEQ ID NO: 46089 - DNA, 614 bp, Panicum virgatum
  misc_feature: Ceres CLONE 2028803
  misc_feature: Encodes the peptide sequence at SEQ ID NO. 46090
ctcttttcgtctcggtagcaggacgaggacctatcatcatggtgaagttcctcaagcccgggaaagtggtcgtggtcttgtctggtcggttcgccggcaagaaggctgtcatcgtgaggaaccacgatgatgggacaaccggccgcccatatgggtgcgctctgcttgtcggcctgcgcaaggagccccgcaaggtgaccaagaggcagacagccaagaggcaggcgaagaagtctaccctcaagacattcatcaagactgtgaactacaaccacttgatgccaactcgctataccctggacgtggatttcagcaagtccatcacagccgaggttgtggagaacagcacaaagaaggtcgaggccagcaaggaggccaagaagctgctggaggagaagttcaagactggcaagaacaggtggttcttcaccaagttgcgcttctaagctgttctctttgcgtcaacatctcagtacaacatccaccccttctttcaccattatctggggcaccatcacaggtcacctcaagctgggcataatgccttgttcaagggcacgcactgggatcccatgatgttgtagtgtcctgcttatggtgtaaagattcttacc

SEQ ID NO: 46090 - protein, 135 aa, Panicum virgatum
  misc_feature: Ceres CLONE 2028803
  misc_feature (52)..(135): Pfam Name: Ribosomal_L27e Pfam Description: Ribosomal L27e protein family
  misc_feature (7)..(40): Pfam Name: KOW Pfam Description: KOW motif
MVKFLKPGKVVVVLSGRFAGKKAVIVRNHDDGTTGRPYGCALLVGLRKEPRKVTKRQTAKRQAKKSTLKTFIKTVNYNHLMPTRYTLDVDFSKSITAEVVENSTKKVEASKEAKKLLEEKFKTGKNRWFFTKLRF

SEQ ID NO: 46091 - DNA, 352 bp, Panicum virgatum
  misc_feature: Ceres CLONE 2028806
  misc_feature: Encodes the peptide sequence at SEQ ID NO. 46092
atattgagtaattataagaataatatggaccgaagggaacccattccccagaaggaaccgactaagctccgggtccgtccttggaagccgggaaccgctcccgatcggaattgccaccgccgcatttgatgggattccttcctcaaaatgggaagaacccgaaggaacttaagggtggtggctgatttattaaatgccccaagggccaacttgggagttggactcctatgatttgatggccgctaatgatgctccagaaagggatcccatggactgggttcctggagccagcaccgaaggaagctccacctggaatgccattgacacccgcaggtctgaaataattgagaac

SEQ ID NO: 46092 - protein, 52 aa, Panicum virgatum
  misc_feature: Ceres CLONE 2028806
  misc_feature: SWISSPROT Homolog: EC 3.5.1.52 Peptide-N(4)-(N-acetyl-beta-glucosaminyl)asparagine amidase
MPQGPTWELDSYDLMAANDAPERDPMDWVPGASTEGSSTWNAIDTRRSEIIE

SEQ ID NO: 46093 - DNA, 629 bp, Panicum virgatum
  misc_feature: Ceres CLONE 2028819
  misc_feature: Encodes the peptide sequence at SEQ ID NO. 46094
acatttcagatcggcctgagcggcggcctggagacgctgtgcggtcaggcctacggcgccggtctgtaccgccgtctcggcctctacctgcaatcatccctcatcgtctccgcggcggcgtccgcgctcgtcgccattctatgggcgttcacggagccgctgctcctcctcctgcggcaggatcccgagatctcccgcgcggcggcggcgttcgcccgtgcccagatccccggcctcttcgccttcgcctccatgcagtgcctgctccggtacctgcagatgcagtccgtcgtcgcgccgctcgtcgcattctccgccgcctcgttcgcgctccacctcgtgctcgcgtacctgctggtcaccgtgctcggcctggggctcgccggagcggccgccgccgtctcggtctcctactgggtcgcctgcctggctctgctcgcctacgcgctgcgttcgggggagttcggcgagacgtggaaggggttctccgtcgaagatttcggatacgtgctgcccaccgtgaagctcgccgcgccgtctgccgtcatggtctgcttcgagtactgggcgtttgagctactggtccttgtcgctggattgctcccgaattccacagtgagcacgtcgct

SEQ ID NO: 46094 - protein, 209 aa, Panicum virgatum
  misc_feature: Ceres CLONE 2028819
  misc_feature (1)..(118): Pfam Name: MatE Pfam Description: MatE
TFQIGLSGGLETLCGQAYGAGLYRRLGLYLQSSLIVSAAASALVAILWAFTEPLLLLLRQDPEISRAAAAFARAQIPGLFAFASMQCLLRYLQMQSVVAPLVAFSAASFALHLVLAYLLVTVLGLGLAGAAAAVSVSYWVACLALLAYALRSGEFGETWKGFSVEDFGYVLPTVKLAAPSAVMVCFEYWAFELLVLVAGLLPNSTVSTS

SEQ ID NO: 46095 - DNA, 567 bp, Panicum virgatum
  misc_feature: Ceres CLONE 2028821
  misc_feature: Encodes the peptide sequence at SEQ ID NO. 46096
cggaggatctgccccgggctggccatgggcacgacgcacatcgcgctgatggtggcgcggatggtgcaggcgttcgagtggcgcgcgcacccgtcgcagccgccgccggacttcaaggacaaggtggagttcacggtggtgatggaccgcccgctgctcgccgcggtcaggccccggagcctctccttctgatcggatcgtcagctagcgtggcggcaccggccgacacgcacgacgtcgtcgtcgttcgtacgtgtgcacgcgcggctgcacatgcatgcatggccgcgggccgtgggccgtgggctgcatgctgccttgaatcctttccgatcaggacgcgtggcgtatgggtacttgctagctatagctgctctctcctaccagcgtaccagtactccagtagtgtgagctgtgaacgaacgcctccatgtctgtgcgtctcttgccgtgtgttgcgtggtggtgacgtggtgtagcataaaaaaaatgctagcatgtgcgagtttataggaagtagtaattcacaatgtacaagagtgaaccctttttatcccttgcatttcc

SEQ ID NO: 46096 - protein, 63 aa, Panicum virgatum
  misc_feature: Ceres CLONE 2028821
  misc_feature: SWISSPROT Homolog: EC 1.14.13.21 Flavonoid 3'-monooxygenase
RRICPGLAMGTTHIALMVARMVQAFEWRAHPSQPPPDFKDKVEFTVVMDRPLLAAVRPRSLSF

SEQ ID NO: 46097 - DNA, 610 bp, Panicum virgatum
  misc_feature: Ceres CLONE 2028840
  misc_feature: Encodes the peptide sequence at SEQ ID NO. 46098
tcatcacaagcgaagcagagcacacaggaagcactccaccttcttcagccgcgctacctgctttccttcctgcttgctcgtgatcaccgagatcaggatgtctggttgcagcggcggcaactgcgggtgcggctccgcctgcaactgcggcggcggatgcaacggctgcaagatgttccctgacgtggaggccgcctccaccaccaccaccatggtcatcgccgccgccagcaacaaggcgagctccggcgggttcgaggcggccaccgagagcggcggctgcgactgcaacacctgcaagtgcggcaccagctgcggctgctcctgctgcagctgcaactgaggcggccatgcgccgccgccatggaagcacgaggagaaagccccccggcgtagtatataggagcagcgtctaaataagatcttgccaaccgtatattgtcgtgtcgtgtcgtgtcgtgtcgtgacatccatggtcgcctgccgtgtctcagctggggttgttgtctgaacgtctctggtgatcgacgacgcatgccggtcgtcgatctttagcttgtgtgtccgtcctcttcgtgcacgccacctttaatatatgtatttcagaact

SEQ ID NO: 46098 - protein, 81 aa, Panicum virgatum; identical to SEQ ID NO: 32704
  misc_feature: Ceres CLONE 2028840
  misc_feature (1)..(80): Pfam Name: Metallothio_2 Pfam Description: Metallothionein

SEQ ID NO: 46099 - DNA, 700 bp, Panicum virgatum
  misc_feature: Ceres CLONE 2028855
  misc_feature: Encodes the peptide sequence at SEQ ID NO. 46100
agcaagcaatgatcttaatgaagaaactatagatgctctaaacaagcagggccacgaggtagatgcatttggtattggcacctacctggttacatgctatgcacaagccgcactcggttgtgtattcaaattagttgaaattaacaaacagcctcgcattaaactctctgaagatgtcacaaaggtgtcaataccatgtaagaaaaaatgctacagattgtatggcaaagaaggatatccattggttgatataatgactggtgaagatgagccaagtccaaagattggcgaaaggctgctgtgtcgtcaccctttcaatgaatcaaagagagcatacgttgttccacagcatgttgaggaattactgaagtgctactggcctggaaattcatccaattcacgggaggagcttccatcactccacgagattaggactcggtgcattcagcatttggtccgaatgaggccagaccatatgcggaggctgaacccaactccttacaaggtaagcgtgagtgctaaattgtacgacttcatccacttcttgtggctcaatgaagcgcccgttggagaactgcaatgaagaaacgaggtggtggggggcgcccaaggctaacagtaataagctgatccaaataagctgttgtcacgggatcattttctgcagatgtttttaccatccgtgtttcagtaaaatgtg

SEQ ID NO: 46100 - protein, 193 aa, Panicum virgatum
  misc_feature: Ceres CLONE 2028855
  misc_feature: SWISSPROT Homolog: EC 2.4.2.11 Nicotinate phosphoribosyltransferase
ASNDLNEETIDALNKQGHEVDAFGIGTYLVTCYAQAALGCVFKLVEINKQPRIKLSEDVTKVSIPCKKKCYRLYGKEGYPLVDIMTGEDEPSPKIGERLLCRHPFNESKRAYVVPQHVEELLKCYWPGNSSNSREELPSLHEIRTRCIQHLVRMRPDHMRRLNPTPYKVSVSAKLYDFIHFLWLNEAPVGELQ

SEQ ID NO: 46101 - DNA, 649 bp, Panicum virgatum
  misc_feature: Ceres CLONE 2028866
  misc_feature: Encodes the peptide sequence at SEQ ID NO. 46102
acagtgaagtcagccatggccctcgcgctcgccacgaccccactcactctcgcctacgccgcgctcgtcggagctggtggtgtgatgggatatatgaagagtggaagccagaaatccttggctgcaggaggcatatcagctctcgtcctgtacttcgtccacactcaactcccggtgaggcctgtctttgcatcatcaattggtctaggcatatcggctgcgctactgtcagtgatggggtctcgcttcaagaagtccgggaagatattcccagccggtgttgtgtcactcgtgtccctggtcatggtcggaggctacttccatgggatcttgcgtagctcccatgcttgatagaatccatttccatcacaccatctgcaccacgcattgggatcactatcaagttttatgtttcatccgctttaggcaccctttgttgttttaaattccgatgaactctttcactttttggtggatgtttcaagtgttcttagagttgccgttctcaagtttagttcatgttcagtgcctctgtgggacagacagccaataagcacatgactgtgagtagctggtagttgtgaaagacgagaatgtatttctttttttggaattttgaaagacgaactttttgaaaatcagttctagt

SEQ ID NO: 46102 - protein, 111 aa, Panicum virgatum
  misc_feature: Ceres CLONE 2028866
  misc_feature (8)..(105): Pfam Name: TMEM14 Pfam Description: Transmembrane proteins 14C
MALALATTPLTLAYAALVGAGGVMGYMKSGSQKSLAAGGISALVLYFVHTQLPVRPVFASSIGLGISAALLSVMGSRFKKSGKIFPAGVVSLVSLVMVGGYFHGILRSSHA

SEQ ID NO: 46103 - DNA, 713 bp, Panicum virgatum
  misc_feature: Ceres CLONE 2028873
  misc_feature: Encodes the peptide sequence at SEQ ID NO. 46104
ccacggagttctgaacgcggttgcctggggcatcctgatccccaccggcgccatcatcgcccggtacctgcgcgtgttcgagtccgcggacccggcgtggttctacctccacatcgcctgccagtgctccggctacatcctgggcgtcgccggctggggcctggggctcaagctcggcagcgagtccgtgggcatcacctaccagccccaccgcaacatcggcatcgccatcttctgcctggccacgctgcaggtgttcgcgctgctgctgaggcccgacaagaagaacaagtacaggctctactggaacatctaccaccactccgtcggctactccgtcatcatcctcagcgccatcaacatcttcaagggcttcgacgccctcaagccggccagcggctacaagaccgcctacattgtcgtcctggccacgctcggcggaatcgcgctctgcctcgaggccatcacctggcccatcgccatccggaagcgcaggcgcgccgccgacaagcaggcgtccaacggcaccgccggctggcaacagggcgcgtgagcaccggggtctccggcaggtgccacagtgcgcgcgcgcgtgcttagttttgctgcgagcgagggagcgatgtgatatcgatcgatgttgttttggagatgttggtgtacctttcctgttcctgcttctgtagagatcgagtagctctcttttcttctat

SEQ ID NO: 46104 - protein, 183 aa, Panicum virgatum
  misc_feature: Ceres CLONE 2028873
  misc_feature: Functional homolog of the protein sequence given in SEQ ID NO 50252
  misc_feature: Useful for making plants with modulated phosphate use efficiency
HGVLNAVAWGILIPTGAIIARYLRVFESADPAWFYLHIACQCSGYILGVAGWGLGLKLGSESVGITYQPHRNIGIAIFCLATLQVFALLLRPDKKNKYRLYWNIYHHSVGYSVIILSAINIFKGFDALKPASGYKTAYIVVLATLGGIALCLEAITWPIAIRKRRRAADKQASNGTAGWQQGA

SEQ ID NO: 46105 - DNA, 661 bp, Panicum virgatum
  misc_feature: Ceres CLONE 2028875
  misc_feature: Encodes the peptide sequence at SEQ ID NO. 46106
caagaacctgtatatcatttcagtgaagggaatcaaagggcgccttaacaggcttccttctgcctgtgttggtgacatggttatggcaactgtgaagaagggaaagcctgacctcaggaagaaggtgatgccagctgtcattgtgaccaacaaccagcagccatatatatagcagtaaataaataaagcgatatacttattattagcaactgtgccaattcagggtctgattggcagtcaactaatagctgaaccggcgatggctcccggcggcgtggcaccaaggaagaacacgatggtcctttcctgcgtgctggccctgatggtgctcctgctgatggccacgcaggcggtggcagaggcggcggcggccggcgacgacggaggcaaagcacgccggctgctgctgctggggtgccactacagcgcctgtaactgccgcacttgctcgatatatggctgggcgtgctgcgtttcttgctgctagagagccgcgcacctttgctcttccatgtttcggacgcagtagccagcacatggcccggtgccctgtgcggcaatagttctcagcttatgatgatgatgatgatgccctttcgaatttgcaataataaagcttgtgtgcacgagcactgctgaataaattaaacctcttccttgg

SEQ ID NO: 46106 - protein, 56 aa, Panicum virgatum
  misc_feature: Ceres CLONE 2028875
  misc_feature: Functional homolog of the protein sequence given in SEQ ID NO 50297
  misc_feature: Useful for making plants with modulated biomass
  misc_feature: Useful for making plants with modulated heat sensitivity
KNLYIISVKGIKGRLNRLPSACVGDMVMATVKKGKPDLRKKVMPAVIVTNNQQPYI

SEQ ID NO: 46107 - DNA, 653 bp, Panicum virgatum
  misc_feature: Ceres CLONE 2028883
  misc_feature: Encodes the peptide sequence at SEQ ID NO. 46108
tccagaaccgcgggctcaacctcacggacctcgtcgcgctctccggcgcgcacaccatcggcgtcgccagctgctccagcgtcacgccgcggctgtaccaggggaacgccaccagcgtcgacccgctgctggacgccgcctacgcccgggcgctcatgtcgtcgtgcccctccgcggccgcgcccggcaccatcagcctcgacggcggcacggcgctcaagttcgacagcagctacttcaccaacgtgctcaacaagcaggggacgctcgcctccgacgccgcgctcacgcagaacgccgccgccgcgcagatggtgcaggacctgaccaaccccatcaagttctacgccgccttctccatgtccatgaagaagatgggccgcgtcgaggtgctcaccggcaccagcggccagatcaggaagcagtgccgccaggtcaacagctcctgatcggccgcccgccgccggcgagctcctcctcccctccttctcagtgattccttttggtttctcctgcctgcctgccttcctcctcttcctctcgttacaacgaccggtcggcgcggatcaatatattccgttccgcgccggcgattgatcagctcgatcctcccaaggtccattggtttgtcatgtgctcggttgtcttgcaaa

SEQ ID NO: 46108 - protein, 148 aa, Panicum virgatum
  misc_feature: Ceres CLONE 2028883
  misc_feature: SWISSPROT Homolog: EC 1.11.1.7 Peroxidase
QNRGLNLTDLVALSGAHTIGVASCSSVTPRLYQGNATSVDPLLDAAYARALMSSCPSAAAPGTISLDGGTALKFDSSYFTNVLNKQGTLASDAALTQNAAAAQMVQDLTNPIKFYAAFSMSMKKMGRVEVLTGTSGQIRKQCRQVNSS

SEQ ID NO: 46109 - DNA, 770 bp, Panicum virgatum
  misc_feature: Ceres CLONE 2028886
  misc_feature: Encodes the peptide sequence at SEQ ID NO. 46110
ctcttctttccttccatccctttgcaattagataatcatcatccatcctcttttcactgcacgctcgctctagagccctgctgtgaggttggcatccatggccgggagcgggagcagcagcagcagcagcagcagcagctcgtcgccctgcgcatcgtgcaagttgctgcggcggcggtgcacccaagagtgcgtgttcgcgccctacttccctcctgaggatcctcacaagtttgccatcgtccacaaggtctttggcgccagcaatgtcagcaagatgcttcaggagctgcctgctcagcagagggcggatgcggtgagcagcctggtgtacgaggccaacgcacggatgagggacccggtctacggctgcgtcggcgctatctcctacctccagcagcaggtttcccagctccaggtgcagctcgcccttgccaaggccgagatcctctgcgtccatgcaactgcttcatcatcaccatcatcgccatcgcaacaacgtcagcagcagatcatggaaagcgaggcttatgttagtagcttgctcatgcaaaataccctgatgaacagcagtagtgccgctcatcatcagcagcagatgttgggcagcagcttgggttcctcggggagcactgcaactgctgcaatgatgctgcaggaggcgtgcctcaagaaagagtccctctgggcgtgaacttatatttctgcccacttctgttattttccgaaaagatgggaaattgatacatacaggccgagataattggggc

SEQ ID NO: 46110 - protein, 198 aa, Panicum virgatum
  misc_feature: Ceres CLONE 2028886
  misc_feature: Functional homolog of the protein sequence given in SEQ ID NO 51714
  misc_feature: Useful for making plants with modulated biomass
  misc_feature: Functional homolog of the protein sequence given in SEQ ID NO 51715
  misc_feature: Useful for making plants with modulated flowering time
  misc_feature: Functional homolog of the protein sequence given in SEQ ID NO 51716
  misc_feature: Useful for biocontainment applications
MAGSGSSSSSSSSSSSPCASCKLLRRRCTQECVFAPYFPPEDPHKFAIVHKVFGASNVSKMLQELPAQQRADAVSSLVYEANARMRDPVYGCVGAISYLQQQVSQLQVQLALAKAEILCVHATASSSPSSPSQQRQQQIMESEAYVSSLLMQNTLMNSSSAAHHQQQMLGSSLGSSGSTATAAMMLQEACLKKESLWA

SEQ ID NO: 46111 - DNA, 640 bp, Panicum virgatum
  misc_feature: Ceres CLONE 2028894
  misc_feature: Encodes the peptide sequence at SEQ ID NO. 46112
gtgtcccggttcgcgagctccctccctccggccggcggcggcttgcccaccccgccgcgcggcagcccacccaatccacagccggacacggcgcccaagctcagggcggcgctgcccgcgctcaccgacgagctcatcggcctcatgatgcagccgccgttccggtcctaccaccccgacatcgtccaggagcccgccatatacagattgaatgaagctgtcatgcattttggagagagcatcaaggaaatcatcaatgaggaatttggtgatggaatcatgtcggccatagatttctactgttcagttgacaaggttcaaggtgctgacggcaaagatcgtgtggtggtcacatttgacgggaagtatctgccttacactgaacagaaatctgagcatatgatatcaaggccggcccgcaagacatcttgagactgttggtgacagggagaaagattcttttacgacatggagccaccatgcagcaatttggatttgaaaagggtcgagcgtgcctgttttttttttctctccaaataatcaacgaaagcaaacaggccctgaactgataaagcctggttttacccttgtttgacaggtacgccaataataaagaataaacatatgattgttggactgc

SEQ ID NO: 46112 - protein, 143 aa, Panicum virgatum
  misc_feature: Ceres CLONE 2028894
  misc_feature (56)..(129): Pfam Name: Cyanate_lyase Pfam Description: Cyanate lyase C-terminal domain
  misc_feature: SWISSPROT Homolog: EC 4.2.1.104 Cyanase
VSRFASSLPPAGGGLPTPPRGSPPNPQPDTAPKLRAALPALTDELIGLMMQPPFRSYHPDIVQEPAIYRLNEAVMHFGESIKEIINEEFGDGIMSAIDFYCSVDKVQGADGKDRVVVTFDGKYLPYTEQKSEHMISRPARKTS

SEQ ID NO: 46113 - DNA, 248 bp, Panicum virgatum
  misc_feature: Ceres CLONE 2028896
  misc_feature: Encodes the peptide sequence at SEQ ID NO. 46114
gtttatcctcgctcatcctgcccccctgccccgcgccacgccatgtccgcgacctggtggccgaggcggaggaccatcagccgcataggtgggaagagggactgcgcttgtgcgccaaccactgcggcttcttcggcagccccggctggctggacctctgctcccagtgctcccgctacctcctgcaccggcagcccgctgcccccgcgccgccggccttctcgccgccccccgccgccgcctcttcc

SEQ ID NO: 46114 - protein, 81 aa, Panicum virgatum
  misc_feature: Ceres CLONE 2028896
  misc_feature (34)..(58): Pfam Name: zf-A20 Pfam Description: A20-like zinc finger
LSSLILPPCPAPRHVRDLVAEAEDHQPHRWEEGLRLCANHCGFFGSPGWLDLCSQCSRYLLHRQPAAPAPPAFSPPPAAAS

SEQ ID NO: 46115 - DNA, 547 bp, Panicum virgatum
  misc_feature: Ceres CLONE 2028897
  misc_feature: Encodes the peptide sequence at SEQ ID NO. 46116
ggcgcagggtgagtcggctcctaaggcgaaggccgagaaggcccccaaggcggagaagaagcccaaggccgagaagcggctgccggcgtccaaggagggcggcgacaagaagggcaagaagaaggccaagaagagcgtcgagacctacaagatctacatcttcaaggtgctaaagcaggtgcacccggacatcggcatctcctccaaggccatgtcgattatgaactcgttcatcaacgacatcttcgagaagctcgcgcaggaggctgcgcgcctcgccaggtacaacaagaagcccaccatcacgtcgcgcgagatccagacctcggtccgcctcgtcctccccggcgagctcgcgaagcacgccgtctccgagggcaccaaggccgtcaccaagttcacctcctcctagattgctagatgatgcgccccctttgaccttgtctgttcttcgcctctttcccctagttaggggtcgaggattagtttgtaattgatgatgctggtttacgaaacgatgaaatgaattggcaatgccacgtttggt

SEQ ID NO: 46116 - protein, 136 aa, Panicum virgatum
  misc_feature: Ceres CLONE 2028897
  misc_feature (43)..(113): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
AQGESAPKAKAEKAPKAEKKPKAEKRLPASKEGGDKKGKKKAKKSVETYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 46117 - DNA, 472 bp, Panicum virgatum
  misc_feature: Ceres CLONE 2028905
  misc_feature: Encodes the peptide sequence at SEQ ID NO. 46118
gcacacacgacacacagcgccctcgctcgcacttcctccgctcgtctgacatctcctcccgtcctttcctttcgaagcctcggggatcccagcgatggccgcctccgccaccctggtgtcggtcgacgagaagatcgagaagcttcgcaccgaggtcgccaagctcgaccagatcagcgagaacgagaagtccggcttcatcagcctcgtgtcgcgctacctcagtggggaggcggagcagatcgagtggagcaagatccagaccccgaccgatgaggtggtggtgccgtacgacaccctcgcgtcgcctcccgaagatctcgaggagacgaagaagctgctggacaagctcgttgtgctcaagcttaatggagggctcggcacgaccatgggctgcactggccccaagtctgtcattgaggtccgtagtcgacagattgtggtctcctcgagttttttttttttttttttt

SEQ ID NO: 46118 - protein, 125 aa, Panicum virgatum
  misc_feature: Ceres CLONE 2028905
  misc_feature: SWISSPROT Homolog: EC 2.7.7.9 UTP--glucose-1-phosphate uridylyltransferase
MAASATLVSVDEKIEKLRTEVAKLDQISENEKSGFISLVSRYLSGEAEQIEWSKIQTPTDEVVVPYDTLASPPEDLEETKKLLDKLVVLKLNGGLGTTMGCTGPKSVIEVRSRQIVVSSSFFFFF

SEQ ID NO: 46119 - DNA, 682 bp, Panicum virgatum
  misc_feature: Ceres CLONE 2028915
  misc_feature: Encodes the peptide sequence at SEQ ID NO. 46120
gtagctagctgcagcagatcagttgatcacaaaatgtctcatctgagcattctctccttcaagtacaatctcgccaagctccggtccaaggccggccgtcctgtggggcggcccctgtcggccagggaccggcagttctccgacctgagcacctacaggcctgacgaggaggagatgaagaaagtgttccacatgatcgctagggacccccgcgggatcaacaagaaggacctgcagctgctcctggagaggctcgggaaggcggacgccgccggcgaggcgcggcggatgatgtgcgtcgcggaccacaacaaggacgggtacatggacctggaggagttcatggaggttcacaagaacggcgtgcagctgggggacatccggcgggcgttcttcgtgttcgacaggaacggggacggcaggatcagcgccgaggagatcatgacggtgctgctcaagctcggggagagctgcagcctggagagttgccggaagatggtgagggagatcgacgggaacggggatggcttcgtcgacatggacgatttcatggccatgatgactcgcccacggaggaagctgtgagctctggagctgtgtggagcactggaattccatgtactctccgatgtaaatatatgtcatgcgtgcaaaccacatccagaataagataaccggattc

SEQ ID NO: 46120 - protein, 183 aa, Panicum virgatum
  misc_feature: Ceres CLONE 2028915
  misc_feature (115)..(143): Pfam Name: efhand Pfam Description: EF hand
  misc_feature (151)..(179): Pfam Name: efhand Pfam Description: EF hand
  misc_feature: SWISSPROT Homolog: EC 2.7.11.1 Non-specific serine/threonine protein kinase
MSHLSILSFKYNLAKLRSKAGRPVGRPLSARDRQFSDLSTYRPDEEEMKKVFHMIARDPRGINKKDLQLLLERLGKADAAGEARRMMCVADHNKDGYMDLEEFMEVHKNGVQLGDIRRAFFVFDRNGDGRISAEEIMTVLLKLGESCSLESCRKMVREIDGNGDGFVDMDDFMAMMTRPRRKL

SEQ ID NO: 46121 - DNA, 738 bp, Panicum virgatum
  misc_feature: Ceres CLONE 2028931
  misc_feature: Encodes the peptide sequence at SEQ ID NO. 46122
tctctctttctcccctatccgcatcacatcatgggcgcctacaagtatgtccaggaactctggaggaagaagcagtccgacgtgatgcgcttcctcgccaggcttaggtgctgggagtacaggcagtaccccatggttctgcgcgtcagcaggcccagccgccccgacaaggcccgccgtctcggctacaaggccaagcagggctacgtcatctacagagtgcgcgtccgccgtggtggccgcaagaggaagatcaggaagggtcgcgtccacggtaagcccgccacccagggagtcaacgccctcaagttccagaggtccctccgttccgtcgctgaggagcgtgctggccgtcgctgcggcaacctccgcgtcctcaactcgtactgggttgcccaggatgccaccttcaagttcttcgagatcatcctcgtggatcccttccacaaggccgtccgtcgcgaccccaagatgaactggatcgccaaccccacccacaagcaccgcgagatgaggggtctgacctccgctggcaagaagtacaggggtctccgtggcaagggtcacaactacaccaagtccaggccctcgaggcgcgccgtctggaagaggaacaacaaggtttccctcaggcgttaccgttaaacgtaacggttgtagcttatgcgctacttccttccacctcgagtgggatttgttgttgttgccccctttcaacacagattgttctctttcttc

SEQ ID NO: 46122 - protein, 204 aa, Panicum virgatum
  misc_feature: Ceres CLONE 2028931
  misc_feature (2)..(193): Pfam Name: Ribosomal_L15e Pfam Description: Ribosomal L15
MGAYKYVQELWRKKQSDVMRFLARLRCWEYRQYPMVLRVSRPSRPDKARRLGYKAKQGYVIYRVRVRRGGRKRKIRKGRVHGKPATQGVNALKFQRSLRSVAEERAGRRCGNLRVLNSYWVAQDATFKFFEIILVDPFHKAVRRDPKMNWIANPTHKHREMRGLTSAGKKYRGLRGKGHNYTKSRPSRRAVWKRNNKVSLRRYR

SEQ ID NO: 46123 - DNA, 419 bp, Panicum virgatum
  misc_feature: Ceres CLONE 2028949
  misc_feature: Encodes the peptide sequence at SEQ ID NO. 46124
atcggcatccttacccttctttttggtcccttcacaagatgacacagaaaagacgaaaccacggaagatccaaacacggacgaggacatgttaaacgcgtaaactgcgaaggatgtaaatgtttacctgctaaggataaatgcatcaaaagatttcaagtcaggggtatggtcgaccaatctgctctcagagatctcgaagaaaactctgctctcggagatgttgaatacgttttgccaaaaacctacatcaagactcactactgtgtctcctgtgctatccacagaaagactgttcgtgtccgatcagtcactgaccgtagaatcagaacattcgaacgtggacctcaacgaaaatatcaaaagtaaactctctttcttcgtcgtgaagggacaataaaatgatagaattttaatcag

SEQ ID NO: 46124 - protein, 109 aa, Panicum virgatum
  misc_feature: Ceres CLONE 2028949
  misc_feature (1)..(109): Pfam Name: Ribosomal_S26e Pfam Description: Ribosomal protein S26e
  misc_feature: Functional homolog of the protein sequence given in SEQ ID NO 50755
  misc_feature: Useful for making plants with modulated nitrogen use efficiency
MTQKRRNHGRSKHGRGHVKRVNCEGCKCLPAKDKCIKRFQVRGMVDQSALRDLEENSALGDVEYVLPKTYIKTHYCVSCAIHRKTVRVRSVTDRRIRTFERGPQRKYQK

SEQ ID NO: 46125 - DNA, 563 bp, Panicum virgatum
  misc_feature: Ceres CLONE 2028955
  misc_feature: Encodes the peptide sequence at SEQ ID NO. 46126
gcagaccaggcaaccatatcaaaatacatggagagcatgtggggtacgggcttgcgagtgcgcaaggatgagaaaggcttggtgacaaggtatgaggttgaacggtgtatcaaggaagtgatggatggggataggaaggatgagattaggaggaacgccactaagtggatgcagaaggccaaggaggcaatgcagaaaggagggagctcaagcaagaatatagccgaatttgcggcgaagtattcatcatgttaaatgataaaaacatccagtgatacggaatgtctttgggagcataaccagtctttagtccttgtggcattgtcttccaaaatgttgtgggagactaaacacatattgttattttgttgtgtcagcactcagcaattcgcattttaagtgctatcactagcacctgtgtgtctcgtatttaaatgtgaagagcctctgtgctctacaaggacaaggagctcatagatcttcttacatgtaccttatctatttaataaccgtgtaacattaggagcatacaataattttaattatgaaacatccgtttcttt

SEQ ID NO: 46126 - protein, 84 aa, Panicum virgatum
  misc_feature: Ceres CLONE 2028955
  misc_feature: SWISSPROT Homolog: EC 2.4.1.121 Indole-3-acetate beta-glucosyltransferase
ADQATISKYMESMWGTGLRVRKDEKGLVTRYEVERCIKEVMDGDRKDEIRRNATKWMQKAKEAMQKGGSSSKNIAEFAAKYSSC

SEQ ID NO: 46127 - DNA, 504 bp, Panicum virgatum
  misc_feature: Ceres CLONE 2028959
  misc_feature: Encodes the peptide sequence at SEQ ID NO. 46128
gctcaactctccggagggcagaagcagcgcgtagccattgctcgcgccatcgtgaaggaccccaagatcctcctcctcgatgaggcgacgagcgcgctcgacgccgagtccgaacgggtggtacaggacgctctggacaaggtgatggtgaacagaacaacggtcatcgtggcgcaccgcctgtccacgatacagggtgccgatgtgatcgcggtggtgaaggatggtgtgatcatcgagaaggggaggcacgataccttggcgaacatcgaaggcggggcgtacgcgtccctcgtcgcgttgcattcagcagcaccgtcgtagcacatggcaacgatagatcaggcagaagtgatgctgaatctgtggttgctggagcaagcctggcagcctaacaaagttcaggcgccggttctttgctgtccaggtcctgatggaatagacggaaggccaagatttatagatgtaactcccgcgcagctaaagcaggaaagaagattacag

SEQ ID NO: 46128 - protein, 107 aa, Panicum virgatum
  misc_feature: Ceres CLONE 2028959
  misc_feature (1)..(76): Pfam Name: ABC_tran Pfam Description: ABC transporter
  misc_feature: SWISSPROT Homolog: EC 3.6.3.44 Xenobiotic-transporting ATPase
  misc_feature: The sequence is a functional homolog of SEQ ID NO 3 in US patent 7041874
AQLSGGQKQRVAIARAIVKDPKILLLDEATSALDAESERVVQDALDKVMVNRTTVIVAHRLSTIQGADVIAVVKDGVIIEKGRHDTLANIEGGAYASLVALHSAAPS

SEQ ID NO: 46129 - DNA, 557 bp, Panicum virgatum
  misc_feature: Ceres CLONE 2028967
  misc_feature: Encodes the peptide sequence at SEQ ID NO. 46130
gatagagagagagagagtttgggagggggagagagagagagagagtttgggagggaggtcagcgaggagaaagaagaggagcaagaagaagagggtgatcggagatgtcggactgggggccggtggtggtggcggtggtgctgttcgtgctgctctcgccggggctgctgctgcagctgccggccaagggcggccgcttcgtcgagttcggcaacttccagaccagcggcgcctccatcttcgtccacgccatcatcttcttcgccctcaccgccgtcttcctcgtcgccatcggggtccacatcaccaccgactagccaccccggtgatcatggcgctaccactacctgcctgcccagtgaggagcacttcgtgcgttacggcagcctgtatctgcatcagtatttgcagattgtaaatttgtaactgtaccgtacccctctgctagcagttaagcgtttatcttatacatgcaaggatttgtaatcttaccaggctgattttaaaagaattgtacactagcctctgaatttttgtccgattattctatttgttcc

SEQ ID NO: 46130 - protein, 70 aa, Panicum virgatum
  misc_feature: Ceres CLONE 2028967
  misc_feature: Functional homolog of the protein sequence given in SEQ ID NO 50117
  misc_feature: Useful for making plants with altered cell wall content and/or composition
MSDWGPVVVAVVLFVLLSPGLLLQLPAKGGRFVEFGNFQTSGASIFVHAIIFFALTAVFLVAIGVHITTD

SEQ ID NO: 46131 - DNA, 597 bp, Panicum virgatum
  misc_feature: Ceres CLONE 2028981
  misc_feature: Encodes the peptide sequence at SEQ ID NO. 46132
agatgatgatttctatcggctttttggctgcaacaggagtgctagtggcaaatgagcttggagctggaagtgcaagaagggccaagtttgcgatatacaatgtcgtcatcacgtctttcttgatcggatttgtgttgtttgtgctcttccttttcttccgtggaaaccttgcttacatatttactgagagtctagcagtggccgatgctgttgctgacctctcacctctgctagccttctccatattggtaaacagagttcaaccagtgctatcaggtgtccctgttggtgctggctggcaaagtgtagatgcctacgttaacattacatcatactacttgagtgatgtcccccttggaggagtcctaggctatgtagtgggacttcatgtaaagggcatttggattggcatgctgctcggaacactggtccaaactattgtgcttctgttcataacattaaagaccgactgggaaaaactggtggtgactgctcaagagagattgaagagatggtacatggaagaaaacagaagactgcagggctctaggagcaatccttgaaccggccctgataagtggacctttgtgagttaac

SEQ ID NO: 46132 - protein, 186 aa, Panicum virgatum
  misc_feature: Ceres CLONE 2028981
  misc_feature (1)..(121): Pfam Name: MatE Pfam Description: MatE
MMISIGFLAATGVLVANELGAGSARRAKFAIYNVVITSFLIGFVLFVLFLFFRGNLAYIFTESLAVADAVADLSPLLAFSILVNRVQPVLSGVPVGAGWQSVDAYVNITSYYLSDVPLGGVLGYVVGLHVKGIWIGMLLGTLVQTIVLLFITLKTDWEKLVVTAQERLKRWYMEENRRLQGSRSNP

SEQ ID NO: 46133 - DNA, 531 bp, Panicum virgatum
  misc_feature: Ceres CLONE 2028983
  misc_feature: Encodes the peptide sequence at SEQ ID NO. 46134
aaggctacttccgcttaacaaccatgtctctcgtaaagttaacgccttctgatgatgaaaaagcagttgtcgaagtatcactcgaagttgcaaatatgtcagtaactatcaaaaacatgcttgaagatctcggcggtggtgttcctgatgttgctatccctctccataacgtcactgcaaaggttcttggaaaagtcgtcgaatactgcaaataccatgttgaaaacccaaccaaggctgacgactccaagaaaggatctgaagacatttcaccttgggataagaacttctgctctgttgatcaagctaccttgttcgaacttatcctcgccgccaactaccttgatatcaagcctcttttggatttgacttgtaagactgtcgcaaacatgatcaaaggaaagactcctgaagaaatccgtaaaaccttcaacatcaaaaatgacttcactccagaagaagaggaaaaagtcagaaaagaaaacgaatggtgtgaagaaagataaatgtaaagaataaaccgcttgtcat

SEQ ID NO: 46134 - protein, 160 aa, Panicum virgatum
  misc_feature: Ceres CLONE 2028983
  misc_feature (82)..(159): Pfam Name: Skp1 Pfam Description: Skp1 family, dimerisation domain
  misc_feature (2)..(67): Pfam Name: Skp1_POZ Pfam Description: Skp1 family, tetramerisation domain
MSLVKLTPSDDEKAVVEVSLEVANMSVTIKNMLEDLGGGVPDVAIPLHNVTAKVLGKVVEYCKYHVENPTKADDSKKGSEDISPWDKNFCSVDQATLFELILAANYLDIKPLLDLTCKTVANMIKGKTPEEIRKTFNIKNDFTPEEEEKVRKENEWCEER

SEQ ID NO: 46135 - DNA, 725 bp, Panicum virgatum
  misc_feature: Ceres CLONE 2028992
  misc_feature: Encodes the peptide sequence at SEQ ID NO. 46136
tccaatggaggccccgctcttgtcctgcgaaagtgatgtcactgagaagggattctggacaaatctgaaggatactgtccaccaatttgtcgaggagctgatggcaccaccaacgatatccgcattaactgggtttgttgttggcctggtcccatggttgaaatcgctaatcatcggcgagggagctccgttcaaagttttacaggattccctccaactgatgggcaatggcacgattccttgcatcaccctcatcctaggtggaaacctgacgcaagggcttcggaagtcggggctcaagcgcacggtgatcatcgcgatcgtctgcatacgcttcgtgatcctgccgctgatcgggatcgccgtggtccatgccgcgtacggagtcgggttcctgtcccacgacccgctctaccgctacgtgctcatggtgcagttcgccctgcctcctgcgatgaacattggaaccatggctcagctgtttgatgttgcacaagaggaatgctccgtgatctttctctggacgtacctcgtatcggcgattgcgctgacgacgtggtcgacgatcttcatgtccattctgtcttgagccaccgcaggtgcaggaggcatggtcgtatttgcgagcctgtgctgcgcaaagattcagcttagcacagcagtatagctatagatagtacgtggtatgcagtagattatgatcccatgatcatttaggtaattat

SEQ ID NO: 46136 - protein, 195 aa, Panicum virgatum
  misc_feature: Ceres CLONE 2028992
  misc_feature (2)..(187): Pfam Name: Mem_trans Pfam Description: Membrane transport protein
PMEAPLLSCESDVTEKGFWTNLKDTVHQFVEELMAPPTISALTGFVVGLVPWLKSLIIGEGAPFKVLQDSLQLMGNGTIPCITLILGGNLTQGLRKSGLKRTVIIAIVCIRFVILPLIGIAVVHAAYGVGFLSHDPLYRYVLMVQFALPPAMNIGTMAQLFDVAQEECSVIFLWTYLVSAIALTTWSTIFMSILS

SEQ ID NO: 46137 - DNA, 450 bp, Panicum virgatum
  misc_feature: Ceres CLONE 2028997
  misc_feature: Encodes the peptide sequence at SEQ ID NO. 46138
agtcgacagattgtggtctcctcgagtttttttttttttttttttttgaataacatgggtgcatacagctacatctctcctcggctctatactgccatgaaggctcttgggcggggttcgtttgaagacatcaagtacataggcagagcaccttcagctgctacagccacaggcttcctgtcggttcatgtacaggagcagtcagagctggtaaagaaggcactgcagccggagccgatcaagttcccctgatgggatgcagatcctaacggtgtggtgaaataacatgaccctgacatgcctgtttgcaggaggctcaacataccgaacgtgcaatttaaaagttttgcacgttttctcttctttttcaattttgaggcttttatgtttttttgggaaataatgacgcattatgaagagacctgaagctgtgtgaaaccgatgtcattc

SEQ ID NO: 46138 - protein, 83 aa, Panicum virgatum
  misc_feature: Ceres CLONE 2028997
  misc_feature: SWISSPROT Homolog: EC 1.2.4.2 Oxoglutarate dehydrogenase (succinyl-transferring)
SRQIVVSSSFFFFFFLNNMGAYSYISPRLYTAMKALGRGSFEDIKYIGRAPSAATATGFLSVHVQEQSELVKKALQPEPIKFP

SEQ ID NO: 46139 - DNA, 717 bp, Panicum virgatum
  misc_feature: Ceres CLONE 2029014
  misc_feature: Encodes the peptide sequence at SEQ ID NO. 46140
gcttctgcctcctctctccacacgacttgctcccgccgccgccgccgccgtcgcagcagtcgccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggtcgcgccagttgttggccattcctgtactgctttcgtatcaagttattgaacaatgctactttgtcctttgagtaggctatgaagaatgggcttaagcaatggaattgtaatttaagcactcgtcttattgcaagttttggtctgttattgcctgaatgaatttaagtgcacttgatgcgtgacatgattttgttgctatcttgggtaacaacaatgaatggtttgtatgactaaaatctgaatttttactgtcaactacaaatccaaattgtttggtttggttgtccgggaatttgcatggtggttagttttagtcactagggtgtgtagtcagaagttgtgtcatggggtgcttgttggattttttgtcaataatgtaagtttatgagttacgccatcatgtacgggatcatttgcttc

SEQ ID NO: 46140 - protein, 65 aa, Panicum virgatum; identical to SEQ ID NO: 9766
  misc_feature: Ceres CLONE 2029014
  misc_feature (1)..(65): Pfam Name: Ribosomal_S28e Pfam Description: Ribosomal protein S28e

SEQ ID NO: 46141 - DNA, 517 bp, Panicum virgatum
  misc_feature: Ceres CLONE 2029019
  misc_feature: Encodes the peptide sequence at SEQ ID NO. 46142
cagtacaggaagcacaagaaagccacttctagccatcaacaacgacttcttcaccatcatcgtcacctaactcagacagtattagcgactgaagaagaagatgagctcctccgcggaaccagctgtgtgcggcggcggcggcaagacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtatgaataataatggatgtgtgttctttccctataaatcaaataaataagcaagggatgtgcccccggcatgtccctttcctctaaataatgccatattatgtgtaataaaagcatcgatcatatcctgg

SEQ ID NO: 46142 - protein, 74 aa, Panicum virgatum
  misc_feature: Ceres CLONE 2029019
  misc_feature (15)..(74): Pfam Name: potato_inhibit Pfam Description: Potato inhibitor I family
MSSSAEPAVCGGGGKTSWPEVVGMSIEEAKKVILKDKPDADIQVLPVGTPVTKDFRPNRVRIFVNTVAETPHVG

SEQ ID NO: 46143 - DNA, 1081 bp, Panicum virgatum
  misc_feature: Ceres CLONE 2029027
  misc_feature: Encodes the peptide sequence at SEQ ID NO. 46144
gaccccgatccatccgagcgaaccggcgaggaaggaggcagcccccgcaacaccaccagccatgtggcgccgcgcctcccagctcctcctccgcaccagcgccgccgccacccggcgcctcccgcttccgcccccaccccggccgctccccctcgcgcccacatgggtcgcttccgcgtcctcctcctacgccacccaggcagcggcggccgcggcggcgccggcgccggcgcggaggccgctgcggacggtggggtccctgctacggctgaacgacctgcgtgacaacccgggcgcgcggaagcagaagacgcgcaagggacgcgggatcggctccgggaagggcaagacggccggccgcggacacaagggacagaaggcgcgcggcaccgccaggttcggcttcgagggcggccagaccccgctccgccgccgcctgccccggcgtggattcaagaaccgcttctccctcacattccagccctgtggactagggaaaattgcaaagctcatcaatgctggaaaaattgattcctctgaactgatcacaatgaagacactaaaggaaacaggtgccattgggaagcaaataaaggatggaattcgcttaatgggtcgtggagcagaagaaatcaaatggccgattcaccttgaggtatcaaggacaacagcaagagcaaaagctgccgtggaagcagctggtgggacagtaaggctggtgtactacaacaagcttggcttccgagcgctcctgaaacctgagtggtttgagaagaagggccgcctgctaccaaaagcagcacggcctccgcccaagcaacgagataaggtggatagcattggccgcctgcccgcaccgacaaagccactccccttcacgccagaggagctggagtttgcagcaaagcgtgacgctgcttgtgtgagtgtgactgcataatattttttttttcaagtgaggcaccttttttttcattctacacaccacaaggcaggcccctctgaatatgtaccacattagttgggttaggggagggcatgtaagaacggaatgttatatcttgaaggtctcattcctcgc

SEQ ID NO: 46144 - protein, 292 aa, Panicum virgatum
  misc_feature: Ceres CLONE 2029027
  misc_feature (68)..(167): Pfam Name: Ribosomal_L15 Pfam Description: Ribosomal protein L15 amino terminal region
MWRRASQLLLRTSAAATRRLPLPPPPRPLPLAPTWVASASSSYATQAAAAAAAPAPARRPLRTVGSLLRLNDLRDNPGARKQKTRKGRGIGSGKGKTAGRGHKGQKARGTARFGFEGGQTPLRRRLPRRGFKNRFSLTFQPCGLGKIAKLINAGKIDSSELITMKTLKETGAIGKQIKDGIRLMGRGAEEIKWPIHLEVSRTTARAKAAVEAAGGTVRLVYYNKLGFRALLKPEWFEKKGRLLPKAARPPPKQRDKVDSIGRLPAPTKPLPFTPEELEFAAKRDAACVSVTA

SEQ ID NO: 46145 - DNA, 535 bp, Panicum virgatum
  misc_feature: Ceres CLONE 2029043
  misc_feature: Encodes the peptide sequence at SEQ ID NO. 46146
ggctgtggggttcgatcaaggcgcttgcccgaggctatgagatcatcatgggcctgctgttgttcaccccgatcgcgttccttgcttggttcccgtttgtttcggagttccagacaaggatgctgttcaaccaggccttcagtagaggtctgcagatctcgcgcattctaggcgggcacaagaaagaccgggcaacacggaacaaggagtaggtagtattgtagacgcccttaaactagccggcatccccgtccgccttgagtgtaaattatgattcctctttcaactctgttggagtattttaatgtaatcgtacgaatgaatgagagcgagagtgagagagagagagagatcgagccgggggtggtggtaaatcagcaatttagcattttgtccgtggatgttacagccttgtattggttgatgattggagtggagaccccgggatttttatgctgtagttggagggaaatcaattctgcaaacatgccagtcaagcttatgtgtgtatatatatattctctatttaacaccc

SEQ ID NO: 46146 - protein, 69 aa, Panicum virgatum
  misc_feature: Ceres CLONE 2029043
  misc_feature: Functional homolog of the protein sequence given in SEQ ID NO 51717
  misc_feature: Useful for making plants with altered cell wall content and/or composition
LWGSIKALARGYEIIMGLLLFTPIAFLAWFPFVSEFQTRMLFNQAFSRGLQISRILGGHKKDRATRNKE

SEQ ID NO: 46147 - DNA, 691 bp, Panicum virgatum
  misc_feature: Ceres CLONE 2029048
  misc_feature: Encodes the peptide sequence at SEQ ID NO. 46148
agacaaatcctatcctcctccacctagtcaccacagtcgtctctccctgcgccgcgtgagctgccaacgatggcccttgagacgtgcttcagagcgtgggcgctgcacgccgcccctgccggcggcaaggacaggctcgccgtcggcggcggcggcagcagcagcagcagcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacgccggtgctggtggagttctgggcgccgtggtgcgggccctgccggatgatcgcgccggtgatcgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactgttgttgttggagatgaactaaatacatacgtgtccgtgctcgcgcatacacaccatgtatctctttgtgc

SEQ ID NO: 46148 - protein, 179 aa, Panicum virgatum; identical to SEQ ID NO: 13067
  misc_feature: Ceres CLONE 2029048
  misc_feature (72)..(175): Pfam Name: Thioredoxin Pfam Description: Thioredoxin
  misc_feature: SWISSPROT Homolog: EC 1.8.1.8 Protein-disulfide reductase

SEQ ID NO: 46149 - DNA, 380 bp, Panicum virgatum
  misc_feature: Ceres CLONE 2029051
  misc_feature: Encodes the peptide sequence at SEQ ID NO. 46150
ctttcctcttcttcctctcacatcgacgtccggtcacggtccttctctctctctgagtcgatacaatgggtaagggtacggcatctttcggtaagaggcacaccaagtcgcacactctgtgccgtcgctgtggcaggcgctcctaccacatccagaaggcccgttgcgcctcgtgcggctaccccgccgccaggctcaggaagtacaactggtccaacaaggccctcaggaggaggacgactggttctggccgcatgcgctaccttaaggacatgcccaggaggttcaagaacggtttccgtgagggtacccaggccaagaaggtcaaggccgcccccgctgctcagtaaatctgccccatgaacaataaacctccttcc

SEQ ID NO: 46150 - protein, 94 aa, Panicum virgatum
  misc_feature: Ceres CLONE 2029051
  misc_feature (2)..(55): Pfam Name: Ribosomal_L37e Pfam Description: Ribosomal protein L37e
MGKGTASFGKRHTKSHTLCRRCGRRSYHIQKARCASCGYPAARLRKYNWSNKALRRRTTGSGRMRYLKDMPRRFKNGFREGTQAKKVKAAPAAQ

SEQ ID NO: 46151 - DNA, 663 bp, Panicum virgatum
  misc_feature: Ceres CLONE 2029057
  misc_feature: Encodes the peptide sequence at SEQ ID NO. 46152
acagagcacccaggccacgcagaccacaagcagaagaaaagaggaagaaatattcctcccgtcgaaagccaagccggcctcgacaacgccggcaagaccaccctcctccacatgctcaaggacgagcggctcgtacagcaccagccgacgcagtaccccacgtcggaggagctgagcatcggcaagatcaagttcaaggccttcgacctcggcggccaccagatcgctcgccgcgtctggaaggactactacgccaaggtggatgctgtcgtgtacttggtggatgctgttgacaaggaacggtttgccgagtcaaagaaagagcttgatgctcttcttgcagatgactcgcttgcgaacgttcctttcctcatactgggcaataagattgacatcccgtacgcggcttcagaggaggagctgcgctactaccttgggctgagcaacttcacaaccggaaagggcaatgtgaacttgtctgactccaatgttcgccccctggagatcttcatgtgcagtgtggtgcgcaagatgggctacggcgaaggcttcaaatggatgtctcagtacatcaagtgaagcgccgcacacctctgtccatagcactggcgtaggtgctctcgcaggtggccagagtcaggtctggtcgtcacactatggaga

SEQ ID NO: 46152 - protein, 192 aa, Panicum virgatum
  misc_feature: Ceres CLONE 2029057
  misc_feature (10)..(191): Pfam Name: Arf Pfam Description: ADP-ribosylation factor family
  misc_feature: The sequence is a functional homolog of SEQ ID NO 11 in US patent 7259294
TEHPGHADHKQKKRGRNIPPVESQAGLDNAGKTTLLHMLKDERLVQHQPTQYPTSEELSIGKIKFKAFDLGGHQIARRVWKDYYAKVDAVVYLVDAVDKERFAESKKELDALLADDSLANVPFLILGNKIDIPYAASEEELRYYLGLSNFTTGKGNVNLSDSNVRPLEIFMCSVVRKMGYGEGFKWMSQYIK

SEQ ID NO: 46153 - DNA, 719 bp, Panicum virgatum
  misc_feature: Ceres CLONE 2029059
  misc_feature: Encodes the peptide sequence at SEQ ID NO. 46154
ccctctgtttctcttctcaaacccttcccttctctcgaagagaaactctctcctgatctcctcccttgctcgagatcttccttccctggcgacgacgactgggcgggcggtggcccagccctttaccggcgacgagcgcatcctccaggtatgccggggccgccccttctctttccttgtgctatgcgagacggaacaccccaaaccctaacaaaactgtctgtattcggatctgaatccaactacagtatattgatttacctactaacttggatttcgtttgcaagaacaagaattatcgggtgggtgtacatgtgtacacccatgtcctatgttgggtccgcccctgactctaatgctctggtattgctcttgctctttctgaaattctgatctcaaaggtcatggcagagaccatagatttatcaggggacggaggtgttcttaagacggtggtccggaaagcaaaggatgatgctatagcgccatctgatagtctgcccctggttgatgttcattacgaaggcacacttgctgagaatggtgaagtttttgacaccacccatgaagacaactctattttctcatttgaaattggacagggggctgtcatcaaagcatgggatatagccttaagaactatgaaggttggcgaggttgcaaaacttacgtgcaagccagaatatgcatatggaactgcgggctcaccaccggagata

SEQ ID NO: 46154 - protein, 104 aa, Panicum virgatum
  misc_feature: Ceres CLONE 2029059
  misc_feature (15)..(104): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
  misc_feature: Functional homolog of the protein sequence given in SEQ ID NO 50112
  misc_feature: Useful for making plants with modulated biomass
MAETIDLSGDGGVLKTVVRKAKDDAIAPSDSLPLVDVHYEGTLAENGEVFDTTHEDNSIFSFEIGQGAVIKAWDIALRTMKVGEVAKLTCKPEYAYGTAGSPPE

SEQ ID NO: 46155 - DNA, 714 bp, Panicum virgatum
  misc_feature: Ceres CLONE 2029070
  misc_feature: Encodes the peptide sequence at SEQ ID NO. 46156
acgcatacctccctgctttttttagtctcctctgcaactcttccgctctgcagctgctcgtagcatagcatcctcctcctcctagtcaggtgcaagaacacgagcaggagaacatctgctctcttgtttcttccatggcggtggccacagagaccccgttccatgtcctggccgtggatgacagcctcctggacaggaagctcatcgagaggctcctcaagacctcttccttccaagtcaccactgtcgattccgggagcaaggcgctggagttcctggggatccacggcgaggacagcagcccaccagtttcggatgcagaccagctggaggttgcggtgaatctgatcatcacagactactgcatgcctggaatgacgggatatgatctgctcaagaagatcaaggaatcaacatctctgagagatatcccagtggtgatcatgtcgtccgagaacattccttcaaggatcaatagatgcctggaggaaggagcagatgaatttttcctaaagccagtgcggctatcagacatgagcaagctgaagccccacatactgaaaagcagatgcaaggagcactaccaccaggaacagcaccagcaaagcgacagcgacagcgacagcaacagcaacgaatgcagtaaccccacgaacaacagcagcagcgataacagcaacagccgcaagagaaaggcagaagacgacgaagttt

SEQ ID NO: 46156 - protein, 193 aa, Panicum virgatum
  misc_feature: Ceres CLONE 2029070
  misc_feature (9)..(138): Pfam Name: Response_reg Pfam Description: Response regulator receiver domain
  misc_feature: SWISSPROT Homolog: EC 3.1.4.17 3',5'-cyclic-nucleotide phosphodiesterase
  misc_feature: Functional homolog of the protein sequence given in SEQ ID NO 51179
  misc_feature: Useful for making plants with modulated low light sensitivity
  misc_feature: Useful for making plants with modulated nitrogen use efficiency
  misc_feature: The sequence is a functional homolog of SEQ ID NO 932 in the 10/666,642 US patent application
MAVATETPFHVLAVDDSLLDRKLIERLLKTSSFQVTTVDSGSKALEFLGIHGEDSSPPVSDADQLEVAVNLIITDYCMPGMTGYDLLKKIKESTSLRDIPVVIMSSENIPSRINRCLEEGADEFFLKPVRLSDMSKLKPHILKSRCKEHYHQEQHQQSDSDSDSNSNECSNPTNNSSSDNSNSRKRKAEDDEV

SEQ ID NO: 46157 - DNA, 674 bp, Panicum virgatum
  misc_feature: Ceres CLONE 2029078
  misc_feature: Encodes the peptide sequence at SEQ ID NO. 46158
tgctagtgtttcaatacaagacagcaacatgaaagaaccaattacacaaacaagtggtggagcagaatcaaatgtgtcgtcacaggcaaaaccttcatcgaagaaacctgcagtacggaaaaaggttcctttcgagaagggctatagccaaatggattggttaaagctgacacgaacacatcctgatctagctgggctcaaggggcagtcaaatcgaaggttaatttctttggaagaagttaagcagcataaaactggagattgcatttggacagttctcaaaggccgtgtttataatattgctccatacatgaaatttcatcctggaggagttgatatgcttatgaaagctgctggaaaggactgcactgctttgttcaataaataccatgcttgggtaaatgcagagttccttttggagaagtgccttgtcggattccttgaccccaacgagtagatctcaaggttcacgccattgtggcattttaccacttctgcactactggactatttgtattaggcacactagtcgatgaattaaagaatgtaaatgttctattgtatcacaatgagagtacaataattcatttcgttcaaaaaagaaagagaaagaaataagcttagtgtctgttcgtccttgtaaatgtgagaaaatccagggatatactggtatg

SEQ ID NO: 46158 - protein, 151 aa, Panicum virgatum
  misc_feature: Ceres CLONE 2029078
  misc_feature (74)..(148): Pfam Name: Cyt-b5 Pfam Description: Cytochrome b5-like Heme/Steroid binding domain
  misc_feature: SWISSPROT Homolog: EC 1.6.2.2 Cytochrome-b5 reductase
ASVSIQDSNMKEPITQTSGGAESNVSSQAKPSSKKPAVRKKVPFEKGYSQMDWLKLTRTHPDLAGLKGQSNRRLISLEEVKQHKTGDCIWTVLKGRVYNIAPYMKFHPGGVDMLMKAAGKDCTALFNKYHAWVNAEFLLEKCLVGFLDPNE

SEQ ID NO: 46159 - DNA, 640 bp, Panicum virgatum
  misc_feature: Ceres CLONE 2029084
  misc_feature: Encodes the peptide sequence at SEQ ID NO. 46160
ctctccgcctcccccattcctcttcccctgcgatccgaggccgcacccgcagccgcagggaggagaagccatcacctgatcagcgcaggagcggagatggggctcacgttcacgaagctgttcagccgcctcttcgccaagaaggagatgaggatcctcatggttggtctcgacgcggctggtaagaccaccatcctctacaagctcaagctcggcgagatcgtcaccaccatccccaccataggatttaatgttgaaactgttgagtacaagaacattagcttcactgtttgggatgttggtggtcaggacaagatccgtcccctgtggaggcactacttccagaacacccagggcctcatttttgttgtggacagcaacgacagagagcgtgttgttgaggccagagatgagctccatcgtatgctgaatgaggacgagctccgtgatgctgtgcttctggtgtttgcaaacaaacaagatcttcctaatgccatgaacgctgctgaaatcaccgacaagcttggcctgcactccctgcgccagcggcactggtacatccagagcacatgtgctacctctggtgagggtttgtatgaggggcttgattggctttccacaacattgccaacaaggcttg

SEQ ID NO: 46160 - protein, 181 aa, Panicum virgatum
  misc_feature: Ceres CLONE 2029084
  misc_feature (5)..(177): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSTTLPTRL

SEQ ID NO: 46161 - DNA, 609 bp, Panicum virgatum
  misc_feature: Ceres CLONE 2029088
  misc_feature: Encodes the peptide sequence at SEQ ID NO. 46162
attcctccccgaggctccaaaacctagctctcctcttcctcgggcggcggcggcggcggcggccatggacaagagcatgctcggcgacctggatggcctccccgaggaggacaagatgcgcatggccgccatgatcgagcagctccagatccgtgacagtctgagaatgtacaataacctggtggagagatgcttcacggactgcgtggacacgttccgccgcaagaccctggacaagcaagaggagtcatgcgtccgccgctgcgctgaaaagttcctgaagcactccatgagggttggcatgagatttgctgagcttaaccagggtgtggccacacctgactaaacatgctggttttgttgcccttgccaagttcctaactgtggcgattttgtcagcatctatttgtaatcctaaaaagcttttagcactccttgagaaatgcaactcggtaaggttgcctattgaaccaactgccaggtatgacaatgaataaaattacctagaatcattgtatccaatggtacattcttcatatcgtggttaccgctgtatccattgatacctgatagctgctgagaagagtttggattctcgtttggtacttg

SEQ ID NO: 46162 - protein, 93 aa, Panicum virgatum; identical to SEQ ID NO: 14043
  misc_feature: Ceres CLONE 2029088
  misc_feature (20)..(85): Pfam Name: zf-Tim10_DDP Pfam Description: Tim10/DDP family zinc finger

SEQ ID NO: 46163 - DNA, 584 bp, Panicum virgatum
  misc_feature: Ceres CLONE 2029090
  misc_feature: Encodes the peptide sequence at SEQ ID NO. 46164
gcaattccccacttgtgcggcgcccccttcgtcaagagctcgccagtgactgcgaggctggcggccgggctgctccgacctaggagatggggttaacaggaaggcagaatcgatcccgggaggataaggccgcgcccatggcgccccgcgtccgtagtcatcccccaccaccaccgccggatccggaagtgacgaacggacaagacgcgctacgcttcttggcgaccatgaagcgcgagctcgccgacgaaatacaaaagtacgacgagttcgtcaacgtcctggccgagttcaggaacgggagagtggatacagtcatggtggttgagcatgtcaaagtcctgctcgccgggcacccagatctcctgcgaggctttgacgaattcgtgccatggggttacaaaatatctcagggtggacaaggagggcaaagtggcatctgatggtatcattggtacttgggctggcctttggttatattgattgaataaaagttttattcgctctctgctctgctatgtatggctaaacattgctagcgcttgatttctttcgtatggaacatcagtgcccagttctacacc

SEQ ID NO: 46164 - protein, 118 aa, Panicum virgatum
  misc_feature: Ceres CLONE 2029090
  misc_feature (56)..(102): Pfam Name: PAH Pfam Description: Paired amphipathic helix repeat
MGLTGRQNRSREDKAAPMAPRVRSHPPPPPPDPEVTNGQDALRFLATMKRELADEIQKYDEFVNVLAEFRNGRVDTVMVVEHVKVLLAGHPDLLRGFDEFVPWGYKISQGGQGGQSGI

SEQ ID NO: 46165 - DNA, 547 bp, Panicum virgatum
  misc_feature: Ceres CLONE 2029101
  misc_feature: Encodes the peptide sequence at SEQ ID NO. 46166
gcgacgaaggcaagatacgcccacccacctgctccggcgatgcagcagcagatgcccatgcagccggcgcccgccggcgccgcggcggcggcgcccccggcggccggcatcaccaccgagcagatccaaaagtatttggatgaaaataagcagcttattttggccatcctggaaaatcagaacttaggaaagttggctgaatgtgctcagtatcaagctcagcttcaaaagaatctcttgtacctggctgcaattgcagatgcccaaccccaaccaccacagaaccctgcagtgatgtggtggagaaatcctaagtcaagcaaagaaaccaaaggactcttgagtgactagtagtccttgctgtgttttagacatgtatcgatccatgtagaacaaaaagtttagattggttatgaatgatgtaatctgcccaagattgttaccgcgttcttacatttctgtagccattatggaataatttttaccagcctgttgtctagcgtattttactatgtttttccagctaattagatggttaagagtggcc

SEQ ID NO: 46166 - protein, 103 aa, Panicum virgatum
  misc_feature: Ceres CLONE 2029101
  misc_feature (21)..(85): Pfam Name: SSXT Pfam Description: SSXT protein (N-terminal region)
MQQQMPMQPAPAGAAAAAPPAAGITTEQIQKYLDENKQLILAILENQNLGKLAECAQYQAQLQKNLLYLAAIADAQPQPPQNPAVMWWRNPKSSKETKGLLSD

SEQ ID NO: 46167 - DNA, 666 bp, Panicum virgatum
  misc_feature: Ceres CLONE 2029109
  misc_feature: Encodes the peptide sequence at SEQ ID NO. 46168
aaccagtcgacgacgacttcctcctccttcctccctcgcccacctcgcgcccccggagaaaacaaaccaaaagaagaaagcctcgccgcgagatctgggaggaagagggagagagaggcccccggccaagatgcacgatttctgcttcacgatcccctacgggttcgccgtgctggccggcggcgtgctgggctacctccgccgcggcagcaccgcgtccctggcggggggcgccggcgccggcgcgctcctcctgctcgcggggttcgtcagcctcaaggccttcgagaagcggcgcaactcctacctcgccctcgcgctcgagaccctttgtgcattcgccttgacctacgttatgggacagagatacctagaaacttcgaagataatgccagctggtgttgttgctggtctcagcgccgtgatgtctgcattctatctattcaagattgcaactggcggcaaccacatcccaccaaagaaagagtaaaccaaggtttaacttgtaatatatgtttgattgaactcaaagatcatgaccgattgtgttgtctagttgcacggtaacttgagggactagtgatggtctccgtttgtaattctgttagaatgtaccttggatctctgaactttgtacaagaaataaagattaaagatgtgattcac

SEQ ID NO: 46168 - protein, 119 aa, Panicum virgatum; identical to SEQ ID NO: 26551
  misc_feature: Ceres CLONE 2029109
  misc_feature (4)..(107): Pfam Name: TMEM14 Pfam Description: Transmembrane proteins 14C

SEQ ID NO: 46169 - DNA, 681 bp, Panicum virgatum
  misc_feature: Ceres CLONE 2029120
  misc_feature: Encodes the peptide sequence at SEQ ID NO. 46170
gcagtcgctccgcctcctcgcttccttcaccccctgccgcaacccgcgcgcctcctccttcccttttcagcagccgccgccgccgccgccgccggggatggagaccacctacaagttcgggccctacaagatcgatgccagggaggtcttccacgccactcccctctcctacgccatggtcaacctccgccccctcctccctggtcatgttcttgtgtgccccaagcgtgaagtgaaaagatttgctgatctaagttctgatgagacgtgtgacttatgggttactgcaaaggaagtcggtgtacgtcttgagcagtatcataaagcatcttcacttacctttgctattcaggatggtcctcaagctggccaaacagttccacatgtccacattcatgtcatcccgaggaagaaaggggattttgagaaaaatgatgaaatatatgatgcgattgatgtgaaagagaaagaattgaaggagaagcttgacctggacattgagagaaaagatagaagcatggaagaaatggctcatgaggccaatgagtaccgtgctcttttctcctagaattaactcttctatagtagttagtttctaggttgatctgactgttttcataaataagccttgctgctgccttttctccattgttgcaatccagatatcatttaactgatatg

SEQ ID NO: 46170 - protein, 156 aa, Panicum virgatum
  misc_feature: Ceres CLONE 2029120
  misc_feature (14)..(107): Pfam Name: HIT Pfam Description: HIT domain
  misc_feature: SWISSPROT Homolog: EC 3.6.1.29 Bis(5'-adenosyl)-triphosphatase
  misc_feature: Functional homolog of the protein sequence given in SEQ ID NO 51219
  misc_feature: Useful for making plants with modulated heat sensitivity
METTYKFGPYKIDAREVFHATPLSYAMVNLRPLLPGHVLVCPKREVKRFADLSSDETCDLWVTAKEVGVRLEQYHKASSLTFAIQDGPQAGQTVPHVHIHVIPRKKGDFEKNDEIYDAIDVKEKELKEKLDLDIERKDRSMEEMAHEANEYRALFS

SEQ ID NO: 46171 - DNA, 476 bp, Panicum virgatum
  misc_feature: Ceres CLONE 2029145
  misc_feature: Encodes the peptide sequence at SEQ ID NO. 46172
acatcgtaccagttggacctttggagtaccttaaacatgcgaattattgcggcttacctgcttgcagttcttggcgggaactcctccccctctggttctgacatcaagaagatcctcgagtctgtcggcgttgaggctgaggatgaaaagattgagctcctcgtcaccgagctgagcggcaaggacgtcttcgaggtcatcgaggagggcaagaagaagctcggcgctgtccccgtcggtgctgccgcccccgctgccggtggcgctgcccccgctggtgccgccgcccccgctgccggtgccgctgcccccgccgccaaggctgaggagaaggatgaggacgatgacgtcttcggcgaaggtggtggtgatggtggtatgggtctcttcggcggtgatgaggatgactactaagttctcaattgcccacgccctatcggttaattcagcccttcgaataaatcgaacatcactcg

SEQ ID NO: 46172 - protein, 125 aa, Panicum virgatum
  misc_feature: Ceres CLONE 2029145
  misc_feature (17)..(118): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MRIIAAYLLAVLGGNSSPSGSDIKKILESVGVEAEDEKIELLVTELSGKDVFEVIEEGKKKLGAVPVGAAAPAAGGAAPAGAAAPAAGAAAPAAKAEEKDEDDDVFGEGGGDGGMGLFGGDEDDY

SEQ ID NO: 46173 - DNA, 663 bp, Panicum virgatum
  misc_feature: Ceres CLONE 2029166
  misc_feature: Encodes the peptide sequence at SEQ ID NO. 46174
aaccatcaacgagccagagtctgccgccaaccccatccagatttcatcaatcaagctactgctcgtcctttcgacattcggaagtaatcagtcaagatggttctcgccgttgatctcctcaaccccagcccggctgctgaggcccgcaagcacaagctcaagacccttgtgcccggcccccgctccttcttcatggacgtcaagtgccctgggtgcttcaccatcaccaccgtcttctcccacgcccaaaccgtcgtcatctgccaaggctgcacgaccgtcctctgccagccgaccggtggcaaggctaggctcacggagggctgctcgttccggaggaagtaagcggttcgctcgcgactgttttctttccttgggcatcatggcatggtaatggggtcatctcggtatctgcaaggctggttcgagttgggcgtctagacacattactctcgatcgtcaaatcaatctcatttgcggatagaagatggattcgccaaaaatcaccccgcacaacaatctgggagggcgtttggggtccggatatctagcatcatcgacttctccgacttttctctcgatctgcgttttccgatcgttcgtcttgtcttttgctgtacaggcaggtgatactgcatgggaggatcgctggcagaggcattc

SEQ ID NO: 46174 - protein, 82 aa, Panicum virgatum
  misc_feature: Ceres CLONE 2029166
  misc_feature (28)..(82): Pfam Name: Ribosomal_S27e Pfam Description: Ribosomal protein S27
MVLAVDLLNPSPAAEARKHKLKTLVPGPRSFFMDVKCPGCFTITTVFSHAQTVVICQGCTTVLCQPTGGKARLTEGCSFRRK

SEQ ID NO: 46175 - DNA, 459 bp, Panicum virgatum
  misc_feature: Ceres CLONE 2029181
  misc_feature: Encodes the peptide sequence at SEQ ID NO. 46176
accacaaagcggccagcgttcaaaattaaacaagcgagagaatgtcacgagcaggcgtatggcaactgagaaagctcaagctgcagtactgtgatctcggagggagcagccgtggcatgcgcgaattcttggagacgcgcctgcccgagttccagaagaagaacccgcaaatagtggtggatgtggtgaagcgccgcaatcgccatccccatctctccggcgaatacttggcagcgggccgggagaaagccgttggtgtgggtggaatggaggcggacgaggtggagcactacatctaccatctccgcaaccagtggggcctcaagtcgcggcgcctgggcgcgggccagatcatctcgcagaaacgcagcgtgcagggcgtgtggaatccctttgtcaaatatgactaacccggtcagccaaacaaacacgcacccgcgccctgcgtgtccactcctc

SEQ ID NO: 46176 - protein, 122 aa, Panicum virgatum
  misc_feature: Ceres CLONE 2029181
  misc_feature (18)..(92): Pfam Name: L51_S25_CI-B8 Pfam Description: Mitochondrial ribosomal protein L51 / S25 / CI-B8 domain
MSRAGVWQLRKLKLQYCDLGGSSRGMREFLETRLPEFQKKNPQIVVDVVKRRNRHPHLSGEYLAAGREKAVGVGGMEADEVEHYIYHLRNQWGLKSRRLGAGQIISQKRSVQGVWNPFVKYD

SEQ ID NO: 46177 - DNA, 671 bp, Panicum virgatum
  misc_feature: Ceres CLONE 2029197
  misc_feature: Encodes the peptide sequence at SEQ ID NO. 46178
gttcaagcgcaatttcctggcgttcggcgccgggccgcaccagtgcttggggcagcgctacgcgctcaaccacctggtgctcttcctggcgctcttcgtgtcggtggtggacttccggcgggagaggacgccggggtgcgacgacccggtgtacatgccgaccatcgtgcccaaggacggctgcgccgttcacctcgcgcagcgctgcgccaagttcccgactttctgaggacgaggccaatgtgccattcattccaattccctcccctcccctctctgggttcggctccaccattgaactttttcttttcgatttcttggcgggggccggcaggtcgtgcctcctctgtcgccgtggtgcttggtggtggtgatgatttgtaggttgtggtgttggcttgctcgtgtccgctctgctctaatggcggggacactccattcaattattttgttggcaattggttggctttggttgggttcgggactcgatctgcagctgctcatcggggccccagcctgtccagaggaggaggaggaaggagatggtagcagtatcagtgtgaatgaatacttgtagtacaagtggtgggttggtgactgcatctgtactgtttggctggtgagctgctccgtctcgctcaatcatggaaactgctctgctcgtttcgtgg

SEQ ID NO: 46178 - protein, 75 aa, Panicum virgatum
  misc_feature: Ceres CLONE 2029197
  misc_feature: Functional homolog of the protein sequence given in SEQ ID NO 51388
  misc_feature: Useful for making plants with altered sterol content
FKRNFLAFGAGPHQCLGQRYALNHLVLFLALFVSVVDFRRERTPGCDDPVYMPTIVPKDGCAVHLAQRCAKFPTF

SEQ ID NO: 46179 - DNA, 630 bp, Panicum virgatum
  misc_feature: Ceres CLONE 2029206
  misc_feature: Encodes the peptide sequence at SEQ ID NO. 46180
cttcgcgcaccgctccaccctacccccccgccgccgcccccgcctcgccgccgcaaccgccaccgtcgccatggcccggatcaaggtgcacgagctccgggtgaagaacaaggcggagctgcaggcgcagctcaaggagttcaagtccgagctctccctcctccgcgtggccaaggtcaccggcggagcccccaacaagctctccaagatcaaggtggtgcgcacctcgatcgcgcgcgtgctgacggtgatctcgcagaagcagaaggcggcgctgcgggaggcgtacaagacgaagaagcggctccccctcgacctccgccccaagaagacccgtgccatccgccgccgcctcaccaagcaccagctttctctgaagacagagagggaaaagaagcgtgagaagtacttccccatgaggaagtatgctatcaaggcctaggtcagaactgtgagatgttcctagcatatcatgggctgtttctttgcctaggaagtgttttaagttttggtttgtatggacctttgctatgtgttgaaagtacggtacatttcctctcttgcctcaaatacctagatgggtttaaggcgcaattcgtattggcaatgaaacctggcatgcttggtgtg

SEQ ID NO: 46180 - protein, 123 aa, Panicum virgatum
  misc_feature: Ceres CLONE 2029206
  misc_feature (6)..(64): Pfam Name: Ribosomal_L29 Pfam Description: Ribosomal L29 protein
MARIKVHELRVKNKAELQAQLKEFKSELSLLRVAKVTGGAPNKLSKIKVVRTSIARVLTVISQKQKAALREAYKTKKRLPLDLRPKKTRAIRRRLTKHQLSLKTEREKKREKYFPMRKYAIKA

SEQ ID NO: 46181 - DNA, 494 bp, Panicum virgatum
  misc_feature: Ceres CLONE 2029209
  misc_feature: Encodes the peptide sequence at SEQ ID NO. 46182
attaaagatgctggcctctatgataaaatatggcaagcttttgctgtcttcttgccagtacaaacagttggggttcagggtgaccagcgaacccactccaatgctgttgtcttacgggcaatcaccagtgaggatggcatgactgcagattggtactattttggccatgaattcctagtagatgttgtcaacaagatctgcaacaacgtccgtggcatcaaccgtgtctgccaggacatcacatcaaagccacccgcgacagttgagtgggaataggaactggtgctctgatgcagtgatggtgggatctggcgagaaacttgaggaacaatttaccttttggtgatgggatcaaatacaatatgacctcagttattagtgtactgatacgctttagtcaaaatatccttttgtcgaaccttagatgataaacacagcaaagctggtgaactgcatactctgcaaaattcatgagtagacattgcttctgggtc

SEQ ID NO: 46182 - protein, 91 aa, Panicum virgatum
  misc_feature: Ceres CLONE 2029209
  misc_feature (1)..(90): Pfam Name: GMP_synt_C Pfam Description: GMP synthase C terminal domain
  misc_feature: SWISSPROT Homolog: EC 6.3.5.2 GMP synthase (glutamine-hydrolyzing)
IKDAGLYDKIWQAFAVFLPVQTVGVQGDQRTHSNAVVLRAITSEDGMTADWYYFGHEFLVDVVNKICNNVRGINRVCQDITSKPPATVEWE

SEQ ID NO: 46183 - DNA, 504 bp, Panicum virgatum
  misc_feature: Ceres CLONE 2029210
  misc_feature: Encodes the peptide sequence at SEQ ID NO. 46184
aacaaacgctaaaaaagtaacagtttctgtactttattgagcaccgtcaacaatggtggctgttcgcaggaaggtcggcgcgcgcggccagctccgcatgccggcgctgccgaagggcaagaaggtcttcaagatcgactgctcgacgcccgctcaggacgagatcatggacgctgacatgctcaacgccttcacgcagtacctcaccgagaacgtcaagctgcacggccgcaagggcaagctcggcgacaaggtcaaggtgacgtcggagaacaatgtcatcaccgtcgcgacgacgatggcgtaccgcaagaagtacttcaagtacctcacgaagaagttcctgaagaagaagaacctccgcgactggctccgcatcctcgccacgaagaagggcgagtacacgctccgctactacaacatccaggacaacgaggaggaggagcaggagtaagtagccccgcccccagtgctcaacacgcatgaaacgcctctccgttttcg

SEQ ID NO: 46184 - protein, 133 aa, Panicum virgatum; identical to SEQ ID NO: 35665
  misc_feature: Ceres CLONE 2029210
  misc_feature (22)..(132): Pfam Name: Ribosomal_L22e Pfam Description: Ribosomal L22e protein family

SEQ ID NO: 46185 - DNA, 604 bp, Panicum virgatum
  misc_feature: Ceres CLONE 2029217
  misc_feature: Encodes the peptide sequence at SEQ ID NO. 46186
tgcgctagcgttcagccataaaaccctaaaccctccgagcggttgggggtggtggtggtgaggccaaggagagcgtggaagcttcgagcgtttttgcttgctgcgcaagaagaagagaaggcggctatggcgaagaggctgctcccgtcgctgaaccgggtgctggtggagaagctggtgcagcccaagaagaccgccggcggcatcctcctcccggaaacatccaagcagctgaatgctgccaaagtggtggctgttggccctggtgagcgtgacagggagggcaagctgatccctgttgctctgaaggaaggtgacactgttctcctgcctgagtatggcggaactgaagtcaaacttgctgctgataaagagtacctactcttcagagagcatgacatcttgggtacactcgtggactgatttgagacaatcaggaagctcatcactagtcagtccagtgtgagagatgttttaggttttgatgctacgaaacaatccttgaaaatttacatgatgatgtcatagaattttgtggtgaacatcgtgaactggataacaatgctgctcgtttctgttgagatgcaattgagtaatattcacc

SEQ ID NO: 46186 - protein, 98 aa, Panicum virgatum
  misc_feature: Ceres CLONE 2029217
  misc_feature (4)..(96): Pfam Name: Cpn10 Pfam Description: Chaperonin 10 Kd subunit
MAKRLLPSLNRVLVEKLVQPKKTAGGILLPETSKQLNAAKVVAVGPGERDREGKLIPVALKEGDTVLLPEYGGTEVKLAADKEYLLFREHDILGTLVD

SEQ ID NO: 46187 - DNA, 846 bp, Panicum virgatum
  misc_feature: Ceres CLONE 2029228
  misc_feature: Encodes the peptide sequence at SEQ ID NO. 46188
aaccgctcgaccaacgaccagcgagacacagtcaagatgggtatctctcgtgactctcggcacaagcgcgccgctaccggtgccaagcgagcttactaccggaagaagagagccttcgaggcgggccgtcagcctgcgaacacccgtatcggtgccaagcgcatccacaccgtccgcacccgcggcggtaaccacaagtaccgtgcgctccgtctcgactcgggcaacttcgcctgggcctcggagggatgcacccgcaagactcgtgtcattgtggtggcctaccacccgtctaacaacgagcttgtccgcacgaacaccctgaccaagtccgccgtcgtccagattgacgctgcgcccttccgtcagtggtacgaggcccactacggccagcccctcggccgccgtcgccagcagaagcagggtcaggctctcgaggaggtcaagaagagcaagtccgtcgaggctaagcaggctgcccgtttcgccgcctccggcaaggttgactccgccatcgagaagcagttcgaggccggtcgtctctacgccgtcatctccagccgtcccggccagtccggccgctgcgacggctacatcctggagggtgaagagctcgccttctaccagcgcaagctccacaagtaagcgttgggcgagggaggaaagggtatgatgaagaacgggaggaacaagtctggacgcgggggcttgcatcggcgtttcgccaggtgttgatgggtcatttctgggacgaaaaaggcgatcacagcaacgtcatttccagttgtttcgtcaccggtaacagggcatggcagggatttagggcaatggaaaatgaataccccc

SEQ ID NO: 46188 - protein, 202 aa, Panicum virgatum
  misc_feature: Ceres CLONE 2029228
  misc_feature (1)..(188): Pfam Name: Ribosomal_S8e Pfam Description: Ribosomal protein S8e
MGISRDSRHKRAATGAKRAYYRKKRAFEAGRQPANTRIGAKRIHTVRTRGGNHKYRALRLDSGNFAWASEGCTRKTRVIVVAYHPSNNELVRTNTLTKSAVVQIDAAPFRQWYEAHYGQPLGRRRQQKQGQALEEVKKSKSVEAKQAARFAASGKVDSAIEKQFEAGRLYAVISSRPGQSGRCDGYILEGEELAFYQRKLHK

SEQ ID NO: 46189 - DNA, 553 bp, Panicum virgatum
  misc_feature: Ceres CLONE 2029239
  misc_feature: Encodes the peptide sequence at SEQ ID NO. 46190
gactccccgccgccgcacccctcctcttcgtcgctctcctcgcctgcctcgcgccgccgccgccgccatggccccgaagaaggacaaggccccgccgccgtcgtccaagccggccaagtccggaggagggaagcagaagaagaagaagtggagcaaggggaagcagaaggagaaggtcaacaacgcggtgctcttcgaccaggccacctacgacaagctgctctccgaggtgcccaagtacaagcagatcaccccgtccgtcctctccgagcgcctcaggatcaatggatccttggcgcggagggccatcaaggacctgatggcaagggggcttataaggatggtctctgttcattccagccagcagatatacaccagggcaaccaacacatgagcgtcttttcaggcattatctagtctagaggacttatgtttctgttatatcaagtttatttcaatcatggctcagtcgatgttaccattgatgtggagaatgttgaatccttttgagattatggtactattttaagttcatgctgctatcctaattttt

SEQ ID NO: 46190 - protein, 108 aa, Panicum virgatum; identical to SEQ ID NO: 12376
  misc_feature: Ceres CLONE 2029239
  misc_feature (1)..(106): Pfam Name: Ribosomal_S25 Pfam Description: S25 ribosomal protein

SEQ ID NO: 46191 - DNA, 590 bp, Panicum virgatum
  misc_feature: Ceres CLONE 2029241
  misc_feature: Encodes the peptide sequence at SEQ ID NO. 46192
agcacactacgctactctacgctcgccggctagtcgatcttactgtgcgttccgcagtagcccagcccacccactcacacacacccacaatggcggggcgtcgcatcgccgtggcggcggcgttcctggcgctggcggcggtggttcctgcggcgctggcgcaggcgccgggccccgcagcggcgccgagcgggccccccaacgtgacggcgatcctggagaagggcgggcagtacacgaccttcatccggctgatgaaggagacgcagcaggacacgcagctcaacagccagctcaacagctccttcggcaacaacggcggcggcggctacacggtgttcgcgcccaccgacaacgccttcaacaacctcgccgccgttcttggctacctgttgtgagtctgagacaagaatgccaatgtccaccaaatccatctttgcctgagatagattgtcagtggtggtgtttccttccttccccttcttcctctctttgtttaaatttctctggtactgctagttgcttttttttattcttgttcttggcggtctgtaagattgggttaaattcatgtgcttgaggctgttcat

SEQ ID NO: 46192 - protein, 102 aa, Panicum virgatum
  misc_feature: Ceres CLONE 2029241
  misc_feature: Functional homolog of the protein sequence given in SEQ ID NO 51072
  misc_feature: Useful for making plants with altered carbohydrate content
  misc_feature: Functional homolog of the protein sequence given in SEQ ID NO 50209
  misc_feature: Useful for making plants with altered cell wall content and/or composition
MAGRRIAVAAAFLALAAVVPAALAQAPGPAAAPSGPPNVTAILEKGGQYTTFIRLMKETQQDTQLNSQLNSSFGNNGGGGYTVFAPTDNAFNNLAAVLGYLL

SEQ ID NO: 46193 - DNA, 590 bp, Panicum virgatum
  misc_feature: Ceres CLONE 2029247
  misc_feature: Encodes the peptide sequence at SEQ ID NO. 46194
gggtggagggcggcgcacaaccgcgtcccggtctcggtgtttcctccaggcttccagagttccaacttccaacacgcctcgatccagatctgggcattcccttccggtctccccccgagactattcatattccattcgcccgcagcggaagaggcgcctgccgccgccgcctcgtcctcgactccctcctcgtccgccgcttggagtgcgctcctccgttccaagaagcgcagcatggcaaagctcaagccaaaggcgttgctggcgcaaagcaaagtgaagaaggcccctagccaaatcagtgtgatcacaatcttcacctacttggtcctcggtgtcatagttgtatcctctgtttatgctgcttacaaatatttggtaggcaaaggaccagcagtgacagcagcaggcgtcgaggggaattaaacctcaaactatgtaactgattttgttgttgtatcatccagttggataattttggttgctgcagccagtaaaaggagcatggatagattgtatcttgctacagttttattgtaaaccgtgggtacattatattgatatgtgtatgctaaattcctttcctcgat

SEQ ID NO: 46194 - protein, 63 aa, Panicum virgatum; identical to SEQ ID NO: 9836
  misc_feature: Ceres CLONE 2029247
  misc_feature: SWISSPROT Homolog: EC 5.2.1.8 Peptidylprolyl isomerase

SEQ ID NO: 46195 - DNA, 587 bp, Panicum virgatum
  misc_feature: Ceres CLONE 2029248
  misc_feature: Encodes the peptide sequence at SEQ ID NO. 46196
ggagggacaccaatcacaccacagcgcgcaagatgagcagcagcggcggcggcggggcggtgaagacgccgtcggacttcctcaagtccatcaggggccggcccgtcgtcgtcaagctcaactccggcgtcgactaccgaggtattctggcttgtcttgatggatacatgaacatcgcgatggagcaaactgaagagtatgtgaatggtcagctaaagaacaaatatggtgacgcattcataagaggaaacaatgtattgtacatcagtacatccaagcgtacccttacagacggttcgtgagaggtgaaactgttaagatcttcagtgccactgtgccagtcttgcaactcgaccgattatgagtgaattttatgtattactttcttttccagttgtactgacaggcgacagctatgcttgatgttaatgttagcagcttggaactctgtccacatattttgcactcaagatatgtggtggtaattcgacctgtagagatacagataagactctggtgtcataaactgaaatgtctgctatctcaaatatttttgtgaatcaaaaagacatcattgatctttggct

SEQ ID NO: 46196 - protein, 89 aa, Panicum virgatum; identical to SEQ ID NO: 44515
  misc_feature: Ceres CLONE 2029248
  misc_feature (15)..(80): Pfam Name: LSM Pfam Description: LSM domain

SEQ ID NO: 46197 - DNA, 574 bp, Panicum virgatum
  misc_feature: Ceres CLONE 2029260
  misc_feature: Encodes the peptide sequence at SEQ ID NO. 46198
gtgctctctcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggcggcggctacggtcgccgcgagggcggtggcggctacggcggcggcggcggcggcggcggctacggtggccgtggaggctacggtggcggcggctacagtggcaaccgcggcggcggctacggcaactccgatgggaactggaggagctga

SEQ ID NO: 46198 - protein, 157 aa, Panicum virgatum
  misc_feature: Ceres CLONE 2029260
  misc_feature (10)..(81): Pfam Name: RRM_1 Pfam Description: RNA recognition motif. (a.k.a. RRM, RBD, or RNP domain)
  misc_feature (48)..(152): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSPYGEVLESKIILDRETQRSRGFGFVTFSSEQAMRDAIEGMNGKELDGRSITVNEAQSRGGPRSGGGGGYGRREGGGGYGGGYGRREGGGGYGGGGGGGGYGGRGGYGGGGYSGNRGGGYGNSDGNWRS

SEQ ID NO: 46199 - DNA, 689 bp, Panicum virgatum
  misc_feature: Ceres CLONE 2029277
  misc_feature: Encodes the peptide sequence at SEQ ID NO. 46200
gacaccaaaacatccacaacatcatccatggcgttttccaagagtagtctagctgcctttgctgttgtggccatggcgctggccactgcaaccaccgcctctgcccagaacacgccgcaggacttcgtcaacctgcacaaccgggcgcgcgccgccgaccgtgtcggcccggtgacgtgggacgccagggtggccaggtacgcgcaggactacgccgtcaggcgtgccggggactgcaagctcgtgcactccggcgggccgttcggggagaacctcttctggggctccgcggggcgggcgtggagcgccgccgacgcgctcaggtcatgggtggacgagaagaagaactaccacctcgacaccaacacctgcgacgccggcaaggtgtgcgggcactacacgcaggtggtgtggcgcaagtccacccgcatcggctgcgcgcgcgtcgtctgcgccgccaaccgcggcgtgttcatcatctgcagctacgacccccctggcaacttcaacggcgagaggccgttcctcgcgcttgacgcggctgctaagtagggggcgtgtgcgccgcacgagagttcgttccagcagtgtctccatgcacgcagtattcctacaaaataataagcacgcatatgtgcatgtgtatctttgttgtatgtggccaaatttgtgatgcttgtgtaagatac

SEQ ID NO: 46200 - protein, 174 aa, Panicum virgatum
  misc_feature: Ceres CLONE 2029277
  misc_feature (34)..(154): Pfam Name: SCP Pfam Description: SCP-like extracellular protein
  misc_feature: Functional homolog of the protein sequence given in SEQ ID NO 50414
  misc_feature: Useful for making plants with modulated biotic stress sensitivity
MAFSKSSLAAFAVVAMALATATTASAQNTPQDFVNLHNRARAADRVGPVTWDARVARYAQDYAVRRAGDCKLVHSGGPFGENLFWGSAGRAWSAADALRSWVDEKKNYHLDTNTCDAGKVCGHYTQVVWRKSTRIGCARVVCAANRGVFIICSYDPPGNFNGERPFLALDAAAK

SEQ ID NO: 46201 - DNA, 724 bp, Panicum virgatum
  misc_feature: Ceres CLONE 2029306
  misc_feature: Encodes the peptide sequence at SEQ ID NO. 46202
aaacctagcactcccccgccgccacctcccctccggcttcctcgaggcgaaaccctagcgcccgacctcctctccgcttcaccccactcagccatggcggcggcggacgtggcgtacgctccgccgatgaagtccggcaaggcggggttcgagggggcgatggagccgcagcacaggatccgcatcactctctcctccaggaacgtcaagaacctcgagaaagtctgcggcgatctggtgaagggtgccaagggtaagctgctgaggttgaagggccccgtccggatgcccaccaaggtgctccacatcaccaccaggaagtctccctgtggcgaaggcaccaacacctgggatcgttttgagatgaggattcacaaaagggtgattgatctcgtcagcacaccagatgtggtcaagcagatcacctccatcaccatcgagcctggtgtggaggttgaggtgacaatcagtgacgcgtaatgtggtagccagcatcttatcgttttgaaggattggaaatgcaactgaacaggatgttttgagagtttctagcatgagaaaactctgtagcagaggaattccctcctaatcgatagtttattcgcatcagaattgttgagcccatcgagattttgtggcatgctagtctgtttcagttgatgttatgcatgagtgggatgattatgggatgctcctaatgggttttcatgtcattaatctggca

SEQ ID NO: 46202 - protein, 128 aa, Panicum virgatum
  misc_feature: Ceres CLONE 2029306
  misc_feature (28)..(123): Pfam Name: Ribosomal_S10 Pfam Description: Ribosomal protein S10p/S20e
  misc_feature: Functional homolog of the protein sequence given in SEQ ID NO 50533
  misc_feature: Useful for making plants with modulated phosphate use efficiency
  misc_feature: Functional homolog of the protein sequence given in SEQ ID NO 50532
  misc_feature: Useful for making plants with modulated biomass
  misc_feature: Useful for making plants with modulated flowering time
MAAADVAYAPPMKSGKAGFEGAMEPQHRIRITLSSRNVKNLEKVCGDLVKGAKGKLLRLKGPVRMPTKVLHITTRKSPCGEGTNTWDRFEMRIHKRVIDLVSTPDVVKQITSITIEPGVEVEVTISDA

SEQ ID NO: 46203 - DNA, 712 bp, Panicum virgatum
  misc_feature: Ceres CLONE 2029321
  misc_feature: Encodes the peptide sequence at SEQ ID NO. 46204
ttcctccgagctcgtgctctacaacctggtccccgccccccaaaccctaaaccctccccaaccccacgccgccgccgccgccgtcgccgtctccggcgacctctccatctccaccaccgtcgctccgccgccacaggagcctctccgcgtccggacgcgccgcccggtggggtcctccgccgaccgccacgccaaggtcgccggccgcggccgccgggtccgcatcccggccatggtggcggcgcgcgtcttccagctcacccgcgagctcgggcaccgcaccgacggagagaccatcgagtggctgctccgccaggccgagccctccatcatcgccgccaccggcacgggcgtcactcccgaggaggcgccccccgctcccgtccctgtctcccccgttgcggccaccgcgtccctgatgcccgtaccatactacactgcgctcctcatgcagccaccgccaaccaccgattccgcatctggctctggcaccgccgcacaggagaataataactaggctaggtagaagacggcggttactatggttaggactctaatgttagttattagtttagatttcttatgtgtgtgtgctctgtagccatggcaatggcatcccccattcctcaataattaacatattaccttgggggatgccatggatcccgttgcttagattgtcagttaggtagagaatggattgagatgtaca

SEQ ID NO: 46204 - protein, 171 aa, Panicum virgatum
  misc_feature: Ceres CLONE 2029321
  misc_feature (40)..(168): Pfam Name: TCP Pfam Description: TCP family transcription factor
  misc_feature: The sequence is a functional homolog of SEQ ID NO 2782 in the 10/374,780 US patent application
  misc_feature: The sequence is a functional homolog of SEQ ID NO 680 in the 10/225,066 US patent application
SSELVLYNLVPAPQTLNPPQPHAAAAAVAVSGDLSISTTVAPPPQEPLRVRTRRPVGSSADRHAKVAGRGRRVRIPAMVAARVFQLTRELGHRTDGETIEWLLRQAEPSIIAATGTGVTPEEAPPAPVPVSPVAATASLMPVPYYTALLMQPPPTTDSASGSGTAAQENNN

SEQ ID NO: 46205 - DNA, 638 bp, Panicum virgatum
  misc_feature: Ceres CLONE 2029330
  misc_feature: Encodes the peptide sequence at SEQ ID NO. 46206
atcgcatctcctctcgctctctgttgtgtgactgattgccaagaaagctctctgcttgcttgtgttccagcctctgaatctcgtgaggatgtcgtgctgcggaggcaactgcgggtgcggctccggctgcggagggtgcaagatgtacccggacatgactgagcagggcaccaccaacaaggggcacgccgagggcggatttgaggccggcgccggagccgagaacggctgcaagtgcggtgccaactgcacctgcaacccctgcacctgcaagtgaggagctcatggccctggccggaccggaggagatctgcagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgccgtgtccttcctccccggccggtcgggcacctgtggcggtgctctagcagtgtgttgtgtgtgcagcaggccatgctctgatctttgtggtgtatgtgtgcggcctgctgcttagtgtccctagtgtcgtgtaaccatccatctatatctatctacatccatcttgtgt

SEQ ID NO: 46206 - protein, 62 aa, Panicum virgatum
  misc_feature: Ceres CLONE 2029330
  misc_feature (1)..(61): Pfam Name: Metallothio_2 Pfam Description: Metallothionein
MSCCGGNCGCGSGCGGCKMYPDMTEQGTTNKGHAEGGFEAGAGAENGCKCGANCTCNPCTCK

SEQ ID NO: 46207 - DNA, 827 bp, Panicum virgatum
  misc_feature: Ceres CLONE 2029349
  misc_feature: Encodes the peptide sequence at SEQ ID NO. 46208
agcaggaagcagcaggcttaagatgaagcttgacgtcgccacgttcgcttccctcctggccctggccgcggccgcgtcggcggccggcgccgtcacgttcgacgcgacgaacacggcgtccagcacccccggcggccggcgcttcgaccaggccgtcggcctcggctacgccaagcgggtcctctccgacgcgtccaccttcatctggagcaccttcaaccagcgcagcgccgccgggcgcaagcccgtggacgcggtcaccctcgtcgtcgaggacatcgacggcgtcgcgttcacgagcgccaacggcatccacctcagcgcccggtacgtcggcggctactcgtccggcgacgtgcaggccgaggtgaccggcgtgctgtaccacgaggcgacgcacgtgtggcagtgggacgggcgggggagggcgaacggcggcctcatcgagggcatcgccgactacgtgcggctcaaggccgggtacgcgccggggcactgggtgaagccggggcagggcgaccggtgggaccagggctacgacgtcacggcgaggttcctggactactgcgactcgctgaagccggggttcgtggcgctgctcaacgccaagatgaaggacggctacagcgacgacttcttcgcgcagatcacggggaagagcgtgcagcagctgtggcaggactacaagaagaagtatgggggctgatgtggatagaggtggtccatggtcaacacgtacgtctagtatgacgtggcaaagttgaataaggtgtttgttgcccatctcagtgtactgttgcttactatgctgaatagtaataacgtcg

SEQ ID NO: 46208 - protein, 227 aa, Panicum virgatum
  misc_feature: Ceres CLONE 2029349
  misc_feature (21)..(221): Pfam Name: BSP Pfam Description: Plant Basic Secretory Protein
MKLDVATFASLLALAAAASAAGAVTFDATNTASSTPGGRRFDQAVGLGYAKRVLSDASTFIWSTFNQRSAAGRKPVDAVTLVVEDIDGVAFTSANGIHLSARYVGGYSSGDVQAEVTGVLYHEATHVWQWDGRGRANGGLIEGIADYVRLKAGYAPGHWVKPGQGDRWDQGYDVTARFLDYCDSLKPGFVALLNAKMKDGYSDDFFAQITGKSVQQLWQDYKKKYGG

SEQ ID NO: 46209 - DNA, 803 bp, Panicum virgatum
  misc_feature: Ceres CLONE 2029350
  misc_feature: Encodes the peptide sequence at SEQ ID NO. 46210
atcttgcctccgacgccgacgaacacaaccagtcccccacacttgtgcccaaagaagcctaaccacccaaccacaaacatgaaggagtacaccctcgtcgttcttgggcccggaggcgttggcaagtccgccattacagtgcagttcattcacgacaagttcctcgagcgatacgaccctaccgtcgaggacagctaccggaaggaaatggccgtggatggcgtggcgtgcacgctggacatcatggacacagccggtcaagacgagtacaaagccttgctggaccagtacatgaagaatgcgcacggcttcttgatggtgtacagcatcacgtcgttgaccagcttcgatgcgatgaacaagtttcacgagagcatcagccgagtgcatccgacggccctgcccattatgatggtgggcaacaaggtcgacctcgagaacgaccgcgaggtgaagaccgcccaaggcgaggagtgggccaagaagcaccgcacgggcttccacgaggtcagcgccaagggccgcatcaacgtcgccgagagcttcgtgtggctggtgcacgccatcgacgagtggaggaagaagcatcccgagctcaacacccagcgctcggccgccgtcggcaagaagaagaagtgcaccctcttctgagtgacagagccctcacaccgacaagagctcccacacacaccaaccctcccaccctctacaactggcaggctttagatgaggacctaccaccagttaccaacactgctcgcctgtgtacataacttctccacggcgaattaaagtgtgtcgac

SEQ ID NO: 46210 - protein, 190 aa, Panicum virgatum
  misc_feature: Ceres CLONE 2029350
  misc_feature (5)..(165): Pfam Name: Ras Pfam Description: Ras family
  misc_feature (5)..(118): Pfam Name: Miro Pfam Description: Miro-like protein
MKEYTLVVLGPGGVGKSAITVQFIHDKFLERYDPTVEDSYRKEMAVDGVACTLDIMDTAGQDEYKALLDQYMKNAHGFLMVYSITSLTSFDAMNKFHESISRVHPTALPIMMVGNKVDLENDREVKTAQGEEWAKKHRTGFHEVSAKGRINVAESFVWLVHAIDEWRKKHPELNTQRSAAVGKKKKCTLF

SEQ ID NO: 46211 - DNA, 658 bp, Panicum virgatum
  misc_feature: Ceres CLONE 2029373
  misc_feature: Encodes the peptide sequence at SEQ ID NO. 46212
acgaatgaaagatgagttggagaaaaagtacaatgatttgagttcttttgaaaaggaggcagacgaatttttgaagaattcagagaagaggctccaagatgcaatactcaaagatgatgaagaaactcaggcagctgcaagagagctgctggaacttgttgattccattgctgagcataaagagttcatggaagcaagaattgctcagaggaggaaggaactgtatgaagctgcagattatatagcctctttggcatccaagacatcatctcccaatccttagatctgaatgattataaagtctgatgataagttgctgattccccttctgatcagctgcgcttccttgaggtcttacgattatccctatggcctatgttaagttcattcaacctggagctaagtactacctaaatgtttagctgttggcaatgactctttgactggatacataacaagtaatcttgcacctgttgcaattagctagatatctcagattactctttacacctgtctctccaatgtataagcctgcaaaactctctttcattgagaactctgggagcccctgcaaatgtgcttatgttggcggtccaaggtatctttcggggattcaaggataccaaggccctggtgttttatataggtaactaccgag

SEQ ID NO: 46212 - protein, 93 aa, Panicum virgatum
  misc_feature: Ceres CLONE 2029373
  misc_feature: SWISSPROT Homolog: EC 3.6.3.14 H(+)-transporting two-sector ATPase
RMKDELEKKYNDLSSFEKEADEFLKNSEKRLQDAILKDDEETQAAARELLELVDSIAEHKEFMEARIAQRRKELYEAADYIASLASKTSSPNP

SEQ ID NO: 46213 - DNA, 722 bp, Panicum virgatum
  misc_feature: Ceres CLONE 2029379
  misc_feature: Encodes the peptide sequence at SEQ ID NO. 46214
gtcaacgaccctactaacaccaagaccagacaaaatgggtgcccttaagtatgtcgaggaacttcagaagaagaagcagtcggatatgatgcgcttcttgatgcgcgttcgctgctgggagcttcgccaactgaaggtcatccaccgcgccagccgtccctcgcgccccgacaaggcccgccgtctcgggtacaaggccaagcagggttacgttatctaccgctgccgtgtccgccgcggtggccgcaagaggcccgctcccaagggcgccacctacggcaagcccaccaaccagggtatcaaccagctcaagtaccagcgctccctcaagagcaccgctgaggagcgtgtcggtcgccgctgcgccaacttgcgcgttctcaactcgtactggatcaaccaggactcgacctacaagtactacgaggtcatccttgtcgacccccagcacaaggccatccgccgcgatgcccgcatcaactggatcgtcgcccccgtccacaagcaccgcgagtcccgtggcctcaccgccaccggcaagaagagccgtggtctcggccgtggccacaagtacaacaacaccaccgctggtcgcaggaagacctggaagaggcacaacaccctctccctttggcgctacaggtaaatgtagcgctgagggcgttgcgtggtgtctgggacgtctggtcgaaactttcaagcttatggactggcgtgcatgg

SEQ ID NO: 46214 - protein, 203 aa, Panicum virgatum
  misc_feature: Ceres CLONE 2029379
  misc_feature (2)..(192): Pfam Name: Ribosomal_L15e Pfam Description: Ribosomal L15
MGALKYVEELQKKKQSDMMRFLMRVRCWELRQLKVIHRASRPSRPDKARRLGYKAKQGYVIYRCRVRRGGRKRPAPKGATYGKPTNQGINQLKYQRSLKSTAEERVGRRCANLRVLNSYWINQDSTYKYYEVILVDPQHKAIRRDARINWIVAPVHKHRESRGLTATGKKSRGLGRGHKYNNTTAGRRKTWKRHNTLSLWRYR

SEQ ID NO: 46215 - DNA, 669 bp, Panicum virgatum
  misc_feature: Ceres CLONE 2029393
  misc_feature: Encodes the peptide sequence at SEQ ID NO. 46216
cctcgcttctcagcccgtcagctcagaaaaagaaagagctagcgcatcgcaccggcgtctgagaaatggcgtgcggggcccacctcgccggcgcctgccgcgcgctcctcctcgccggcctcctcgcggccgccgcgtccttccttccggcagccgagccgtcctgcccccgagacacttcgctggtgaaggacgtcggccggatgcaccagagcagctacgggatcgacggcttctcgcacataaccgtcgccggcgcgctcgctcacgggctcaaggaggtggaggtgtggcttcagactatagttccaggcggaaggacgccgatccaccggcactcctgcgaggaggtcttcgtagtcctcaaagggaaaggcacgctcctgctgggctcaagcacgctcaagtacccagggcagccccaggagatccccatcttccagaacagcacgtttacggtccccgtgaacgatccgcaccaggtagtgaattctgacgagcatgaagatctgcaagttcttgtggtcatttcgcgcccaccggtaaagatatttctatacgatgattggagtatgcctcatacagcagcgaagctgaagttccccttcgtctgggatgaggactgcttgccagctcctaaagatgaactctaggtccaaaagcgtttca

SEQ ID NO: 46216 - protein, 195 aa, Panicum virgatum
  misc_feature: Ceres CLONE 2029393
  misc_feature (30)..(195): Pfam Name: Auxin_BP Pfam Description: Auxin binding protein
MACGAHLAGACRALLLAGLLAAAASFLPAAEPSCPRDTSLVKDVGRMHQSSYGIDGFSHITVAGALAHGLKEVEVWLQTIVPGGRTPIHRHSCEEVFVVLKGKGTLLLGSSTLKYPGQPQEIPIFQNSTFTVPVNDPHQVVNSDEHEDLQVLVVISRPPVKIFLYDDWSMPHTAAKLKFPFVWDEDCLPAPKDEL

SEQ ID NO: 46217 - DNA, 624 bp, Panicum virgatum
  misc_feature: Ceres CLONE 2029411
  misc_feature: Encodes the peptide sequence at SEQ ID NO. 46218
gtactgaacatgggctcggcgtcgtcggaggccatcccctccttcccactcaacaccatctacgccgccactaaacggtacgtttctaagttctcgaggagcctttacgtcgagtatagaagcaaagggattgatgtgcagtgccaggccccgttcttcgtggcgaccaggctggtgcccagagccgtgctggacaactggctctcgccgttcgtccccacgccggacgcctacgcccgcgcggcggtgcgctggatcgggcacgccccgctctgcacccccgccgtcggccaccagctcctgtggtgcctcgccggcgtcctgccggacgccgcgcacgactggctccgcctgcgcgagcacctgcggttcagagcgctgttccagagagaaagggcggcgatggcgtcggcagctgatcggggagagaaaacgacgcacgccaaaaaaatgagttttttttttttagtttggctaataatgtgcttgcttggcctgccggaactgatgtggttcctacggttcaccccaaactgtgtgcatcatgaagctgtacgtggttcatttgcctctccttgcttgagcctgagattacaagcgggagaacaaaaaatgagttttgct

SEQ ID NO: 46218 - protein, 207 aa, Panicum virgatum
  misc_feature: Ceres CLONE 2029411
  misc_feature: SWISSPROT Homolog: EC 1.1.1.62 Estradiol 17-beta-dehydrogenase
VLNMGSASSEAIPSFPLNTIYAATKRYVSKFSRSLYVEYRSKGIDVQCQAPFFVATRLVPRAVLDNWLSPFVPTPDAYARAAVRWIGHAPLCTPAVGHQLLWCLAGVLPDAAHDWLRLREHLRFRALFQRERAAMASAADRGEKTTHAKKMSFFFLVWLIMCLLGLPELMWFLRFTPNCVHHEAVRGSFASPCLSLRLQAGEQKMSF

SEQ ID NO: 46219 - DNA, 623 bp, Panicum virgatum
  misc_feature: Ceres CLONE 2029415
  misc_feature: Encodes the peptide sequence at SEQ ID NO. 46220
actaccgccgcgcttcgccctctcgctccagccgcttcacagcgacgccgccgctcgcctctccgaccgccgcgaggatgccgttcaagaggttcgtcgagatcgggcgcgtggccctggtgaactacggcaaagactatggccgcctcgtcgtcatcgtcgatgtggtcgaccagaacagggcacttgtggatgcccctgatatggtcaggtgccagatgaacttcaagcggctctcacttactgacatcaagattgacatcaaacgtgtccccaagaagacaaccttgatcaaggcgatggaggaagctgatgtgaagaccaagtgggagaacagctcatggggcaagaagctgattgtccagaagaggagggcagcgctcaatgactttgacaggttcaaggtcatgctggctaagatcaagaggggtggtgctatcaggcaagagctcgccaagctgaagaaggcgtccacggcttagtctctttggtggatgtgttatgttagagtttttggttctgagttggatcagcaattccaattgagtgttgtcaaagccagaattagtaatatgtttcctgtgaacccatttcaaactttaaagcatgggtgttctctggat

SEQ ID NO: 46220 - protein, 134 aa, Panicum virgatum
  misc_feature: Ceres CLONE 2029415
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQMNFKRLSLTDIKIDIKRVPKKTTLIKAMEEADVKTKWENSSWGKKLIVQKRRAALNDFDRFKVMLAKIKRGGAIRQELAKLKKASTA

SEQ ID NO: 46221 - DNA, 442 bp, Panicum virgatum
  misc_feature: Ceres CLONE 2029421
  misc_feature: Encodes the peptide sequence at SEQ ID NO. 46222
gattcctcatccagccagaatgccagctcaagccaaaaaaggaggtaaaggtaaggcaaaatcaaccaagaaagccgccgtccttaaatttcacattgattgcaccaagccttgtgatcaaaacatttttacacctgacagctttacaaacttcttgaaatccaaaatcaaggttaacggaaagagaaagaaattaggagatgcagttaaagtcacaagcgatgctgccaaaatttctgttcaagctcgtgcaccattctctaagagatatcttaagtacttgacaaagaaatttctcaagaaaaatcaacttcgtgattggctccgtgttgttgctactcaaaagaacagctatgcactcaaatatttcgatatctatgacaacgaaaacgaagaggcttcagaagaaggaaattaattcaataaactgtttcattctggc

SEQ ID NO: 46222 - protein, 132 aa, Panicum virgatum
  misc_feature: Ceres CLONE 2029421
  misc_feature (17)..(129): Pfam Name: Ribosomal_L22e Pfam Description: Ribosomal L22e protein family
MPAQAKKGGKGKAKSTKKAAVLKFHIDCTKPCDQNIFTPDSFTNFLKSKIKVNGKRKKLGDAVKVTSDAAKISVQARAPFSKRYLKYLTKKFLKKNQLRDWLRVVATQKNSYALKYFDIYDNENEEASEEGN

SEQ ID NO: 46223 - DNA, 552 bp, Panicum virgatum
  misc_feature: Ceres CLONE 2029422
  misc_feature: Encodes the peptide sequence at SEQ ID NO. 46224
aacaaacgctaaaaaagtaacagtttctgtactttattgggcctctcgcacagcatgggtcgcatgtatggtcccggcaagggcatctccggatcgtcccttccttatcgccgcaccccgccggcgtggctgaagctgacgtcgcgcgacttggtgaagacgatcgtcgacctggcgaagaagggtatggcgccgtccatgatcggtctgacgctgcgtgactcgatgggtgttgctcaggtcaaggcggtgacgggccgcaagatcgtgcgcatcctgaaggctcacggccgtggtgcggagctgccggaagacatgttctgcctgatcactcgcgccgtcgcgatgcgcaagcaccttgatcgccaccgcaccgacatcgacacgaagttccgtctgattctggtcgagtcgcgcatccaccgcctggcgcgctactataagagtgtgcgcaagctgccgcccacgttcaagtacgaggccgccaacgccgcttctctggttgcccagtgagtgtgattcgcccattgcaaagtttctctcccacgtact

SEQ ID NO: 46224 - protein, 152 aa, Panicum virgatum; identical to SEQ ID NO: 41128
  misc_feature: Ceres CLONE 2029422
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15
  misc_feature: Functional homolog of the protein sequence given in SEQ ID NO 50384
  misc_feature: Useful for making plants with modulated nitrogen use efficiency

SEQ ID NO: 46225 - DNA, 672 bp, Panicum virgatum
  misc_feature: Ceres CLONE 2029423
  misc_feature: Encodes the peptide sequence at SEQ ID NO. 46226
aaaacagcaactccacaaacccaacaactcaatggactcgaccaagccagagacgcagccattgctcgcggggcagcagacgacgccagcacagggcaccagcgcacaagagctggacgcggagacgatcgaggagaagtacgcacaccagctggccgaccggggcgagcggtacatgatcgcgatcgacgggtcgaagcagtccggcgcggcattcaagtggctcctcaagcaggtggcgctggcgggcgacaagaccaaggtcgaggtggtcatcatcaacttcttgcccgagtgcgactttgccgtcgaggtgagccccgagtacgggcaggccaagcaggagctcacccactgcctcgaggagtacaagcgcatcctcaccaacctcaacgtgccgagcgtggtgaggctggtggagggcgcgggcgacgtgcgcgaggcgctgtgtgagcacgtgaagaaggagggcatcaacacgctggtcatgggcaacaccggcaagtccggcctgcagcgggtcttcctgggctccgtcagcgagtactgcgtgcgtcacgccgagtgcgccgtggtggtcgtcaagtgacctctccctccctctcacgcacgccacacacctcgctcgtctgtacacttcttcgcaacttagcaaactgctctcgcatcatg

SEQ ID NO: 46226 - protein, 185 aa, Panicum virgatum
  misc_feature: Ceres CLONE 2029423
  misc_feature (45)..(185): Pfam Name: Usp Pfam Description: Universal stress protein family
MDSTKPETQPLLAGQQTTPAQGTSAQELDAETIEEKYAHQLADRGERYMIAIDGSKQSGAAFKWLLKQVALAGDKTKVEVVIINFLPECDFAVEVSPEYGQAKQELTHCLEEYKRILTNLNVPSVVRLVEGAGDVREALCEHVKKEGINTLVMGNTGKSGLQRVFLGSVSEYCVRHAECAVVVVK

SEQ ID NO: 46227 - DNA, 456 bp, Panicum virgatum
  misc_feature: Ceres CLONE 2029431
  misc_feature: Encodes the peptide sequence at SEQ ID NO. 46228
aagatccaagaactcgcgccccggcacggacagggcaggagatagagagtgagagtgaccgacagtctctggcgccatgaacgtggaggaggaggtcgggaagctcaaggaggagatccagaggctcggccagcagcagcccgatggctcctacaaggtcaagttcggtgtactcttcaatgatgatcgctgtgcaaacatttttgaagcactagtcggcaccttgagggcctccaagaagaggaaaattttgacaatgtggagataaccctattgccgcctcctgcagttgctgccgcttgaggcgcacagatccaccagtccccctattctgtaccgttgatatgctagcactttgttgtgcctatatgtttcatgaactattttgtattcccagaagactgctattgtatgatgtactacgaagttgtgatgctaaaaaaattggcttgcttg

SEQ ID NO: 46228 - protein, 63 aa, Panicum virgatum
  misc_feature: Ceres CLONE 2029431
  misc_feature: Functional homolog of the protein sequence given in SEQ ID NO 50458
  misc_feature: Useful for making plants with modulated nitrogen use efficiency
MNVEEEVGKLKEEIQRLGQQQPDGSYKVKFGVLFNDDRCANIFEALVGTLRASKKRKILTMWR

SEQ ID NO: 46229 - DNA, 521 bp, Panicum virgatum
  misc_feature: Ceres CLONE 2029439
  misc_feature: Encodes the peptide sequence at SEQ ID NO. 46230
aacgctgaaagacgacgccatccctcgccagctcgcctcctccactcctcccaaacccctcgccgactcagattccgctgccccgcgccgccgccgccgccatgccgttcaccccgggcccctactccggcgtcagcaccctcgctctcgtggcgagggcgtcggccttcggcgtcggtgtcgtctacgggagcatcaagctctccatcctcaaggcgacgaaacctaaaaaggaggaagcacaggctcatcactaaggatggcagggatgcaatgtgttacctgcagttcaaggatgtcataaattggcagtgtaccccttcttcatacgtgcatttgggtttatcatttgtggacctcttgtctgtaacacacctgctgagttaccttagttttgcgtcataataagttcttgatcccatgacttgaaatgaggaagtaaagggcaaaagctggaaagaatccttttttgccaacgattttgaagttcagcaattatatatggtgaagttttgcatgcc

SEQ ID NO: 46230 - protein, 51 aa, Panicum virgatum
  misc_feature: Ceres CLONE 2029439
  misc_feature: Functional homolog of the protein sequence given in SEQ ID NO 51718
  misc_feature: Useful for making plants with altered carbohydrate content
  misc_feature: Functional homolog of the protein sequence given in SEQ ID NO 51509
  misc_feature: Useful for making plants with altered cell wall content and/or composition
MPFTPGPYSGVSTLALVARASAFGVGVVYGSIKLSILKATKPKKEEAQAHH

SEQ ID NO: 46231 - DNA, 664 bp, Panicum virgatum
  misc_feature: Ceres CLONE 2029446
  misc_feature: Encodes the peptide sequence at SEQ ID NO. 46232
atcacaaccgacctccgatccacaaatcatccctgctaagctagctagctgctttacacttcactcactagtcactagcagcttagtcattcgaagatcagtgagtgttattatatatctgtagctgcaatattatatagaattatatatatggctcgcctctccgccgttggcgccgtcgtcctggtggctgcgctggtggcggccgagaccgcttcggctgcggtgagctgcagccaggtgacgtcggccgtggcgccgtgcctggggtacgccatgggcagctcggcgtcgccctcgtcggcgtgctgcaacggggtgaggtcgctcaacagccgggcgtcgtcgacggcggacaggcaggcggcgtgcgcctgcctcaagaacatggcggggaggctgggtggcaacatgggcaacgccgccgccagcatcccaagcaagtgcggcgtcaacgtcggcgtgccaatcagcccaaacgtcgactgcgccaagattaactgagaagaaggatggtggatgctcagctctttccttctctttgggtatgatgtcggccaacagagcagagagcagtcgtttaatttactacctcttccttttacatttgtacaacaccacgcaccacctgtgtacgtcgtcgtgtatgtgtatgtaacaacat

SEQ ID NO: 46232 - protein, 117 aa, Panicum virgatum
  misc_feature: Ceres CLONE 2029446
  misc_feature (28)..(113): Pfam Name: Tryp_alpha_amyl Pfam Description: Protease inhibitor/seed storage/LTP family
MARLSAVGAVVLVAALVAAETASAAVSCSQVTSAVAPCLGYAMGSSASPSSACCNGVRSLNSRASSTADRQAACACLKNMAGRLGGNMGNAAASIPSKCGVNVGVPISPNVDCAKIN

SEQ ID NO: 46233 - DNA, 668 bp, Panicum virgatum
  misc_feature: Ceres CLONE 2029476
  misc_feature: Encodes the peptide sequence at SEQ ID NO. 46234
ctcgagtcctctttcttctccacttcttcctgcggcggcggccgatttgggggcaattcgccatagcagattggcaacgaaggggggaagcagccggcgattcgctccgagccgatctgattcgccatgaagcccttcaagaaggaattcaccttcgatgagaggctccaggaatccgccgccatgatcgccaactaccccgccagggtccccgtaatcgttgaaaggttttcacggagtaatttaccagaaatggagaagaggaagtacctggttccctgtgacatgccagttgggcagttcattttcatactacggtccaggttacacctatctccaggaacagcgctatttgtgtttgtaaacaacgctttgccccaaacagctagcctgatgggaagtgtatacgactcgtacaaggacaaggacggcttcctttacatgtgctacagcagcgagaagacatttggctgctctgcccctggactgacctgacgtagaaattttgctttgcggccaggtagcccgtacatcacctctgtacatatatcgtgctactccgtatgttatgtgaataaactctgtacatatagatgcatcgtgctacatttgagaaatgatgtactacttgtgtatagctgttaataaagcaatatcctaccctctac

SEQ ID NO: 46234 - protein, 122 aa, Panicum virgatum
  misc_feature: Ceres CLONE 2029476
  misc_feature (12)..(115): Pfam Name: MAP1_LC3 Pfam Description: Microtubule associated protein 1A/1B, light chain 3
  misc_feature: Functional homolog of the protein sequence given in SEQ ID NO 50573
  misc_feature: Useful for making plants with modulated nitrogen use efficiency
MKPFKKEFTFDERLQESAAMIANYPARVPVIVERFSRSNLPEMEKRKYLVPCDMPVGQFIFILRSRLHLSPGTALFVFVNNALPQTASLMGSVYDSYKDKDGFLYMCYSSEKTFGCSAPGLT

SEQ ID NO: 46235 - DNA, 704 bp, Panicum virgatum
  misc_feature: Ceres CLONE 2029481
  misc_feature: Encodes the peptide sequence at SEQ ID NO. 46236
tcagggccagcaacctgtgcagtcatttcagcaacagatgcttcctcgaggacggatgtaccgttacccaaccggccgcaacatgcctgaagctccagcaattccaggagttgctggtggtatgattcagccatatgatatgggaggcttccctgtgagagatacagccttatcacctgctgcccaaattggtactttgacatctgcccttgcaaatgctactcctgagcagcaaagaacgatacttggtgaaaacctatacccactggttgagcaactggaaccaaaccaagcggccaaggtcaccggaatgcttttggagatggatcagacagaggttctccacctgctcgagtcccctgaggctctcaagtccaaggttgctgaggcgatggacgttctccgcaatgtagcccatcagcagaatccaaacaccccgaccagtcagcttgctgcgttatcactgaccgaaggcattatctcctaacttgaaagtcataacaaacgatcttcagtttgcaattgcgtgtggtttttccagaggttatccggcacatgacagtattgctcctttttttttcttcctatgggtggacttgtgtgagcagtgagtcttttccatactggatgttaggtattattttgtgctgtctggtgtcctgaccgttaaggcaaagtacttgtttcccagtttgagtgctatt

SEQ ID NO: 46236 - protein, 161 aa, Panicum virgatum
  misc_feature: Ceres CLONE 2029481
  misc_feature (63)..(134): Pfam Name: PABP Pfam Description: Poly-adenylate binding protein, unique domain
QGQQPVQSFQQQMLPRGRMYRYPTGRNMPEAPAIPGVAGGMIQPYDMGGFPVRDTALSPAAQIGTLTSALANATPEQQRTILGENLYPLVEQLEPNQAAKVTGMLLEMDQTEVLHLLESPEALKSKVAEAMDVLRNVAHQQNPNTPTSQLAALSLTEGIIS

SEQ ID NO: 46237 - DNA, 803 bp, Panicum virgatum
  misc_feature: Ceres CLONE 2029483
  misc_feature: Encodes the peptide sequence at SEQ ID NO. 46238
gtcgacctccatccagccgatctcgctcgctcccctgcacagccggcgagccagcgcctagcttattgctagttgttacaggcaggcaggcagccatgtggacgaggaaggcggccgtgctgctcctgctgctcatcgtcgtcgcacatgggtggtcgccggcgccggcgccggcggcggaggcgcgcgtgtgccggcggcggagcgcggggtcccgggggccctgcatctccaaccgcaactgcgcgcaagtgtgcctgcaggagggctggggcggtggcaactgcgacggcttccgccgccagtgcaagtgcgtcaggcagtgctagctagccatccactgacgaaccggcaggtgggtgtcgcgccaatttagggtcaacacacgaatgcgcttgatcgcgcggtgagcgacggcacaattgcagcgccgatggtcagaccggtcgggggaaccggtcagaccggttcgccggtgcagaacggcgaaatccgaccaacgctcgctcgggagggaccccgtcagggcaagcacacgtagggttgttctaggatcggcaagccacctagaactccttcagacgtcgcggagacgaaggaagaacaacaagtatggggttggaagagttagggtttagagacaaaagtaaaggcaataaacacaaagaaaagtaatgtattgatgtgtttttatcgattgaattgtctcagtcggctgtgaccctttatatttatagggtgggtggacttgtcccgtaaaaaatcctattacaagatctaaatctatgaaaatctctagttgt

SEQ ID NO: 46238 - protein, 77 aa, Panicum virgatum
  misc_feature: Ceres CLONE 2029483
  misc_feature (31)..(77): Pfam Name: Gamma-thionin Pfam Description: Gamma-thionin family
MWTRKAAVLLLLLIVVAHGWSPAPAPAAEARVCRRRSAGSRGPCISNRNCAQVCLQEGWGGGNCDGFRRQCKCVRQC

SEQ ID NO: 46239 - DNA, 730 bp, Panicum virgatum
  misc_feature: Ceres CLONE 2029497
  misc_feature: Encodes the peptide sequence at SEQ ID NO. 46240
acggcaagaggctcatgagcatggacgagatcatcgacgagtgcaagaccttcttcttcgccggccacgagaccacctcgcacctcctcacctgggccatgttcctcctcggcacccaccccgagtggcagcagcggctcagggaggaggtgctccgcgagtgcggcgacgccgaggcgcccatcagcgccgacgccctcagccagctcaagcaggtgacgatggtgctgtacgagacgctccggctgtacggcccggtgacgctggccgcgcggcgggcgacggcggacgcggagctctgcggcgtgaaggtgcccaagggcaccgggctgctgatcccttacgccatcctccaccgcgacgaggaagtgtggggcgccgacgccggcgagttcaacccgctccggttccgggacggcgtgcgcagggcggccgcggacccgagcgcgctgctgtccttctccatcggcccgcggtcgtgcatcgggcaggacttcgcgatgctggaggccaaggcgacgctggcgctcatcctgcggcggttcgccttcgaggtggcgccggagtacgtgcacgcgccggtcgacttcctgacgctgcagccattgcaagggctccccatcgtgctcaagctcttggatccacaggagaggggaatctgatctttcatgacttgctacagaagatcgacaaatctgtcactatcacgtgcgcgcagatggcaccgtac

SEQ ID NO: 46240 - protein, 219 aa, Panicum virgatum
  misc_feature: Ceres CLONE 2029497
  misc_feature: SWISSPROT Homolog: EC 1.3.3.9 Secologanin synthase
GKRLMSMDEIIDECKTFFFAGHETTSHLLTWAMFLLGTHPEWQQRLREEVLRECGDAEAPISADALSQLKQVTMVLYETLRLYGPVTLAARRATADAELCGVKVPKGTGLLIPYAILHRDEEVWGADAGEFNPLRFRDGVRRAAADPSALLSFSIGPRSCIGQDFAMLEAKATLALILRRFAFEVAPEYVHAPVDFLTLQPLQGLPIVLKLLDPQERGI

SEQ ID NO: 46241 - DNA, 618 bp, Panicum virgatum
  misc_feature: Ceres CLONE 2029512
  misc_feature: Encodes the peptide sequence at SEQ ID NO. 46242
acagtcggaggagaagaagagaaggatgggtttcgagaaggagatcctgagagccggcaccggccccaagccgacaaagggccagaaggtcaccgtccactgcaccggctacgaaaaacagcaacaaccttcaggtgctcaaggtcacggtgcatcatcatcacagggagcagcagcaacatcacaacagaaaaggaagagaggtgtccagcaccacgggaaggatcgtgatctatccaagaaattttggagcaccaaggacccaggtcagcagccattcagtttcaacattggtctgggttcagtgatcaaaggatgggatgagggagttatgaccatgcaagtgggtgaagttgctcgtatccagtgcaccccagactatgcttatggagccagcggatttcctgcctggggaattcaaccaaactcggtgctggtgttcgagattgaggtcctcagtgctcagtaattcgcgttgcaattctggatagagccttgcctcttaagtactgaaataaatcctgttctacatacagcacactggtgttcttagtaaaccctgttcaactttaacactgcgtggccgtgatatatcaggtttatggaattacttgtggc

SEQ ID NO: 46242 - protein, 147 aa, Panicum virgatum
  misc_feature: Ceres CLONE 2029512
  misc_feature (11)..(144): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGFEKEILRAGTGPKPTKGQKVTVHCTGYEKQQQPSGAQGHGASSSQGAAATSQQKRKRGVQHHGKDRDLSKKFWSTKDPGQQPFSFNIGLGSVIKGWDEGVMTMQVGEVARIQCTPDYAYGASGFPAWGIQPNSVLVFEIEVLSAQ

SEQ ID NO: 46243 - DNA, 750 bp, Panicum virgatum
  misc_feature: Ceres CLONE 2029516
  misc_feature: Encodes the peptide sequence at SEQ ID NO. 46244
aatcatttacaaaaagctttaaaaaaacaacctctaaacaacatgtctttacattcagacccctctaaaatcggaactttcgagcccctctcaagccaatctcgtaccactggcttgattatgcaaggccagcaacaagccgagacgacacacatgactcaaccgacctacaccaccaccacagctcccactaacctgactggccacgatgtcgttggaactgtcattttcagacctcttgaagccaagtttgtgacggacaaggacgttattggaaagatggacccttactgcaagttcaagatcggatggcacactgcaaagagctcagttgccaagagccaaggaactcatcctgtttggaatgactcaattaccctgcagagaaagcatggcgaacaatgggctaagctcaagtgcaaggacagagatagaattaccttgaacgataacttgggttcagtcaagattaaccttgatgaagttgctgcgaagggaagagtccagcaatggttcactttgactaagagagacaaggttactggtgaagttttggttgatattgagtatgtgagctcactcactgctaatccaactatggtttaagagatgctggttattgtaaataactgagataactttgcgtataaagttggacgtatgtatgatacttaattatataagctataatatcgatatagtatcgtgaatcagttcttgaaattttgttcctcttgaaaatttttctgg

SEQ ID NO: 46244 - protein, 150 aa, Panicum virgatum
  misc_feature: Ceres CLONE 2029516
  misc_feature (24)..(105): Pfam Name: C2 Pfam Description: C2 domain
  misc_feature: SWISSPROT Homolog: EC 2.7.11.13 Protein kinase C
MTQPTYTTTTAPTNLTGHDVVGTVIFRPLEAKFVTDKDVIGKMDPYCKFKIGWHTAKSSVAKSQGTHPVWNDSITLQRKHGEQWAKLKCKDRDRITLNDNLGSVKINLDEVAAKGRVQQWFTLTKRDKVTGEVLVDIEYVSSLTANPTMV

SEQ ID NO: 46245 - DNA, 699 bp, Panicum virgatum
  misc_feature: Ceres CLONE 2029528
  misc_feature: Encodes the peptide sequence at SEQ ID NO. 46246
tcgtcagctggttttcctttatgagagaggaaaaaagaaacttatggatggtgctcggatcgcgtttccagatgaaatagatccaccctctgttgcggggaggattgttgagtgttcttggaataaggaagagaagtgttgggcctgcatgcgtattcgatcagataaatcgactcctaacgatatcaacacataccgaaaggtgatgaggagcatcacagataacatcactgaggagaagcttcttgaagagattgatgagatcaggtgcctcccgatgtatgccgataggatagcgcaggctcatgcgaagatggcacaacatcggaggagatgaacgccagattagagtgctagcctctttgcgatagtgctggagtgctctcctaccgtctctggccagcggctgggttcccgtagttgtgtaattagtagaggtttcagtaggcctatgatgatggctggctgggtctggccagccaactaattctttgcacctccgcatttgtgcttcctcccaacccacctgtataggcgtcgccccagagtagttgcatgtaaatcgtgtattctatgttctcctatattctctcctatggtttttatttttcatgggtgtagaatagcgtttaacaagagggattgttctaggtatattggtgtatgctttgccatctctcggtgttgccttgctataat

SEQ ID NO: 46246 - protein, 111 aa, Panicum virgatum
  misc_feature: Ceres CLONE 2029528
  misc_feature (2)..(83): Pfam Name: mRNA_cap_C Pfam Description: mRNA capping enzyme, C-terminal domain
  misc_feature: SWISSPROT Homolog: EC 2.7.7.50 mRNA guanylyltransferase
RQLVFLYERGKKKLMDGARIAFPDEIDPPSVAGRIVECSWNKEEKCWACMRIRSDKSTPNDINTYRKVMRSITDNITEEKLLEEIDEIRCLPMYADRIAQAHAKMAQHRRR

SEQ ID NO: 46247 - DNA, 424 bp, Panicum virgatum
  misc_feature: Ceres CLONE 2029538
  misc_feature: Encodes the peptide sequence at SEQ ID NO. 46248
aaatcgcatcagccgctcgcgtcagatcgctttcctcattctcacgggcaccgtggcatgcaggtgtttcgcagggagcggcgcgggaagcgtccgggagcttcatccaccccgccgccgtcgtccaccccgatgcggtcatcggccagggtgtctcgatagggcccttttgcacggtagggccttcagccagggttggtgatgcctgtcaattacatgctgggagccatgtcgtgggagacactgagctaggggagggatgcattgttcaaacgtgagatatcatcttttcacattttgtttctcctgatttccaccccttttgtaactatgttgatgcttgcattgacctccattggaactccatatttttaaatataattgaatcaaagaaagatgaagatgtattgaacatcttctgcgg

SEQ ID NO: 46248 - protein, 91 aa, Panicum virgatum
  misc_feature: Ceres CLONE 2029538
  misc_feature: SWISSPROT Homolog: EC 2.3.1.129 Acyl-[acyl-carrier-protein]--UDP-N-acetylglucosamine O-acyltransferase
IASAARVRSLSSFSRAPWHAGVSQGAAREASGSFIHPAAVVHPDAVIGQGVSIGPFCTVGPSARVGDACQLHAGSHVVGDTELGEGCIVQT

SEQ ID NO: 46249 - DNA, 508 bp, Panicum virgatum
  misc_feature: Ceres CLONE 2029553
  misc_feature: Encodes the peptide sequence at SEQ ID NO. 46250
ttattaactcaaggaaattaaattcacaaatggtccactgccctaagactattaaaacctactgcagaaagtgcaagagacacactgctcacaaggtctcccaatacaagaagggtaaggaatctaaggtcgctcaaggtaaaagacgttacgatgccaaacaatcaggttacggtggtcaaaccaagcctattttgagaaagaaggccaagactactaagaagattaccctcagacttgcttgcagtgttaccaattgcggtgccaagagattatatcttatgggaagagccaagactttcatcctcggacaagaaggcaaaaagtaaataaaataaccttgaacataagtgtatttgttgtatgaagcttcatatacccctcttttatgtgcttataaagaagaaacttagatttcaactcctagccaattcttaagtctctcctcacattccaacgggggctgcttaagaatttccttctaaagagccatccgaaaggcaacacg

SEQ ID NO: 46250 - protein, 99 aa, Panicum virgatum
  misc_feature: Ceres CLONE 2029553
  misc_feature (17)..(95): Pfam Name: Ribosomal_L44 Pfam Description: Ribosomal protein L44
MVHCPKTIKTYCRKCKRHTAHKVSQYKKGKESKVAQGKRRYDAKQSGYGGQTKPILRKKAKTTKKITLRLACSVTNCGAKRLYLMGRAKTFILGQEGKK

SEQ ID NO: 46251 - DNA, 607 bp, Panicum virgatum
  misc_feature: Ceres CLONE 2029568
  misc_feature: Encodes the peptide sequence at SEQ ID NO. 46252
aacttatttattatctttccgacgccctcaactctcaactctcctcctatcatgtacaagcttgctgctttattagttttgctttttgttgtttcatccagtgcccgtactttcacaattgtgaacaaatgcccttatcaagtcaacatccaatcccgtggagctggtggccctagcggaagtgttggtgctggaagaactgccaatttgggagttgccaacaactggaatggtagaatgtgggctaacggtgctgacaataaggctactcttggtgaattctgccttgcttgctggaacaacctcgataactacaacttgagtgtcattgatggttacaacatccccatgaaaatcgctcccaagagaggtggctgccccgttgtcgcttgctacggaagaccctgtgctcaaggctacaactaccctgctgataatagcaagatgaagacatgctctccttctgactttactattcaattctgctaaagggatatttattcgtaataattaataacgaggagaaatgattgcgttagcagtcgtttgttcttcctaattaactctctaaagaataataattagaaaaactcacattaaacttctc

SEQ ID NO: 46252 - protein, 145 aa, Panicum virgatum
  misc_feature: Ceres CLONE 2029568
  misc_feature (25)..(145): Pfam Name: Thaumatin Pfam Description: Thaumatin family
MYKLAALLVLLFVVSSSARTFTIVNKCPYQVNIQSRGAGGPSGSVGAGRTANLGVANNWNGRMWANGADNKATLGEFCLACWNNLDNYNLSVIDGYNIPMKIAPKRGGCPVVACYGRPCAQGYNYPADNSKMKTCSPSDFTIQFC

SEQ ID NO: 46253 - DNA, 618 bp, Panicum virgatum
  misc_feature: Ceres CLONE 2029577
  misc_feature: Encodes the peptide sequence at SEQ ID NO. 46254
ccgcctccgccgcctcgcgcttcgccccccctcacttgcttccccacccggcggcgctccccgtcgcgaagagatggcggtgccgctgctgacgaagaagatcgtgaagaagcgggtcaagcagttcaagaggccccaccttgaccgctacaagtgcctcaagccaagctggcgcaggcccaagggtattgactcccgtgtcaggaggaagttcaagggatgcaccttgatgcctaacattgggtacggttctgacaagtcaaccaggcactaccttcccaacaagttcaagaagtttctggtgcacaatgtctctgagctggagttgctcatgatgcacaacaggacatactgtgcggagatcgcccacaacgtctcaacaaagaagcgcaaggatattgttgagcgtgctgctcagctcgacattgttgtcaccaacaagctcgccaggctccgcagccaggaggatgagtaggctgggttgctcgtcagcacaactgttgggtcttgtctttcttgtctgtaggaaaactactctgtttcgcgtcgtattgtattgctaccgaggataccttctatgcccgacctttttgctatcaatagcgactctaatatgtc

SEQ ID NO: 46254 - protein, 133 aa, Panicum virgatum; identical to SEQ ID NO: 31645
  misc_feature: Ceres CLONE 2029577
  misc_feature (14)..(123): Pfam Name: Ribosomal_L32e Pfam Description: Ribosomal protein L32

SEQ ID NO: 46255 - DNA, 666 bp, Panicum virgatum
  misc_feature: Ceres CLONE 2029606
  misc_feature: Encodes the peptide sequence at SEQ ID NO. 46256
atgctgtatttaggagagagaaaggaaaaaccgagctctaatctccctccccgacggagatcgcctgctcctggagcaaccgccgctccttcccgcaccggcgcggacgccactcccgccagattccgcaactgattgctgcagtttactctgctgcctaacccaaggatctctcggaacattcagaaccgtatcaacctcggactccctgcagttcttgtgctaggatctgtgccgtggggcgtcaaacagctcgcagatggacggtggcgggggcgacctgcggagcactatcaagaagtggaacgtcttatacccggtctacctcaactccaagaagacggttgctgaaggccgccgcatcgccaccagcaaggcctgccctgaccccacctgcatcgagatagccgactgctgctcgcacctcaagatcccccacaccatcgagcttgataaggcgtaccctcgggatttcttccaggtggggagggtcagggtgcagctcaagaaggatgacggctcccctgtcaatcctgctattaaaacgaagaagcagctgatgatccaaatagcagagctagttcccaagcatcatggaaggacaaagaagcaggaatcagcgctcagctcttcagctggtggcagttcgaagaacacaaaaggcgg

SEQ ID NO: 46256 - protein, 135 aa, Panicum virgatum
  misc_feature: Ceres CLONE 2029606
  misc_feature (16)..(112): Pfam Name: SRP19 Pfam Description: SRP19 protein
MDGGGGDLRSTIKKWNVLYPVYLNSKKTVAEGRRIATSKACPDPTCIEIADCCSHLKIPHTIELDKAYPRDFFQVGRVRVQLKKDDGSPVNPAIKTKKQLMIQIAELVPKHHGRTKKQESALSSSAGGSSKNTKG

SEQ ID NO: 46257 - DNA, 560 bp, Panicum virgatum
  misc_feature: Ceres CLONE 2029608
  misc_feature: Encodes the peptide sequence at SEQ ID NO. 46258
aagcagttatcaaggtcatggcccaaaagggtttgcctataatgctattcagcacagatgaggcatcaaacaaagctgttatctatgctggtgtgccgcccaacacacctagtggccttaaggtgttggattggctaacaccttcaattgcaccactcaagggaagaggtggtggtggcaagaatggtgtcgcccagggccagggaaatgatgcttctcaactcaaggaggcaatggagctcgcgaacaacattgccgcaatgaagctcagctgatgggttgaattccttgtgcactccacttttgaggttatgtgtcgctgtaggtccagcattcttcacttttacattccgtcgttcacctaacacaaatttcggtctttcacctaacagaaattatgtaatgtttgctgttccatttacatactataccattcaaaccacatgatgacatacaacctaactgttaagagctggctgctgcagctatcttatttctgctgatgtataaggtgttaaattattcaatgcatcatgtggcattatttgaatttgcttgtt

SEQ ID NO: 46258 - protein, 90 aa, Panicum virgatum
  misc_feature: Ceres CLONE 2029608
  misc_feature (10)..(83): Pfam Name: DHHA1 Pfam Description: DHHA1 domain
  misc_feature: SWISSPROT Homolog: EC 6.1.1.7 Alanine--tRNA ligase
AVIKVMAQKGLPIMLFSTDEASNKAVIYAGVPPNTPSGLKVLDWLTPSIAPLKGRGGGGKNGVAQGQGNDASQLKEAMELANNIAAMKLS

SEQ ID NO: 46259 - DNA, 480 bp, Panicum virgatum
  misc_feature: Ceres CLONE 2029618
  misc_feature: Encodes the peptide sequence at SEQ ID NO. 46260
aaaacgacaactcctcagtaacgttcagataaatcatggccgccgccaagtgtgcagtttgcggaaagaccgcctatcctctcgagtccgtcaaggccctcgatgttgtttatcacaagccttgcttcaagtgcgccgtgtgcagcatcaccctgaacgtgaagaccttcaagggcgttgctggctctgtctactgtgccactcacacccccgtcgaccgatcttcgactgctgatggcgacttcaccatcaagtccgctgctgaagctcagaagaagaactccgatgcccgctctgctcagctcgctgcccagaagggtactggcgaggcccccacccaggttgaggacttcaccatgaagagccagctcgaggctcaggagaagaactctgactcccgaggtgcccagcttgctgctcagaagggtactggtgagacccctcaccaggtcatgtactaagctctttgtcgatttgagc

SEQ ID NO: 46260 - protein, 141 aa, Panicum virgatum
  misc_feature: Ceres CLONE 2029618
  misc_feature (6)..(60): Pfam Name: LIM Pfam Description: LIM domain
MAAAKCAVCGKTAYPLESVKALDVVYHKPCFKCAVCSITLNVKTFKGVAGSVYCATHTPVDRSSTADGDFTIKSAAEAQKKNSDARSAQLAAQKGTGEAPTQVEDFTMKSQLEAQEKNSDSRGAQLAAQKGTGETPHQVMY

SEQ ID NO: 46261 - DNA, 283 bp, Panicum virgatum
  misc_feature: Ceres CLONE 2029638
  misc_feature: Encodes the peptide sequence at SEQ ID NO. 46262
ctcccctagcgccggctcgcgtcctctctctccctcgcgccgctgccgcaggcgctgctggtgcaggaagacccctccccgcctatcggaggagatcaacgaccagccgccgctgtgcggggtatgcgaagccgcgggaatggtatctcatcctcggcgctgccgtacaatactactcccccgacctggctcaagactgctgcctccgatgtggaggacatgatcaccaaggccgccaagaaggaccggatcccgtcacagattgacctcctcctctgtgacc

SEQ ID NO: 46262 - protein, 53 aa, Panicum virgatum
  misc_feature: Ceres CLONE 2029638
  misc_feature (1)..(53): Pfam Name: Ribosomal_S13_N Pfam Description: Ribosomal S13/S15 N-terminal domain
  misc_feature: Functional homolog of the protein sequence given in SEQ ID NO 50384
  misc_feature: Useful for making plants with modulated nitrogen use efficiency
MRSRGNGISSSALPYNTTPPTWLKTAASDVEDMITKAAKKDRIPSQIDLLLCD

SEQ ID NO: 46263 - DNA, 715 bp, Panicum virgatum
  misc_feature: Ceres CLONE 2029643
  misc_feature: Encodes the peptide sequence at SEQ ID NO. 46264
gggcttcggcgtcatcgacaacatcaaggcgcaggtggaggctttgtgcccgcagaccgtctcctgcgccgacatcctcgccgtcgccgcccgtgactccgtcgtcgcgctcggcgggccttcatggaccgttccgctgggaagaagggactctaccaattcaagcgcggccctggcaaatagcgacctcccacctcctcagtttaacctctcgcagcttatcactgcgtttgggaacaagaacctcgacccaacagacctggttgccctctctggtgctcacacaatcggacaagcgcagtgcctcaacttccgggcccacatcaccgagcccaacatcaaccccaccttcgccgcgtcgctcagggccaactgccccgccacaggcggcgacaccaacctggcgccgctggacgtcaccacgcccaacaccttcgacaacgcctactacaccaacctgctcaaccagagggggctcctgcactccgaccaggagctcttcaacaacgccagcaccgacagcactgtccgcaacttcgcgtccaacgcagccgccttcaccaccgccttcaccacggccatgatcaagatgggcaacctccagccgctcaccgggacccagggccagatcaggcgcaactgctggagggtcaactcgtcgtaataataagcctgccgatcgacgcttattggcatcaagcatatctatatgcga

SEQ ID NO: 46264 - protein, 220 aa, Panicum virgatum
  misc_feature: Ceres CLONE 2029643
  misc_feature (1)..(182): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50228
  misc_feature: Useful for making plants with altered carbohydrate content
  misc_feature: Functional homolog of the protein sequence given in SEQ ID NO 50229
  misc_feature: Useful for making plants with altered cell wall content and/or composition
GFGVIDNIKAQVEALCPQTVSCADILAVAARDSVVALGGPSWTVPLGRRDSTNSSAALANSDLPPPQFNLSQLITAFGNKNLDPTDLVALSGAHTIGQAQCLNFRAHITEPNINPTFAASLRANCPATGGDTNLAPLDVTTPNTFDNAYYTNLLNQRGLLHSDQELFNNASTDSTVRNFASNAAAFTTAFTTAMIKMGNLQPLTGTQGQIRRNCWRVNSS

SEQ ID NO: 46265 - DNA, 816 bp, Panicum virgatum
  misc_feature: Ceres CLONE 2029648
  misc_feature: Encodes the peptide sequence at SEQ ID NO. 46266
aatatcttaaaaaactattttgttataataaatcaaaatggactccactaacactgctcaattcactcttcaaaaagtcagagatgccctcaatgccagaggtgcccacaccatcagatctctcggcagagtctttagacaaatggattcttatgatggcaacaagaaagtcgatagagacgaattcttgattggtcttaaagaaaacggtgttcaaatcaccaaacaagaagctaatgctcttttggactatatggatactaatagagacggaactttggactttgatgaattcttggtggctcttagaggaaaaatgaatgctactagacatgagattactgataaggcttttgtcaaattcgacagagatggaagtggcagcattaatgcttctgatttgagaggagtgtataatgcctcaaagcaccccaaggttttggaaggaaaaatgactgaagatcaagttttccaagaatttttgcaaagtttcgctgatgccaataaggatggtgtcatcactaaacaagaatgggatcaatattatgattcagtcagtgcttccattgatgatgatcaacattttgttgaattgatgataagctgctggaaactctaagtttcttgagcagaaaaaaaaaagctttatatgaaaagctggattttagaatgttttggataaaaagttcataaaaagtgataccaaagcatagaaatatatattccattcatataactacttattgatatcgatatctctctatatttaaaggaacttcctttttatccatattgatgatatctttaaaaaaatcc

SEQ ID NO: 46266 - protein, 193 aa, Panicum virgatum
  misc_feature: Ceres CLONE 2029648
  misc_feature (65)..(93): Pfam Name: efhand Pfam Description: EF hand
  misc_feature: SWISSPROT Homolog: EC 2.7.11.1 Non-specific serine/threonine protein kinase
MDSTNTAQFTLQKVRDALNARGAHTIRSLGRVFRQMDSYDGNKKVDRDEFLIGLKENGVQITKQEANALLDYMDTNRDGTLDFDEFLVALRGKMNATRHEITDKAFVKFDRDGSGSINASDLRGVYNASKHPKVLEGKMTEDQVFQEFLQSFADANKDGVITKQEWDQYYDSVSASIDDDQHFVELMISCWKL

SEQ ID NO: 46267 - DNA, 888 bp, Panicum virgatum
  misc_feature: Ceres CLONE 2029656
  misc_feature: Encodes the peptide sequence at SEQ ID NO. 46268
agggtgtcgtggcggttttgactcggatcatggtgcgcagctcgagcaggtagaggaagaggagagccgacctgaggcggggcttgggaggcgcggatcgcagcggcaggggcaggagatcgaggggaagccgagggagcggggagaggatcaaggggggaacgcgagggagcggggaggatggtgctggtgctcgcgctgggggatctgcacatcccgcaccgggcgcccgacctgcccgccaagttcaagtccatgctcgtgcccggcaagatccagcacatcatctgcaccggcaacctctgcatcaaggaagtctatgactatctaaaaagcctttgtcctgatctccacataaccagaggtgaatatgatgaggatgctcgatacccagagactaagacacttacaattggtcaatttaagctcgggctgtgccatggtcatcaggttgttccatggggcgacctagactccctggcaatgctgcagcggcagctggatgtggacatactggtgacggggcacacccaccagttcaaggcgtacaagcacgagggcggcgtggtgatcaaccctgggtcggccacaggcgcctacagcagcatcacctacgacgtgaacccaagctttgtgctgatggacatcgatggcctgcgtgtggtggtgtacgtttacgagctgatcgacggtgaggtgaaggtggacaagatcgacttcaagaagacggccacgacgatacacgcgtagctttggctcttggcactgtgcagaggacagtgaaatggactctggacatgtcagattgtcagagtgggtgttaaatgctgagcgtgtagtaatgactttggaagttttaatcaaacaggcgaaccttgatttgtgtcc

SEQ ID NO: 46268 - protein, 189 aa, Panicum virgatum
  misc_feature: Ceres CLONE 2029656
  misc_feature (2)..(120): Pfam Name: Metallophos Pfam Description: Calcineurin-like phosphoesterase
MVLVLALGDLHIPHRAPDLPAKFKSMLVPGKIQHIICTGNLCIKEVYDYLKSLCPDLHITRGEYDEDARYPETKTLTIGQFKLGLCHGHQVVPWGDLDSLAMLQRQLDVDILVTGHTHQFKAYKHEGGVVINPGSATGAYSSITYDVNPSFVLMDIDGLRVVVYVYELIDGEVKVDKIDFKKTATTIHA

SEQ ID NO: 46269 - DNA, 701 bp, Panicum virgatum
  misc_feature: Ceres CLONE 2029670
  misc_feature: Encodes the peptide sequence at SEQ ID NO. 46270
gaacatcttgtacacaaagatcgtatcttctttggctcatgcaaaaggtttacttgtggaagctgaattgggtagactctcaggctctgaagatggcttgacagttgaagaatacgaagcaagatttactgatgttgctcaggctgagggatttattgatgagacaagtattgatgctctagcagtttgcattggaaatgttcatggaaaatatccacctagtggaccaaacctcaaacttgacttgctaaaggaccttcgtgcgttaaccctaaagaaaggagttagcttggttctacatggagcatctggtctgcctcatgagcttgtacaggaatgcatagacttgggcgtcaggaaattcaatgtgaacactgaggtccgaaacagctacctggaatcccttaaaaagtcaggaaaggacctcatccaagtgatgtcatctgcaaaagaagcaatgaaagctgtcgtcgcagagaaattacatctctttggatcagctgggaaagcctgaacgtagcacaccccacacgaataatgggtgccggcagcacacagccttgtgggcatgacagtttcctcggtttgttgatcctgttgttcagccgcagtcttctagcgagttgcagttggagcctatgtaatctgaacttctgaatttgggacatttgctcaagtgtttcaggggaaattctgtcatt

SEQ ID NO: 46270 - protein, 170 aa, Panicum virgatum
  misc_feature: Ceres CLONE 2029670
  misc_feature (1)..(170): Pfam Name: F_bP_aldolase Pfam Description: Fructose-bisphosphate aldolase class-II
  misc_feature: SWISSPROT Homolog: EC 4.1.2.13 Fructose-bisphosphate aldolase
NILYTKIVSSLAHAKGLLVEAELGRLSGSEDGLTVEEYEARFTDVAQAEGFIDETSIDALAVCIGNVHGKYPPSGPNLKLDLLKDLRALTLKKGVSLVLHGASGLPHELVQECIDLGVRKFNVNTEVRNSYLESLKKSGKDLIQVMSSAKEAMKAVVAEKLHLFGSAGKA

SEQ ID NO: 46271 - DNA, 547 bp, Panicum virgatum
  misc_feature: Ceres CLONE 2029688
  misc_feature: Encodes the peptide sequence at SEQ ID NO. 46272
tgcacaagaaatggatatgcagttaaaccggttaagggtgacgccttgctgttcttcagtctccaccctgatgcaacaacagattctgacagcttgcacgggagctgccccgtcatcgaaggccagaagtggtccgccactaaatggatccatgtgaggtcgtttgatctccctgtcaagcaagcgggttcatctgatggatgcgaggatgacaatgccctctgcccccagtgggcggccgtgggtgagtgcgccaagaaccctaactatatggtggggaccaaggaagcacctgggttctgccggaagagctgcaaagtatgcgcagagtaagccattatgtagcatggcatggcatagcatgttatgtaagtggcagagtaatccactgtcttgtaagtggcatggcatgttatgttatgtagctattccaattccagggtgtagataggaccgagcatagcatgaacctgggacaagaaactgtaagagagctatcgataatcacctacacaggccaggaaatcaacagctagaacactttttt

SEQ ID NO: 46272 - protein, 110 aa, Panicum virgatum
  misc_feature: Ceres CLONE 2029688
  misc_feature (68)..(108): Pfam Name: ShK Pfam Description: ShK domain-like
  misc_feature (5)..(53): SWISSPROT Homolog: EC 1.14.11.2 Procollagen-proline dioxygenase
  misc_feature (59)..(109): SWISSPROT Homolog: EC 3.4.24.21 Astacin
CTRNGYAVKPVKGDALLFFSLHPDATTDSDSLHGSCPVIEGQKWSATKWIHVRSFDLPVKQAGSSDGCEDDNALCPQWAAVGECAKNPNYMVGTKEAPGFCRKSCKVCAE

SEQ ID NO: 46273 - DNA, 639 bp, Panicum virgatum
  misc_feature: Ceres CLONE 2029695
  misc_feature: Encodes the peptide sequence at SEQ ID NO. 46274
gaactcccttgtcgtcgacactcattcttttcgccaaaccgcaatcatgaccaaagtaaactccggtttggcctcctccaggcgcaagtcccgcaagttgcactacagcgctccctcttcaacccgacgagttatcttgagcgctcccctgagcaaggaactaagagaaaagcacaatgttcgcagcatccccatccgaaaagacgacgaagtcacgatcgtccgaggttccaacaaaggccgtgaaggcaaagtcacatcggtctaccgattgaagttcctcgtccacatcgagcgagtctcccgcgagaagtccaacggccaatccgtccccatcggcatccacccaagcaaagtcatcgtcacaaagctcaagctcgacaaggatcgagaaaagatcttggagagagtcggaaagggtcgtgaagctgtcaagtccaagtcgcagtagatgatgtttacgttggggaagggtgtgagcaaaaggctaaggttattatgacttgaagcatttccaatgggtttttccacgaggggtttttcatcggaaagatcgcatcatcacatggtttgtagaagcagcgtctcaaatacccgacgtgggcatctcaatcttgcctgaatgaaaaagaaacattc

SEQ ID NO: 46274 - protein, 134 aa, Panicum virgatum
  misc_feature: Ceres CLONE 2029695
  misc_feature (52)..(83): Pfam Name: KOW Pfam Description: KOW motif
  misc_feature: Functional homolog of the protein sequence given in SEQ ID NO 51460
  misc_feature: Useful for making plants with modulated biomass
MTKVNSGLASSRRKSRKLHYSAPSSTRRVILSAPLSKELREKHNVRSIPIRKDDEVTIVRGSNKGREGKVTSVYRLKFLVHIERVSREKSNGQSVPIGIHPSKVIVTKLKLDKDREKILERVGKGREAVKSKSQ

SEQ ID NO: 46275 - DNA, 661 bp, Panicum virgatum
  misc_feature: Ceres CLONE 2029708
  misc_feature: Encodes the peptide sequence at SEQ ID NO. 46276
aaagaagcacgcgcagcatccgttccttgccgctgccgctgcactctcccatagtccctagcagaacccccaccccgcgcaaaagcagagcaaccactttcccctcccgccccccatctccgtcctcctccatggcgagatcgacgcgcggcgcgctcctcctcctcctcgcgctcctggcgctggcggcggcggcccgcgcgggcgacgtgccggcggcgctgggctgggagctcggggtggtgggcgccgcggaggacgaggagttcggcttccccgccggcggcgactccgtggcgcgccgggtgctgcagggcgggcccgggtacatcagctacggcgcgctgcggagggacaacgtgccgtgctccgtgcggggggcctcctactacaactgccgccccggcgcgcaggccaacccctactcgcgcggctgctccgccatcgcccgctgccgcggctgatccgcccgcccgcccgcccgcttcagcgcaggcggccggcgaccgccgggaggacgaggaggaggttcaattcatcccgttagtctctcgccgttcagaaaaagagagagaagaaactgttcatctgccctttttaatcaattattgttgttagagtgtctctaataacttttccaaaatctacattctaaattatt

SEQ ID NO: 46276 - protein, 110 aa, Panicum virgatum; identical to SEQ ID NO: 15978
  misc_feature: Ceres CLONE 2029708
  misc_feature (44)..(110): Pfam Name: RALF Pfam Description: Rapid ALkalinization Factor (RALF)

SEQ ID NO: 46277 - DNA, 480 bp, Panicum virgatum
  misc_feature: Ceres CLONE 2029711
  misc_feature: Encodes the peptide sequence at SEQ ID NO. 46278
ggcggctacatatacccctttctttgtctcagcaagcaaggcttagggtttggtggttggacgcagaagcttgtagtagatccttcgttagggagtcgccatgagccggtcggggcaacctccggatctgaagaagtacatggacaagaagctccaaatcaagctgaatgcaaaccgtgtagtcattggcacgctgcgtggatttgatcagttcatgaatctggtcgtggacaacacagtggaggtcaatggaaacgacaagaatgacatcggaatggtggttatcagggggaacagtgttgtcatgatcgaagccctcgaaccggttgccaaagctcagtgaactgtcagcctgctttggtagtgttaatttaaaactgatgtatgccgttgggcaccattgtatcctaggttcctaacccttattcatgtgcaagtgttaagcacttttgtatagttgagcctgtgtttcgactttcc

SEQ ID NO: 46278 - protein, 80 aa, Panicum virgatum
  misc_feature: Ceres CLONE 2029711
  misc_feature (8)..(72): Pfam Name: LSM Pfam Description: LSM domain
MSRSGQPPDLKKYMDKKLQIKLNANRVVIGTLRGFDQFMNLVVDNTVEVNGNDKNDIGMVVIRGNSVVMIEALEPVAKAQ

SEQ ID NO: 46279 - DNA, 826 bp, Panicum virgatum
  misc_feature: Ceres CLONE 2029726
  misc_feature: Encodes the peptide sequence at SEQ ID NO. 46280
aactaacgctaaaaaagtaacagtttctgtactttattgctttcattcaacatgtcgaagcacgacgccgtcctgaagaaggcgaccgagctcgaggcgaagctgaagggcaacctgttcctcggcggcagcgtgccgacggcggaggacgtgaaggccttcaacgacctgctcggcgacaagcagacgaacgtgtaccgctgggtgaagcacatggcgtccttcacggaggccgagcgcagcgcgtggggcgcgccgggcaagaagctggcggtcgctgaggccaagaaggaggaggccaagccggccgcgaagcccgccgaggcggcgaagcccgctgcggccgcgccggccgcgaaggcggccccggcgccgaaggccgacgacgacgacatcgacctgttcggtgaggagaccgaggaggagaaggcggcggcggaggcgaagaagaaggcggacgccgagaagaaggcgtcggcgaagaaggcggcgccgatcgccaagtcgtcgatcctgctggacgtgaagacatgggaggacaccgttgacctggaggagctcgcgaagaagatcaagtccaacgagcgcgacggcctcctgtggggcgcgcacaagcaggcgccggttgccttcggcgtgaagaagctgcagctgctgatggtgatcgaggacgacaaggtgtcgagcgaggacatcgaggagatcatcatgcagtacgaggaggaggtccagtccatggacgtcgtcgcctggaacaaggtgtaaggctttccgcaccactcttggcacccgccgcggctcttcgacgctaagttcagtaaactcg

SEQ ID NO: 46280 - protein, 237 aa, Panicum virgatum
  misc_feature: Ceres CLONE 2029726
  misc_feature (151)..(237): Pfam Name: EF1_GNE Pfam Description: EF-1 guanine nucleotide exchange domain
MSKHDAVLKKATELEAKLKGNLFLGGSVPTAEDVKAFNDLLGDKQTNVYRWVKHMASFTEAERSAWGAPGKKLAVAEAKKEEAKPAAKPAEAAKPAAAAPAAKAAPAPKADDDDIDLFGEETEEEKAAAEAKKKADAEKKASAKKAAPIAKSSILLDVKTWEDTVDLEELAKKIKSNERDGLLWGAHKQAPVAFGVKKLQLLMVIEDDKVSSEDIEEIIMQYEEEVQSMDVVAWNKV

SEQ ID NO: 46281 - DNA, 725 bp, Panicum virgatum
  misc_feature: Ceres CLONE 2029739
  misc_feature: Encodes the peptide sequence at SEQ ID NO. 46282
gcccataaccaccagaccaaccgagaccaggcaggcatccaccgcaaccaacagcagcagagctcgagcaggccagaaggaagcaggagggaggacgatgagcacggcaaggttcatcaagtgcgtgacggtcggcgacggcgccgtcggcaagacctgcatgctcatctcctacaccagcaacaccttccccacggattatgtgcccacggtgttcgacaacttcagcgccaacgtcgtcgtcgacggcaacacggtgaacctcggcctctgggataccgccggacaagaggactacaacaggctgaggcctcttagctacagaggggctgatgtttttctattagcattttccctcatcagcagagcgagctacgagaatattcacaagaagtggataccagaactaaggcattatgctccaaatgtgccgattgtgttagttggaacgaagcttgacttgcgtgaggacaagcagttcttcttggaccaccctggtttagctcctatcactactgcacagggtgaggagctgaaaaggatgataggcgcagctgcgtacatagaatgcagctccaagacgcaacagaatgtgaaggccgtatttgactcagcgataaaggtcgtgctgtgcccgcccaaaccaaagaagaagagcgccccggagcagaggagttgctggatcctatgagctggcagtgtacaacatggagttgctcttgcat

SEQ ID NO: 46282 - protein, 197 aa, Panicum virgatum
  misc_feature: Ceres CLONE 2029739
  misc_feature (8)..(179): Pfam Name: Ras Pfam Description: Ras family
  misc_feature (8)..(121): Pfam Name: Miro Pfam Description: Miro-like protein
  misc_feature: Functional homolog of the protein sequence given in SEQ ID NO 50617
  misc_feature: Useful for making plants with modulated nitrogen use efficiency
MSTARFIKCVTVGDGAVGKTCMLISYTSNTFPTDYVPTVFDNFSANVVVDGNTVNLGLWDTAGQEDYNRLRPLSYRGADVFLLAFSLISRASYENIHKKWIPELRHYAPNVPIVLVGTKLDLREDKQFFLDHPGLAPITTAQGEELKRMIGAAAYIECSSKTQQNVKAVFDSAIKVVLCPPKPKKKSAPEQRSCWIL

SEQ ID NO: 46283 - DNA, 662 bp, Panicum virgatum
  misc_feature: Ceres CLONE 2029740
  misc_feature: Encodes the peptide sequence at SEQ ID NO. 46284
aaaaaaaaagaacggtgtgcttgtttcaagatggagatcgaggctgctgaagtgaagcttttcaacaaatgggaccctaaggagtgtgtcctctccgacattaccttggccgactacctggctgttaagcaacaggccaagtttattcagtatcttcctcacactgctggtcgctggtccgccaagcgtttccgcaaggcccagtgccccctcgtcgagcgcctcgtctgctcgctgatgatgcacggtcgcaacaacggtaagaagctcaaggccgtccgtattgtgcagcagtccttcgaaatcattcaccttttgactggtcagaaccccatccaggttttggttgatgccgtctccaacgctggtcctcgcgaagatgccacccgcgtcggctctgccggtaccgtccgtcgtcaggccgtcgatgtttcgccttaccgtcgtgtgtctcaggctctgtacttgctcacccaaggtgctcgcgccgctgctttccgtaacacaaagactatgtccgagtgcctcgctgatgagctgatcaacgctgccaagcccgatggtggttcgtccgcctcgcacgccatccgtaagaaggatgaaatcgagcgtctcgccaagagcaaccgttaaattgcctgtcaatatctccaaactaaagc

SEQ ID NO: 46284 - protein, 200 aa, Panicum virgatum
  misc_feature: Ceres CLONE 2029740
  misc_feature (42)..(200): Pfam Name: Ribosomal_S7 Pfam Description: Ribosomal protein S7p/S5e
  misc_feature: Functional homolog of the protein sequence given in SEQ ID NO 51435
  misc_feature: Useful for making plants with modulated biomass
  misc_feature: Useful for making plants with modulated flowering time
MEIEAAEVKLFNKWDPKECVLSDITLADYLAVKQQAKFIQYLPHTAGRWSAKRFRKAQCPLVERLVCSLMMHGRNNGKKLKAVRIVQQSFEIIHLLTGQNPIQVLVDAVSNAGPREDATRVGSAGTVRRQAVDVSPYRRVSQALYLLTQGARAAAFRNTKTMSECLADELINAAKPDGGSSASHAIRKKDEIERLAKSNR

SEQ ID NO: 46285 - DNA, 710 bp, Panicum virgatum
  misc_feature: Ceres CLONE 2029743
  misc_feature: Encodes the peptide sequence at SEQ ID NO. 46286
aagaaacactccaagcaaacgatcagaagctaaccaaatcactcgatcctcacccaagaatcctcgattactcagaaacaccacttcagaaaacccaccgaccatgtcgctgatccgccgcagcaacgtgttcgaccccttctccctcgacctctgggacccctttgagggcttccccttcgccggcgcgcggatcgactggaaggagacccccgaggcgcacgtgttcaaggcggacgtcccggggctgaagaaggaggaggtgaaggtggaggtcgaggacggcaacgtcctccagatcagtggcgagcgcaacaaggagcaggaggagaagacggacacctggcaccgcgtcgagcgcagcagcggcaggttcatgcgcaggttccggctgccggagaacgccaagacagagcagatcagggcgtccatggagaacggcgtgctcaccgtcaccgtgcccaaggacgaagtcaagaagcccgaggtgaagtccatccagatctccggctagacatcatcgtgcctgcgtgatgaagcatgctgctgacctctggagtccgcctgggtcgtgctgctgacgaaataaaaatcgggttcgacgttgtggtctcgtgtagtgtcagtccgcgtgatgggcatgtcgtccctgcgtctggcatggcatggtttgagtccagtttgcgctcattagtgtgtctgtatttagt

SEQ ID NO: 46286 - protein, 136 aa, Panicum virgatum
  misc_feature: Ceres CLONE 2029743
  misc_feature (32)..(135): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFEGFPFAGARIDWKETPEAHVFKADVPGLKKEEVKVEVEDGNVLQISGERNKEQEEKTDTWHRVERSSGRFMRRFRLPENAKTEQIRASMENGVLTVTVPKDEVKKPEVKSIQISG

SEQ ID NO: 46287 - DNA, 581 bp, Panicum virgatum
  misc_feature: Ceres CLONE 2029756
  misc_feature: Encodes the peptide sequence at SEQ ID NO. 46288
attagattctgcttacatcttacatcataatatcatatcataaccttcaaaatctgtgtgtgtgacaaataaacttaaagagagattcataactcaattttatttttcatttagtttgatcaaatggcaacctctatgatgacaactttgcctcaattcactggtcttaaaccacaactcaaaccttctcctatccagggtttggttgctgcccaacctatgacaaggcgcaagggcaagggtgctttgggagttcgttgtgacttcattggttcatccactaatgtgattatggtggcatctacaaccctaatgttgtttgctggaagatttggattggctccctcagcaaacaggaaagcaacagcaggactaaagctggagacaagggactcaggcttgcagactggtgacccagctgggttcacccttgctgatactttggcctgtgggactgttggacacatcattggtgttggtgttgttcttggtcttaagaacattggtgcattgtaaaaaggaaactatgttgtgaacttgtgttgtatctgtaataagttttaatgtcattttatttttgc

SEQ ID NO: 46288 - protein, 126 aa, Panicum virgatum
  misc_feature: Ceres CLONE 2029756
  misc_feature (46)..(126): Pfam Name: PSI_PSAK Pfam Description: Photosystem I psaG / psaK
MMTTLPQFTGLKPQLKPSPIQGLVAAQPMTRRKGKGALGVRCDFIGSSTNVIMVASTTLMLFAGRFGLAPSANRKATAGLKLETRDSGLQTGDPAGFTLADTLACGTVGHIIGVGVVLGLKNIGAL

SEQ ID NO: 46289 - DNA, 637 bp, Panicum virgatum
  misc_feature: Ceres CLONE 2029770
  misc_feature: Encodes the peptide sequence at SEQ ID NO. 46290
acacgcgcttcgttcctcctcgtccctcggctcggcctcgcctcctctccgtctccctgcagaaagagcgcagcaaggcaagaggggggataggaggaggaagagagcaggagatggcaggctgcgagggagccaagtcaccggcctcccaggaggaagaggcatgtgttgagaagaagtacggaggaattgcgcccaagaagcctttgatatccaaggaccacgagcgcgcgtacttcgattcagcagactgggtgctcggcaagcaagctgcaaatagcagcacaagggctgctgtcgagtctctgaagcccaagctgaagagaacgcctcaccaccagctcccccctcgcaagccgacctgcgcttccagctgagacgcacggtgagctggctgccctccaatccaaaaagcctgcagcacttagctcgtagtgttcgtgcagtgcagcagctggagggagtgctcggaggcaagaaagggagaatgaatgattgagctcggataaatgcttggcagccgaaatcgtagggatggatcacaagcccgaggtgcaatctggctagtacttgtcaattgcagcctctactatgtctatcatcagaacggattaattatcggcatcatacttaagtt

SEQ ID NO: 46290 - protein, 87 aa, Panicum virgatum; identical to SEQ ID NO: 18681
  misc_feature: Ceres CLONE 2029770
  misc_feature (20)..(87): Pfam Name: Lg106 Pfam Description: Lg106-like protein
  misc_feature: Functional homolog of the protein sequence given in SEQ ID NO 50181
  misc_feature: Useful for biocontainment applications

SEQ ID NO: 46291 - DNA, 676 bp, Panicum virgatum
  misc_feature: Ceres CLONE 2029783
  misc_feature: Encodes the peptide sequence at SEQ ID NO. 46292
ggcaccgtggtgcaggacggcgcatacgggtaccagaacctcttcgacaccacggtcgacgccttctataccgccatgggtaggcacggcggctccggcgtgaagctcgtcgtgtcggagagcggatggccgtccggcggcggcgtgcaggcgaacgcggcgaacgccagggtctacaaccagtacctgatcaaccacgtcggtaggggcacgccgcgacacccgggcgccattgagacctacctcttctccatgttcaacgagaaccagaaggagagcggcgtcgagcagaactgggggctcttctacccaaacatgcagcacgtctaccccatcagcttctaaacgagaggctgtatacgccttggttcgtccatacgtatatgcaagtgatgcgtctgtaagtacgtacgtatacgccgctgcataagtatacgtacatgtagattacgtattgtactattggggcttgcttcgcgaccgctgggagtgtcaaatgatgctctcagatgcgtacgccgtgagggtattgtgtttctacgttgtatacgccgaagggagacgaacgtactgtaggttaatacggtacatcgtcaattgatcgcccttcctaggtatagtagtatatagaggttggtgatggataagatacagatgtacgtagtcacgtgcctag

SEQ ID NO: 46292 - protein, 114 aa, Panicum virgatum
  misc_feature: Ceres CLONE 2029783
  misc_feature (1)..(114): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
  misc_feature: Functional homolog of the protein sequence given in SEQ ID NO 50980
  misc_feature: Useful for making plants with altered carbohydrate content
  misc_feature: Functional homolog of the protein sequence given in SEQ ID NO 51395
  misc_feature: Useful for making plants with altered cell wall content and/or composition
GTVVQDGAYGYQNLFDTTVDAFYTAMGRHGGSGVKLVVSESGWPSGGGVQANAANARVYNQYLINHVGRGTPRHPGAIETYLFSMFNENQKESGVEQNWGLFYPNMQHVYPISF

SEQ ID NO: 46293 - DNA, 571 bp, Panicum virgatum
  misc_feature: Ceres CLONE 2029787
  misc_feature: Encodes the peptide sequence at SEQ ID NO. 46294
gtgctctctcagaggtgggttggcttctcctccccctccggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatctccgtcaacgaggcccagtcccgcggcggcccgcgctccggcggcggcggcggctacgggcgccgcgagggcggcggtggctacggcggcggcggcggcggctacggtcgccgcgagggcggtggcggctacggcggcggtggcggcggctacggtggccgtggaggcttcggtggcggcggcggctacggtggcgaccgcggcggcggctacggcaactccgatgggaactggaggag

SEQ ID NO: 46294 - protein, 158 aa, Panicum virgatum
  misc_feature: Ceres CLONE 2029787
  misc_feature (10)..(81): Pfam Name: RRM_1 Pfam Description: RNA recognition motif. (a.k.a. RRM, RBD, or RNP domain)
  misc_feature (48)..(154): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
MEASDVEYRCFVGGLAWATDDNSLHNAFSPYGEVLESKIILDRETQRSRGFGFVTFSSEQAMRDAIEGMNGKELDGRSISVNEAQSRGGPRSGGGGGYGRREGGGGYGGGGGGYGRREGGGGYGGGGGGYGGRGGFGGGGGYGGDRGGGYGNSDGNWR

SEQ ID NO: 46295 - DNA, 703 bp, Panicum virgatum
  misc_feature: Ceres CLONE 2029804
  misc_feature: Encodes the peptide sequence at SEQ ID NO. 46296
ggccgccccgtctccgagtccctcatcatcctcaactacctcgacgaggccttccggccggacccggcggtctcctcctcccgcaacaagctcctcctcccctccgacccctacgcgcgcgcgcaggcccgcttctgggccgcctactccgacaaggtctacgagctcggcacgcggctctggaagctcaagggcgaggcgcgggcgcaggcgcgcgccgagctcctgcaggtgctcacccacctcgacggccagctcggggacagggagttcttcggcggcgaggagttcgggttcgtggacgtcgcaatcgtgcccttcgtgccgtggctgcccagctacgagaggtacggggagttcagcgtggaggaggccgcgccgaggctggtagcgtgggcacggcggtgcgcggggagggagagcgtcgccgggagcctccacccgccggagaaggtggacgagttcatcaccatgctcaagaagcactacggcatcgagtagtagggggtggatgctgctgcgggtgggtgagacgacgagtggctgccatgcgcgcatcagctgtttttgtttgctcccgtccagtgaatggatcaactgttccgtgtgtggttgtctgatgcgtgcgacgtggctgcaaataattaaagctgctctactagtattgtttggtcggtgtgatcacaactgttggtatgggttg

SEQ ID NO: 46296 - protein, 166 aa, Panicum virgatum
  misc_feature: Ceres CLONE 2029804
  misc_feature (45)..(140): Pfam Name: GST_C Pfam Description: Glutathione S-transferase, C-terminal domain
  misc_feature: SWISSPROT Homolog: EC 4.4.1.5 Lactoylglutathione lyase
GRPVSESLIILNYLDEAFRPDPAVSSSRNKLLLPSDPYARAQARFWAAYSDKVYELGTRLWKLKGEARAQARAELLQVLTHLDGQLGDREFFGGEEFGFVDVAIVPFVPWLPSYERYGEFSVEEAAPRLVAWARRCAGRESVAGSLHPPEKVDEFITMLKKHYGIE

SEQ ID NO: 46297 - DNA, 578 bp, Panicum virgatum
  misc_feature: Ceres CLONE 2029819
  misc_feature: Encodes the peptide sequence at SEQ ID NO. 46298
cttttcccttttccttgcgcacgcgctcgtccccggaggcctcgaacagcaccgccggcgaccaccggaagagagggaaacgacgacggcgatggcgctcaacggggtacgggccagcctccgcttcctcgtctccagcgccgagggcgccgccgcccccgcttctcctggatttcattccactggagtgaggcggatgggcgcgcacgcacatgatgagccatactacgtccatgccaagcacatgtacaacctgcacaggatgaagcaccagcagcttaaggtttccctcgccgtgctggctgccgtgggcactggtgttggagtccctgtgtacgcagttgttttccagcagaagaagactgcctctgcatagtttgaaataccagagacagcacagcttaaaatacccgtccatgagatttattttcccattctctcttcacacaggtttaccctttgcttattggattttgacgtaggaacagctgtcccttttaataatactgtggcctgaactttttgccaagatgtgggaatgacagaagccatattgtaatacaattctaatttttctt

SEQ ID NO: 46298 - protein, 94 aa, Panicum virgatum
  misc_feature: Ceres CLONE 2029819
  misc_feature: Functional homolog of the protein sequence given in SEQ ID NO 50154
  misc_feature: Useful for making plants with modulated nitrogen use efficiency
MALNGVRASLRFLVSSAEGAAAPASPGFHSTGVRRMGAHAHDEPYYVHAKHMYNLHRMKHQQLKVSLAVLAAVGTGVGVPVYAVVFQQKKTASA

SEQ ID NO: 46299 - DNA, 655 bp, Panicum virgatum
  misc_feature: Ceres CLONE 2029825
  misc_feature: Encodes the peptide sequence at SEQ ID NO. 46300
aacaaacgctaaaaaagtaacagtttctgtactttattgggatctagcatgcgccagagcctcaagtacgccgtcattggcaaggaaggcaagcagcgccgctcccttgagaacaagaagcgcttcgaggcccgcgccgcgaaggacaacaagcgctggaagcgcgtcctcgccaagatgagccccgagcgcaaggtggcgtacaccggcgtgggcaacctggccggcaagaaccgcacccgcggtgtgacgcgccgctcgctcacggagcgcaagggccgcaaggcggactcgactgccgtggagtgcaccatccacctggccaagctcatcaagggccgcaagttcgccaagcgcgcgccgatggcgatcacgaagatccgcaacttcgcccagaagctgatgaagacgaaggacaaccgcatcgacggcagcctgaacaccttcgtgtggcaccagggcgtgaagggcgtcccgacccgcatccgcgtcaagatcgagcgccacgtcgccgagagcactgacggcgcgagcaagcgcaagcgtctctacacggtcatctcgcacgtgcccgtgccgacgttcaagggcctgctaacgaagaccgtgaccgcctgagcgtagcatcccaaaaacagcacgacctccctcattg

SEQ ID NO: 46300 - protein, 189 aa, Panicum virgatum
  misc_feature: Ceres CLONE 2029825
  misc_feature (78)..(175): Pfam Name: Ribosomal_L31e Pfam Description: Ribosomal protein L31e
MRQSLKYAVIGKEGKQRRSLENKKRFEARAAKDNKRWKRVLAKMSPERKVAYTGVGNLAGKNRTRGVTRRSLTERKGRKADSTAVECTIHLAKLIKGRKFAKRAPMAITKIRNFAQKLMKTKDNRIDGSLNTFVWHQGVKGVPTRIRVKIERHVAESTDGASKRKRLYTVISHVPVPTFKGLLTKTVTA

SEQ ID NO: 46301 - DNA, 466 bp, Panicum virgatum
  misc_feature: Ceres CLONE 2029868
  misc_feature: Encodes the peptide sequence at SEQ ID NO. 46302
agttgaaacaactttatccttacctggaaggctaagtggttctttggaatggagaaaagcaagaaggtaaccaattcccaagagggaacagactaagctcaggttcagtccttgcaagcagggaacagctcccgatcggaattgcaacagcagcatttgatggtattcattcatcaaaatgggaagagcctgatggagctaaaggttgttggctgatttataaaatgcccgatggccaaacttgtgagttggactcatatgatttgatgtcagctaatgatgctccagagagggatccaatgcactgggttcttgaagcgagcacggatggaggctccacctggaatgcaattgacactcgcagttctgaaatatttgagacccgtttcttccggaaaacatttacagtggacaagagatgtaaagcaaatgctttccgtatattttaaaatttcaattttttttt

SEQ ID NO: 46302 - protein, 74 aa, Panicum virgatum
  misc_feature: Ceres CLONE 2029868
  misc_feature: SWISSPROT Homolog: EC 3.5.1.52 Peptide-N(4)-(N-acetyl-beta-glucosaminyl)asparagine amidase
MPDGQTCELDSYDLMSANDAPERDPMHWVLEASTDGGSTWNAIDTRSSEIFETRFFRKTFTVDKRCKANAFRIF

SEQ ID NO: 46303 - DNA, 664 bp, Panicum virgatum
  misc_feature: Ceres CLONE 2029871
  misc_feature: Encodes the peptide sequence at SEQ ID NO. 46304
gtgctctctcagaggtgggttggcttctcctccccctcttaccaagtcctcggctctagggttttagtgggaagggagatggcggcggcggatgtggagtaccgctgcttcgtcggcggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggtcgtcagggtggctacggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgttcgtgtcactgtttgatccgagttacccctgagttttgttcgtgtgttaccgttcgattaggtgttggttcccatttttaccgttcccc

SEQ ID NO: 46304 - protein, 147 aa, Panicum virgatum
  misc_feature: Ceres CLONE 2029871
  misc_feature (10)..(81): Pfam Name: RRM_1 Pfam Description: RNA recognition motif. (a.k.a. RRM, RBD, or RNP domain)
  misc_feature (48)..(139): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MAAADVEYRCFVGGLAWATDNASLQQAFASYGDVLDSKVITDRETGRSRGFGFVTFSSEQSMLDAIEAMNGKDLDGRNITVNQAQSRGGGGRQGGYGGGGGYGGGGGYGGGRREGGYGGGGGGGRREGGYGDGGYGSRGDSGGNWRN

SEQ ID NO: 46305 - DNA, 663 bp, Panicum virgatum
  misc_feature: Ceres CLONE 2029876
  misc_feature: Encodes the peptide sequence at SEQ ID NO. 46306
acccccagtctctgcgccgccgccgttcccgtcgtcctccgccagtccgccctcctccgccgtcgcggtcgcgccctcgccgtcgcctgccgaccgcgagcttcctcgccaccaccggtccaccgggggcggcgccatgtcccagtcccagaacaacaacccctcccagctcctcccctcagagctgatcgaccggtgcatcgggtccaagatctgggtgatcatgaagggggacaaggagctcgtcggcaccctctgcggcttcgatgtctacgtcaacatggtgctggaggacgtcaccgagtatgaatacacagctgaagggcgtcgcattacaaaacttgaccagatactgctgaacggcaacaacatagccatcttggttcctggtggttcaccacccgatgtgtaacgagcttgtgcttccagagtaacgatttgaggcgaaggcagcttggtgaactctgcaccttgtgttggtcagaagcatcgatgttttctcagctcaaatgtgtttctcctgttcgtgattgtaccgaagtttattagcaagtctgtcaacatggaagctctctcctgtaatgaacttactgatctcagtagaggacttgcgcatgcttatacgattggctatgctaattccgatgctcatcatcgtcgtgc

SEQ ID NO: 46306 - protein, 91 aa, Panicum virgatum; identical to SEQ ID NO: 14215
  misc_feature: Ceres CLONE 2029876
  misc_feature (16)..(84): Pfam Name: LSM Pfam Description: LSM domain
  misc_feature: Functional homolog of the protein sequence given in SEQ ID NO 50544
  misc_feature: Useful for making plants with modulated cold sensitivity
  misc_feature: Useful for making plants with modulated drought sensitivity

SEQ ID NO: 46307 - DNA, 525 bp, Panicum virgatum
  misc_feature: Ceres CLONE 2029883
  misc_feature: Encodes the peptide sequence at SEQ ID NO. 46308
gcttctgcctcctctctccacacgacttgctcccgccgccgccgccgtcgcagcagtcaccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggttgcgccagttgttggccattcctgttttaaacaagttaaatgatgaattgaatccccccttgcctagtgtactgctttcgtatcaagttattgaacaatgctactttgtcctttgagtaggctatggagaatgggcttaagcaatggaattgtaatttgagtactcgtcttgttgcaagttttggtctgttattgcctgaatgaatttaagtgcacttgatgatgtgtgac

SEQ ID NO: 46308 - protein, 65 aa, Panicum virgatum; identical to SEQ ID NO: 9766
  misc_feature: Ceres CLONE 2029883
  misc_feature (1)..(65): Pfam Name: Ribosomal_S28e Pfam Description: Ribosomal protein S28e

SEQ ID NO: 46309 - DNA, 716 bp, Panicum virgatum
  misc_feature: Ceres CLONE 2029886
  misc_feature: Encodes the peptide sequence at SEQ ID NO. 46310
gggcccacggagcaccaccaccgcgagagagcaccaagattcagaggccagcaggctccgacctcccccgggattcctccgaggcgcgggcggcggcggtcggcgacatggcggccgcggtgcccagccgtgtcgcgctctcggcggcgagccgcttccccaatcgccacgcggtggcaggggatagatcatgcatttacaagggaaggtgccaaagtcttgcaatcgctatggctctgtcagcagctgcaccaggcaaaggtggtgtgcttgatcggccggtagagaaaactactcctggtcgtcagtctgaatttgatgtgaagaaaaagcgcaagatgacgcccccataccgtgtcatcctgcacaacgacaaccacaacaggcgcgagtatgttgtccaggtcctgatgaaagtgatcccggggatgactgtggacaatgcggtgaacatcatgcaggaggcgcacgtgaatgggctctcggtggtgatcgtctgctcccagtccgaggccgaggagcactgcacgtcgctcaggggcaacggcctgcggagctcgattgagcccgccagcggtggctgctgagaatgggtgctgatgtttcgccccgtatattttgtaaataccctgaatcacaagataagctggaatgggtgcagcgagacggagtaccgcttgggtaggtgtaaatcttgtaagggtgccctgtagaag

SEQ ID NO: 46310 - protein, 159 aa, Panicum virgatum
  misc_feature: Ceres CLONE 2029886
  misc_feature (76)..(152): Pfam Name: ClpS Pfam Description: ATP-dependent Clp protease adaptor protein ClpS
MAAAVPSRVALSAASRFPNRHAVAGDRSCIYKGRCQSLAIAMALSAAAPGKGGVLDRPVEKTTPGRQSEFDVKKKRKMTPPYRVILHNDNHNRREYVVQVLMKVIPGMTVDNAVNIMQEAHVNGLSVVIVCSQSEAEEHCTSLRGNGLRSSIEPASGGC

SEQ ID NO: 46311 - DNA, 603 bp, Panicum virgatum
  misc_feature: Ceres CLONE 2029889
  misc_feature: Encodes the peptide sequence at SEQ ID NO. 46312
aaaaattttaaataaaaaattaattctcacaagatcctctagccatggtcgacgctgaacacatccaagagctcgctcaagaactcgatttggactccgctgtcaagagagtcttgaaggctgcctcatatagagatagcctcgccaagggcctccacgaagtctgcaaggccatcgataacgccaagaagccagttctctgcttgttggccgataactgtgacgaaccccaatataaaaagttggttgaagctctctgcaaggagaacgacgtcgcccttatccgtgttcccgatggtaagcaaatcggagaatggatcggtctctgcaaatacgatgctatgatgaaccccagaaaggtcagaagatgcagcagcgttgtcctcagagaattcgccgtcgatgatgaagctgccactttggtcagagaagctatccaaaagaataaggaaatccaattgtcttaaatgaagttccaataacaacccacgtcaccacacaagagagaaaaacaaaaaattaaaaaagctatgttttgatttgtaatttttaccttgtttactgcgacagcgaagcaacattcatagccctggtatgtgcacg

SEQ ID NO: 46312 - protein, 140 aa, Panicum virgatum
  misc_feature: Ceres CLONE 2029889
  misc_feature (18)..(114): Pfam Name: Ribosomal_L7Ae Pfam Description: Ribosomal protein L7Ae/L30e/S12e/Gadd45 family
MVDAEHIQELAQELDLDSAVKRVLKAASYRDSLAKGLHEVCKAIDNAKKPVLCLLADNCDEPQYKKLVEALCKENDVALIRVPDGKQIGEWIGLCKYDAMMNPRKVRRCSSVVLREFAVDDEAATLVREAIQKNKEIQLS

SEQ ID NO: 46313 - DNA, 474 bp, Panicum virgatum
  misc_feature: Ceres CLONE 2029922
  misc_feature: Encodes the peptide sequence at SEQ ID NO. 46314
cttccattttagcaacacgagtcttagtcaccgctgagaattccactagaatgtcctacgtcgctaagaatactaacgaaaagcctggtcttgaagaacaagaacaacccaagatccaccgtatccgtatcaccttgacttctcgcaatgtcaagaacttggaaaaggtttctgctgatcttgttcaacgtgccaaggataagcaactcaaggtcagaggtcccgtccgtcttcccaccaagactcttcgtatcactactcgtaagtctccttgtggtaacggttccgaaacctttgataaattcgaaatgaagatctacaagcgtttgatcgacttgcactctccttccgaaattgtcaagcaaatcacttccatctccattgaacccggagttgaagttgaagttactattgcttaaataaagttgtctaggccgtctttgatcttttaaaaagattagaccaggcttttat

SEQ ID NO: 46314 - protein, 122 aa, Panicum virgatum
  misc_feature: Ceres CLONE 2029922
  misc_feature (24)..(119): Pfam Name: Ribosomal_S10 Pfam Description: Ribosomal protein S10p/S20e
  misc_feature: Functional homolog of the protein sequence given in SEQ ID NO 50533
  misc_feature: Useful for making plants with modulated phosphate use efficiency
  misc_feature: Functional homolog of the protein sequence given in SEQ ID NO 50532
  misc_feature: Useful for making plants with modulated biomass
  misc_feature: Useful for making plants with modulated flowering time
MSYVAKNTNEKPGLEEQEQPKIHRIRITLTSRNVKNLEKVSADLVQRAKDKQLKVRGPVRLPTKTLRITTRKSPCGNGSETFDKFEMKIYKRLIDLHSPSEIVKQITSISIEPGVEVEVTIA

SEQ ID NO: 46315 - DNA, 697 bp, Panicum virgatum
  misc_feature: Ceres CLONE 2029941
  misc_feature: Encodes the peptide sequence at SEQ ID NO. 46316
accaaattaccagcctcctgtaacgtttgtggtggttcaaaaacgtcatcatacaagactatttgcaaacaatcacaaagatagaagcagcatggacaagagtggaaatattttgcctggaacagtcgttgattctaagatatgccatccaacggagtttgatttctacctctgtagtcatgctggaattcagggaacaagtaggcctgctcactaccacgtcctctgggatgagaacaatttcacagcagacgaaatgcagacattgacaaacaacctttgctacacttacgcccggtgcacacgctcggtttctgttgtcccgcctgcatactatgcccacctggccgcattccgggctcggttctacatggaaccggagatgtcagagaaccagacatcaaagagctccaacggcaccaatggagcatcggtgaagcccctgcccgccctaaaggagaaggtgaagagggtgatgttctactgctgacaaggaaaccacttaaccactcacatgctgtagctaacttggtagagtttagtagtgattagattagctttctccaggaatggacgagaagagcatttggatcctgaacaaccaatctgttgactgcctatgtaaagtactctgaagcgcctgtataatagttcttggaccagatggcatccaatctgataaagtacactaggaatc

SEQ ID NO: 46316 - protein, 162 aa, Panicum virgatum
  misc_feature: Ceres CLONE 2029941
  misc_feature (1)..(125): Pfam Name: Piwi Pfam Description: Piwi domain
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 2086 in the 10/374,780 US patent application
  misc_feature: The sequence is a functional homolog of SEQ ID NO 102 in the 10/286,264 US patent application
  misc_feature: The sequence is a functional homolog of SEQ ID NO 1579 in the 11/479,226 US patent application
  misc_feature: The sequence is a functional homolog of SEQ ID NO 2084 in the 10/374,780 US patent application
  misc_feature: The sequence is a functional homolog of SEQ ID NO 752 in the 10/412,699 US patent application
  misc_feature: The sequence is a functional homolog of SEQ ID NO 188 in the 10/666,642 US patent application
  misc_feature: Functional homolog of the protein sequence given in SEQ ID NO 51205
  misc_feature: Useful for making plants with modulated biomass
PNYQPPVTFVVVQKRHHTRLFANNHKDRSSMDKSGNILPGTVVDSKICHPTEFDFYLCSHAGIQGTSRPAHYHVLWDENNFTADEMQTLTNNLCYTYARCTRSVSVVPPAYYAHLAAFRARFYMEPEMSENQTSKSSNGTNGASVKPLPALKEKVKRVMFYC

SEQ ID NO: 46317 - DNA, 596 bp, Panicum virgatum
  misc_feature: Ceres CLONE 2029950
  misc_feature: Encodes the peptide sequence at SEQ ID NO. 46318
acaagctcccccaccggaaaacaacaatccccaaacccaatttccttcgtgctcacggcggcggcgatgtcggggcgcggcaagggcggcaaggggctgggcaagggcggcgccaagcgccaccgcaaggtgctccgcgacaacatccaggggatcaccaagccggcgatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctaagcgccagggacgcaccctctacggcttcggcggctaggccctggcgccggtgcgcccccgtctgaggcgcggttcctggattggtgccgtgtgtggttagggatgagggttcgttgtcaagggattggctgtgttggctttctgaatgtagtctgtctttgtgccgtgatgaaatgcgtactgcctatcttgtacgaggattgaacatgcctgcagcaaagaaatggtcgagtttcaaatgctgtgcttctgactg

SEQ ID NO: 46318 - protein, 112 aa, Panicum virgatum
  misc_feature: Ceres CLONE 2029950
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALSARDAPSTASAARPWRRCAPV

SEQ ID NO: 46319 - DNA, 477 bp, Panicum virgatum
  misc_feature: Ceres CLONE 2029953
  misc_feature: Encodes the peptide sequence at SEQ ID NO. 46320
gccacactaaacccaaccagctaagcttccccttcttcccttctcactcctctatctccacgagcttcttctcaaagcctcccctgctctgctctgccatcctctgctcactgccaccggtcgagcagatgataagagaggcggatcttgatggggatggacaggttgattatgatgagttcgttaggatgatgatgctctccgatggccacgccggagctgccgccgctcagcaccaatcaatctgatattccgtccatctccatggcggtgaccttgtagctagcaggctagcgtcccttttgcagcatcgaatcaggcagcatcctccattgccttctctctccctctctgtagctccatctggtatttcttcaacgtatgatgattcattgttcatctgtaaccgattgattaatcaacaatttaatcttcatcaattcgtcaaaggatggcgattggttcgtaagaacgtct

SEQ ID NO: 46320 - protein, 81 aa, Panicum virgatum
  misc_feature: Ceres CLONE 2029953
  misc_feature (39)..(67): Pfam Name: efhand Pfam Description: EF hand
  misc_feature: SWISSPROT Homolog: EC 2.7.11.1 Non-specific serine/threonine protein kinase
HTKPNQLSFPFFPSHSSISTSFFSKPPLLCSAILCSLPPVEQMIREADLDGDGQVDYDEFVRMMMLSDGHAGAAAAQHQSI

SEQ ID NO: 46321 - DNA, 662 bp, Panicum virgatum
  misc_feature: Ceres CLONE 2029960
  misc_feature: Encodes the peptide sequence at SEQ ID NO. 46322
actcgccgcagcttcacgcccggatagggagcaccaccgcaggagcccgagccctcccttccgcagccgccaaaatggtgaatgttcctaagaccaagaagacctactgcaagaacaaggagtgcaggaagcacactctccacaaggtgactcagtacaagaagggtaaggatagcctttctgcccagggaaagcgtcgttatgaccgcaagcagtcaggatatggtggtcagaccaagcccgtcttccacaagaaggccaagaccaccaagaagattgtgctgaagctgcagtgccagagctgcaagcactactcccagcaccctatcaagagatgcaagcactttgagattggtggagacaagaaggggaagggaacatctcttttctagattgctcgcagcctgtctggatgctgaagttgtggtgtctaccacttttttttagacctgtcgtcaaatattactagtagttcttaaagcggaccatgcttatgtatccaaattccaatgcctgacatttgctaagagtgtttgacttttggctaaatgatgttttgtagcttgaatctgttttctgtcttcgattttggcagccatcatgtgaagttgcctgaatctgtgcagatgtattgggtgctcgtgtcaacagcttctgcttgc

SEQ ID NO: 46322 - protein, 105 aa, Panicum virgatum; identical to SEQ ID NO: 12877
  misc_feature: Ceres CLONE 2029960
  misc_feature (19)..(95): Pfam Name: Ribosomal_L44 Pfam Description: Ribosomal protein L44

SEQ ID NO: 46323 - DNA, 460 bp, Panicum virgatum
  misc_feature: Ceres CLONE 2029962
  misc_feature: Encodes the peptide sequence at SEQ ID NO. 46324
acctcatcgatcgagccagccgtccagccagtcgcctatatcctcgcctgctgcgcgcgtctctctgctctcctagggagatctcgcgcagcgcggtaacccaccttcccacctcgtcgccgtcgcagatggccggcctcatgatgaagctcgtcgccgccgccgccgtggccgccgcgctcgtggcgtccgccgccaccgccgcagaggcccccgccccggcgcccgcctccgacgccgccgccgcggtgcccctccccgcggcgtccctcgccgccgccaccttcggctgcctcttctgctagatccggcgcccgttccccgtggggcctgctgatatgatgatatatgctggggtggcgtgagtcaagtccgggtggggaggatgtcggtgggggtgtgtatgtacgagttcgagctgcggcgggggtggtgtgcgagcggtgactgcgtgataaga

SEQ ID NO: 46324 - protein, 58 aa, Panicum virgatum
  misc_feature: Ceres CLONE 2029962
  misc_feature: Functional homolog of the protein sequence given in SEQ ID NO 50452
  misc_feature: Useful for making plants with altered carbohydrate content
MAGLMMKLVAAAAVAAALVASAATAAEAPAPAPASDAAAAVPLPAASLAAATFGCLFC

SEQ ID NO: 46325 - DNA, 497 bp, Panicum virgatum
  misc_feature: Ceres CLONE 2029966
  misc_feature: Encodes the peptide sequence at SEQ ID NO. 46326
gcgatcctcgtccacacgtcacagaatgggtaagccaaagggaattcgatcagcaagacaccatgttgctaacagaattgtaaacagatgggccgataaagcctacaaaaagtctcacttgggtacctggagaaaagctaatccactcggtgacgcatcccacgccaaaggaattgtccttgaaaaactcggaattgaggctaaacaacctaactctgctatcagaaaatgcgtcagagttcaattaatcaaaaacggaaagaaagtcgctgctttcgtcccaaacgatggttgcttaaactatgttgatgaaaatgacgaagttctcatttctggatttggaagaaaaggtcactccaagggagatattccgggagttcgattcaaggttgtcaagaccgctggtgtctctctccttgctctttacaaagaaatcaaagagaagccacgttcttaaatgtaatttggaaccaaaagaataaaactcagagtttttc

SEQ ID NO: 46326 - protein, 143 aa, Panicum virgatum
  misc_feature: Ceres CLONE 2029966
  misc_feature (8)..(142): Pfam Name: Ribosomal_S12 Pfam Description: Ribosomal protein S12
MGKPKGIRSARHHVANRIVNRWADKAYKKSHLGTWRKANPLGDASHAKGIVLEKLGIEAKQPNSAIRKCVRVQLIKNGKKVAAFVPNDGCLNYVDENDEVLISGFGRKGHSKGDIPGVRFKVVKTAGVSLLALYKEIKEKPRS

SEQ ID NO: 46327 - DNA, 644 bp, Panicum virgatum
  misc_feature: Ceres CLONE 2029968
  misc_feature: Encodes the peptide sequence at SEQ ID NO. 46328
tgctgcttctggcaccactgtgtcccatgtgtctgatattgttggaccagaagggttggtctatgctgttgagttctctcacaggagtggtagggatcttgtcaatatggcaaagaagagaaccaatgtgatccccattattgaggatgctaggcaccctgcaaggtaccgcatgttggttggcatggttgatgttatcttctctgatgttgcacagcctgaccaggctaggatcttagcccttaatgcttcatacttcttgaagaacggtggccattttgtgatttcaatcaaggcgaactgtatcgactccaccatgcctgctgaagctgtgtttgctgctgaggtggagaagctgaagcttgatcagttcaagccgtcggagcaggtgaccctggagccctatgagcgtgaccacgcctgcgtggtcggtggctacaggatgcccaagaagcaaaaggctacgtcctaaagagaagaaattgtgtttggggggcatggcaatcttctttctgagatatgtttgttgtatcctggagaaagaacttttgagcaagtgttagggttttgtagcagctatgttgaacttgttctggtttaacagcactatttggttggatcaagatatggaagtattgacgtcc

SEQ ID NO: 46328 - protein, 156 aa, Panicum virgatum
  misc_feature: Ceres CLONE 2029968
  misc_feature (1)..(148): Pfam Name: Fibrillarin Pfam Description: Fibrillarin
AASGTTVSHVSDIVGPEGLVYAVEFSHRSGRDLVNMAKKRTNVIPIIEDARHPARYRMLVGMVDVIFSDVAQPDQARILALNASYFLKNGGHFVISIKANCIDSTMPAEAVFAAEVEKLKLDQFKPSEQVTLEPYERDHACVVGGYRMPKKQKATS

SEQ ID NO: 46329 - DNA, 839 bp, Panicum virgatum
  misc_feature: Ceres CLONE 2029970
  misc_feature: Encodes the peptide sequence at SEQ ID NO. 46330
cccttttcatttctttaacaatgagtaaagtcagcgcttctgccgtcagagagattgttaaccaaatccaagctgcttctgctgaaaagcaacgcaagttcaccgaaactgttgaactccaaattggtttgaagaactacgatccccaacgtgataagcgtttctctggtaccatcaagcttcccaacgtcgctcgtccccgtatgaccgtctgtgttctcggtgatgctttccactgtgatcaagccaagggtgccggtatggaattccaatccgttgatgatcttaagaagcttaacaagaacaagaagctcatcaagaagctcgccaagaagtacgatgctttccttgcttccgaagctttgatcaagcaaattcctcgtctcttgggtcctggtctccacaaggtcggtaagttccctactcccgtctcccacaacgattccttgaccgataaggccaacgagatccgtgccaccatcaagttccaattgaagaaggttctctgtctcggtgttgctgtcggtcacctcgatatgactgaagatcaattgattgccaacatcatgttgtctgtcaacttcctcgtttctttgttgaagaagcactggcaaaacgtcaagtctttgtacttgaagtccaccatgggtaagcctcaccgtctcttctaagctggtcgccctctgctttctattatttcaatcatgatcattttatataatgtgttatgctatcaaaacagaacctattaactctgacggtgtaccaaggtttcattggtttgaaatcatttgggagctatcatgacttactatgtagaatgttcactattgtttaat

SEQ ID NO: 46330 - protein, 216 aa, Panicum virgatum
  misc_feature: Ceres CLONE 2029970
  misc_feature (4)..(212): Pfam Name: Ribosomal_L1 Pfam Description: Ribosomal protein L1p/L10e family
MSKVSASAVREIVNQIQAASAEKQRKFTETVELQIGLKNYDPQRDKRFSGTIKLPNVARPRMTVCVLGDAFHCDQAKGAGMEFQSVDDLKKLNKNKKLIKKLAKKYDAFLASEALIKQIPRLLGPGLHKVGKFPTPVSHNDSLTDKANEIRATIKFQLKKVLCLGVAVGHLDMTEDQLIANIMLSVNFLVSLLKKHWQNVKSLYLKSTMGKPHRLF

SEQ ID NO: 46331 - DNA, 617 bp, Panicum virgatum
  misc_feature: Ceres CLONE 2029977
  misc_feature: Encodes the peptide sequence at SEQ ID NO. 46332
gcaagccagaagctgctgcagcatccacccatccttcccatcctgctctcgagctccaagcctccgacccgacggcgcgcctgctcagctagccggggacgaacgcaaccgagcagcatccatggccgtgttggtggcgaggcaggggcgcgagctgcagcgctacagccagcgcaccggcgggcgcatcgtggtggggtgcatcccgtaccgcgtgcggtgcgacggcgagctggaggtgctggtgatcacgtcgcagaaggggcacggcatgatgttccccaagggcgggtgggaggaggacgagtccatggacgaggccgcccggcgcgaggccctggaggaggccggcgtcctcggcgacaccgagccggtgctcggcttctggcactacaagagccgccgctacgtcgaccagacctacgagggcttcatgttcccgctccgcgtcgccgacgagctccaccagtggcccgagatggcctcccgcaagcgcacctgggtgagtagttgaggccaccatcccaattccttcgctcgcggcacgcgctgcccaatgcaaatcccacccccagaaccaatgcaaggacatgtcatctgacccctcgattgcacgg

SEQ ID NO: 46332 - protein, 130 aa, Panicum virgatum
  misc_feature: Ceres CLONE 2029977
  misc_feature (21)..(130): Pfam Name: NUDIX Pfam Description: NUDIX domain
  misc_feature: SWISSPROT Homolog: EC 3.6.1.52 Diphosphoinositol-polyphosphate diphosphatase
MAVLVARQGRELQRYSQRTGGRIVVGCIPYRVRCDGELEVLVITSQKGHGMMFPKGGWEEDESMDEAARREALEEAGVLGDTEPVLGFWHYKSRRYVDQTYEGFMFPLRVADELHQWPEMASRKRTWVSS

SEQ ID NO: 46333 - DNA, 547 bp, Panicum virgatum
  misc_feature: Ceres CLONE 2030007
  misc_feature: Encodes the peptide sequence at SEQ ID NO. 46334
cttcatggaaatccccaacattttcagccctgtagatgggagggctcaagccaagggacaagcaagaggttcacgccgttcggtggcgggcctcggctctgcccaggatcggagcttgctaaagtagaggctgctttctttctccatcaccttgtgctcaattatagatggagaatcgatggcgatgacatgccgatggcatacccgtatgtggagttccagagaggtctgccaatagaaatcgagccaatctgccatgaatcttgactggcctgaatgccgggtcacggcgagttcatctgttagcttgaaggtacctgcacgagaacatccatgtccatgaacggcttgaagtttcatgaagtgtagaaacactgggcactagcttgtaagtagctagcatgaggcatctgagactgtgatttatgatgtacatgatgtagatatattttgcccatggcagttgctcgaggtggttggttcacttcaccctgtaacattctccactgtggctcgaccactattctatacgagaagattgggctcc

SEQ ID NO: 46334 - protein, 88 aa, Panicum virgatum
  misc_feature: Ceres CLONE 2030007
  misc_feature: SWISSPROT Homolog: EC 1.14.13.93 (+)-abscisic acid 8'-hydroxylase
  misc_feature: Functional homolog of the protein sequence given in SEQ ID NO 50272
  misc_feature: Useful for making plants with modulated oxidative stress sensitivity
LHGNPQHFQPCRWEGSSQGTSKRFTPFGGGPRLCPGSELAKVEAAFFLHHLVLNYRWRIDGDDMPMAYPYVEFQRGLPIEIEPICHES

SEQ ID NO: 46335 - DNA, 648 bp, Panicum virgatum
  misc_feature: Ceres CLONE 2030008
  misc_feature: Encodes the peptide sequence at SEQ ID NO. 46336
aatctcctcagtagtacactcgctagctagctaagctgctatataaattaaattaaagctagtagtactgatcgatcggcatcgccggccggagatcgacatgacgacgatgatgaagaagcagcagcaagctgtggtggtgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagctagcttatctgtatctatacatacatacatacatacatacatacatacatacatacatatgatcgctcgctcgctcgatcgatcttagtcgtctacgtgtggcttgctgctgttcatccagccgctcgctacgtgtgtgtgtgtgtgcgcgtatacacacacacacgacggataaataaaagatgcatgggttgcctccgggccgctccctatatagct

SEQ ID NO: 46336 - protein, 95 aa, Panicum virgatum; identical to SEQ ID NO: 44457
  misc_feature: Ceres CLONE 2030008
  misc_feature (30)..(95): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass

SEQ ID NO: 46337 - DNA, 535 bp, Panicum virgatum
  misc_feature: Ceres CLONE 2030017
  misc_feature: Encodes the peptide sequence at SEQ ID NO. 46338
aagaccaaggagtggaggccgggcggcgcgcggtgcgagcacccgcagtcgccggcgcagcggaagaagctggacgggctgtacgagtgcatcctgtgcgcgtgctgcagcacggcgtgcccgtcctactggtggaactcggaggcgttcctcggccccgccgcgctgctgcacgcctaccgctgggtctctgacagccgcgacgactacggcgaggagcgggtgcaggcgctgtcggagggctgggacaagctgtacaggtgcaggatgatcaagagctgcaccgcgacgtgccccaagagcctcgaccccgccgccgccatctccgcactcaaggccctgcaccagctccgcaaggcctgacgaacgagaggatgccggcctccttcatgtctacgccggccggtgctagtagaacgtacgacgatgcgtcgtgcgtgtgttcatctgggaataaaggatgctttctctcgtggatttcgttgctactacaatgcttcttgcctgtaacgacgtcgacccaaagagttcactc

SEQ ID NO: 46338 - protein, 120 aa, Panicum virgatum
  misc_feature: Ceres CLONE 2030017
  misc_feature: SWISSPROT Homolog: EC 1.3.5.1 Succinate dehydrogenase (ubiquinone)
  misc_feature: Functional homolog of the protein sequence given in SEQ ID NO 51680
  misc_feature: Useful for making plants with modulated biomass
KTKEWRPGGARCEHPQSPAQRKKLDGLYECILCACCSTACPSYWWNSEAFLGPAALLHAYRWVSDSRDDYGEERVQALSEGWDKLYRCRMIKSCTATCPKSLDPAAAISALKALHQLRKA

SEQ ID NO: 46339 - DNA, 539 bp, Panicum virgatum
  misc_feature: Ceres CLONE 2030029
  misc_feature: Encodes the peptide sequence at SEQ ID NO. 46340
acgaatgaaaggttccttgtgccggagatgctttatcatccaatcgatcttggtataaatcaagctgggcttgctgagtgcatagttcgcgctgtacaagcctgccacccataccttcaacctgtactttttgagagcattatcctgacaggtggaagcacattgtttcccagattcactgaaagactggagatggagctccggcctcttgtccctgatgactaccaggtgaagataattcgtcaagagaatcctatccttggagcctggagaggtggatccattttggcgtccagccctggtttcgaatcgatgtgtgtcacgaaatccgagtacgaggagatggggtcggcacgatgtcggcgtaggtttttccattgaagggtaggccggaagattagaagaaggtgggtgttttgtatatatgacaagcagtatggcttagatcagggtatctgacaattcagtcatgtacaacagcagtactagttggagtttggttaacagtaacgaaatggcggctatcgttttagaagcgc

SEQ ID NO: 46340 - protein, 126 aa, Panicum virgatum
  misc_feature: Ceres CLONE 2030029
  misc_feature (1)..(125): Pfam Name: Actin Pfam Description: Actin
  misc_feature: Functional homolog of the protein sequence given in SEQ ID NO 51690
  misc_feature: Useful for making plants with modulated flowering time
TNERFLVPEMLYHPIDLGINQAGLAECIVRAVQACHPYLQPVLFESIILTGGSTLFPRFTERLEMELRPLVPDDYQVKIIRQENPILGAWRGGSILASSPGFESMCVTKSEYEEMGSARCRRRFFH

SEQ ID NO: 46341 - DNA, 695 bp, Panicum virgatum
  misc_feature: Ceres CLONE 2030030
  misc_feature: Encodes the peptide sequence at SEQ ID NO. 46342
agagagcggagaagaaggctagggtttaaggttgctcggcgatggcgtcggcggcgaaggccctggcggcgcgggcgggatcctccctcctcggccgcctcctcgcgtccccgtcaacacccctcctcggcgcggggatgccgcagctcgccaggctgcaggcgcacgtcccgccggcgccggcgccgtctgtggatgcctacgaggcggaggcggtcgcgaggctcacctcgctccccggagagatctcgttcccctgcggcctgccctcgctccgcttcttcatcgacgacgctactgccgtggagaatcctgtcgctaatgaaccccttctgctaataaagagaacttaccagcccagtaccatcaagcggaagagaacccatggatttcttacacgtaagtcgaccaagggtgggcgcaaggtgatcgcacggaggatcgccaaaggcaggcacaggctttccgtgtagcgagatcccgtagcagctcggaacacttttttcttcacagcagatttgtactgttctttgtacgaaaccttagagttcaacgtctatgtatgcttaacgagtaacgaaccctctgagtaacgaaccctctgctaaaggcgagccccagcaaaaagcagcagaccgtgtgtggattttcttgtcaaaacaactgttccgcgaaataaactcaagtttatctgc

SEQ ID NO: 46342 - protein, 143 aa, Panicum virgatum
  misc_feature: Ceres CLONE 2030030
  misc_feature (100)..(143): Pfam Name: Ribosomal_L34 Pfam Description: Ribosomal protein L34
MASAAKALAARAGSSLLGRLLASPSTPLLGAGMPQLARLQAHVPPAPAPSVDAYEAEAVARLTSLPGEISFPCGLPSLRFFIDDATAVENPVANEPLLLIKRTYQPSTIKRKRTHGFLTRKSTKGGRKVIARRIAKGRHRLSV

SEQ ID NO: 46343 - DNA, 574 bp, Panicum virgatum
  misc_feature: Ceres CLONE 2030037
  misc_feature: Encodes the peptide sequence at SEQ ID NO. 46344
ggcgcgcacctcccgctccactgctcctcgccggcccgccccgcctcgcgcctctcgccgtcggacgccgccccccgtcgccccgaccgaaccccgcggcggcacgcgaagatgactacttcaaggcgtcttgctgacaggaagagtgccaagttccaaaagaatatcacaaagaggggttccgtgcctgagactactgtgaagaaggggaatgactaccctgttggaccaatcctgcttggattcttcatttttgtggtcattggatcatccttgtttcagataatcagaacagcgacaagcggcgggatggcttgaactgagctaaattcagaagcatgtccatccatgcatgtgttcgggagctgggaggcagtgtctgtattctgtagcaaacttgttcctggatgatgtcttgtagtgttgcgaatcttgcgtttcttttctgttgtctggagtatcaaagagttttaagtttaaatggatgttggatcatgcacaggctaaaagtttaaatatatgatgatatagaaccttgatctgtagaaaagcagctgtaatttctctctatctg

SEQ ID NO: 46344 - protein, 68 aa, Panicum virgatum
  misc_feature: Ceres CLONE 2030037
  misc_feature (1)..(64): Pfam Name: RAMP4 Pfam Description: Ribosome associated membrane protein RAMP4
  misc_feature: Functional homolog of the protein sequence given in SEQ ID NO 50140
  misc_feature: Useful for making plants with modulated nitrogen use efficiency
MTTSRRLADRKSAKFQKNITKRGSVPETTVKKGNDYPVGPILLGFFIFVVIGSSLFQIIRTATSGGMA

SEQ ID NO: 46345 - DNA, 615 bp, Panicum virgatum
  misc_feature: Ceres CLONE 2030038
  misc_feature: Encodes the peptide sequence at SEQ ID NO. 46346
cacgccgccgccacagcagtcttcggtctcccgcgcatcccttcgagagatcaagttgctgctgtcgtagtcccacaaccgtcaccatgcagaacgaggagggtaagatggtggacctctacgtccccaggaagtgctccgccactaacaggatcatcacagccaaggatcatgcctctgttcagatcaacattggtcacttggatgcaaatggcatgtatgatggtcactttaccacattcgctctctctgggtttgtgcgcgctcagggtgacgctgacagctcattggacaggctgtggcagaagaggaaggctgagatcaagcagtagatctcgtttgtagtttcactaagaatcgactcttaagggatcctgcattagctatgttttgattttatgtctccagaccgttgggatacaatgctgtgatttcagttggtatcttaaatctaaagacttaaatcgtctgagttttgatgtctcctggtcttgttgtcaaatgaaagtagcttaattcccttaagcgtcatggcgttgccagatctcagaatttatgatgattgtggattcagttttttttttttgtgctaaacacaagtgtgttatctctttc

SEQ ID NO: 46346 - protein, 81 aa, Panicum virgatum
  misc_feature: Ceres CLONE 2030038
  misc_feature (1)..(81): Pfam Name: Ribosomal_S21e Pfam Description: Ribosomal protein S21e
MQNEEGKMVDLYVPRKCSATNRIITAKDHASVQINIGHLDANGMYDGHFTTFALSGFVRAQGDADSSLDRLWQKRKAEIKQ

SEQ ID NO: 46347 - DNA, 682 bp, Panicum virgatum
  misc_feature: Ceres CLONE 2030039
  misc_feature: Encodes the peptide sequence at SEQ ID NO. 46348
aactaacagcaacccatcgtcctcgctactagctagctactcagtggcactctcgctactcgcccatcatctgcttcaattccttcttcttcccaagcaaaagagcaagaccatgtcgacggtgagccgtgcatccctcgaccagaagcttgccctcgccaagcgatgctcgcgagaggcgaccctcgcaggggctaaggctgcagctgtagcgaccatcgcctctgcaattcccacggtgggttccattccatctccctccctcttcctcctctgttcatcgtgccatgctgatagcataacgaccctgtatctcttaccaaataccaaccaattcgctcatctccttcagctcgcgagcgttcggatgctgccatgggcgaaggccaacatcaaccccacaggccaggccctcatcatctccacagtcgccgggatggcctacttcatcgccgccgacaagaagatcctgtctctggcgaggcgccactcgttcgaggacgcacccgagcacctcaagaacacctcctatcagggcgccggcaggccgcacccggctttcttcaggccatgatcgagcttactgctggatcggagttgatgaataaactacttggccaacaactgcaaatcaatcaacgatgcgctcagagactcagagcaattgcaaattttagtgcgt

SEQ ID NO: 46348 - protein, 153 aa, Panicum virgatum
  misc_feature: Ceres CLONE 2030039
  misc_feature (11)..(127): Pfam Name: ENOD93 Pfam Description: Early nodulin 93 ENOD93 protein
MSTVSRASLDQKLALAKRCSREATLAGAKAAAVATIASAIPTVGSIPSPSLFLLCSSCHADSITTLYLLPNTNQFAHLLQLASVRMLPWAKANINPTGQALIISTVAGMAYFIAADKKILSLARRHSFEDAPEHLKNTSYQGAGRPHPAFFRP

SEQ ID NO: 46349 - DNA, 671 bp, Panicum virgatum
  misc_feature: Ceres CLONE 2030047
  misc_feature: Encodes the peptide sequence at SEQ ID NO. 46350
acgccactgccgttcccccccttcgcacctttccttttcttcagttcctcccctccccctccccctccccctccgtcgtcagtcttctttgctgccttcggcccttcacagttcacacttcgccagatcaccaccccgaccgcgactgccgacgcaagccacgaggccggcgacccccgcacctcctcgcctccggcgaccgtcccgagggagaaacatgggcagcgtctggagtggcggtgcaggaggtggtggctctgcctcctcgggaggtcatggtggctcggccaaccctggtggaggcggcggcaagatgatgaaggcgcccggcggcggcggcgcgtacatctcccgccctggcttcgagtccaaccctcagggctacttccaggacctccgcaagggaggcaagtagatgtaggcttgcccggagagcgcctcccggtgcctgcgagtatatggaccgtgagagtccatagcttctaaataatgcacaggtcgctgcaccaggaggcggcagcagtctattttataaataatgtacagctgctgcaccagtagccggcagcagcctagctagccttctgctgctccacgtcctgtttcggtttgctcgcttgtttcaaagtacctgctccctcctttaataaagaaaacgcaatattcgatct

SEQ ID NO: 46350 - protein, 65 aa, Panicum virgatum; identical to SEQ ID NO: 26926
  misc_feature: Ceres CLONE 2030047
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50210
  misc_feature: Useful for making plants with altered lignin content
  misc_feature: Useful for making plants with modulated biomass
  misc_feature: Useful for making plants with modulated nitrogen use efficiency
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50268
  misc_feature: Useful for making plants with modulated heat sensitivity
  misc_feature: Useful for making plants with modulated low light sensitivity
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application

SEQ ID NO: 46351 - DNA, 401 bp, Panicum virgatum
  misc_feature: Ceres CLONE 2030071
  misc_feature: Encodes the peptide sequence at SEQ ID NO. 46352
cccgtctcgacctcacgatctcccctctgcttcaagacgctccccctccttgctctcttgtcataataaagaagtcagcacaatgactcgcggcgaccagcgggagcgggaccggcagagggcgcaggcgcggcggccggtggccaaggggcgcgacgacgggctcacgccggagcagcggcgggagcgggacgccaaggcgctgcaggagaaggcggccaggaaggcggcgcaggccgcgggaggcggcgacgccaagggcgcgggcaagaacgccggcaagtagtagcctgtgtcgccggatccggcgagatcgcgttgtgtggccgggtggtgaaatctctgtaatcatgttgcaagatctgtgtgttggttggatatggaaaaaaaatcgggagcgg

SEQ ID NO: 46352 - protein, 67 aa, Panicum virgatum; identical to SEQ ID NO: 44523
  misc_feature: Ceres CLONE 2030071
  misc_feature (1)..(56): Pfam Name: 4F5 Pfam Description: 4F5 protein family

SEQ ID NO: 46353 - DNA, 377 bp, Panicum virgatum
  misc_feature: Ceres CLONE 2030090
  misc_feature: Encodes the peptide sequence at SEQ ID NO. 46354
gacacgagtacgataaaggagatcatatcagaagttgacacgaacaatgatgggaggattaactatgaggaattttgcgctatgatgagaggtgggatgcagcagccaatgaggcttaagtagcctgttcacgttgtagaaacggtgtaccattactccattagtaactgttgtttgctcttttttcttcatggttggtacttggtagctggataaaggcttacaatggactttgcttgtgcattgttgagagatcattgtgtatatcttttttgctcgtgtttgttggttgttgccttgtagtatcttgaacgtcccgtactttcttctgtaagtttgtttatgcaaatacatctaataaaacgtgcattttgcct

SEQ ID NO: 46354 - protein, 40 aa, Panicum virgatum
  misc_feature: Ceres CLONE 2030090
  misc_feature (4)..(32): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 51604
  misc_feature: Useful for making plants with modulated biomass
DTSTIKEIISEVDTNNDGRINYEEFCAMMRGGMQQPMRLK

SEQ ID NO: 46355 - DNA, 717 bp, Panicum virgatum
  misc_feature: Ceres CLONE 2030100
  misc_feature: Encodes the peptide sequence at SEQ ID NO. 46356
gccctcacaaacaagtccgcccaccgcacgcaaccacgacagagagagtccacgggtcgccatggcgagcaagcagagcctcctcgtcctcgccgccgtcgccgcctgcctcctcctcctcccggccgcctcggtcgccaccgacgtcgactactgcagtaggggcaagaagtacccggtgaaggtgagcggggtgcagatcgtgcccgatccggtgcagcccggcaagccggccaccttcaagatttccgcttccactgataaaatcatccagaaggggaagctggtaattgatgttaagtatttcttcctctacgtgcactcggaaactcgcgacatctgtggagagactacctgtccagcaactggtgacttcgtgctctctcatcagcagacattaccaagcttcactccaccgggttcttacaccatcaccatgaagattgttggggacgacaatgaggaactgagctgcatctcgttcgggttcagcatcgggttcgtcgcctccagctgaacggatgcatcttctatgagcaccagaagtttgccatggatgtaattatgaaccacacactgtatcctacgactcccagtagagttgaggtccatgtacgctttgtgggtgtcgcaaacttactgttcaactaagacgttttttatccagagttgaacaccgcaataaagcaaaaatctggttgtcatgaaacgagatgc

SEQ ID NO: 46356 - protein, 151 aa, Panicum virgatum; identical to SEQ ID NO: 16958
  misc_feature: Ceres CLONE 2030100
  misc_feature (25)..(145): Pfam Name: E1_DerP2_DerF2 Pfam Description: ML domain

SEQ ID NO: 46357 - DNA, 680 bp, Panicum virgatum
  misc_feature: Ceres CLONE 2030179
  misc_feature: Encodes the peptide sequence at SEQ ID NO. 46358
tttgattggacaaatgaggaaagagagatgctaagacggaaggtaccggtgactggttttaaaacaccatttcgggacggatatgtaagagatttagctgaagaagttctaaaattggccaaggatggattagaaagaagagggtacaaggaggttggtttcttgagagaggttgaggaaatggtgggaacaggagtaacgcctgccgagaggcttctgagtctgtacgagaccaagtggcaacgcaacgtggaccatgttttcgagcatttactctactgatgattctggatagagcttgtagatgtactctgatacacaatctcgtcttgattcatttcaacgcctggagctgcaagcctcagctcaggcccagcttggttgctcgttgacgagggaaaccgccacctgacccggcgctgcggctgaataacttcgctcgggccactttgttttgacttcacccctgatctccagggagaagtaacaacattttgtaccggcactttcgtcctgagattgaatgctaggatgaaaaataacgagcccatcctctgtacgatggcaacagtctgtttctttcagatttttgttgggatgcttgtgccggggttcactacatgctagagcaatctcatcgacgaatataaataaactgacggtttgcccgttgcgtccgc

SEQ ID NO: 46358 - protein, 93 aa, Panicum virgatum
  misc_feature: Ceres CLONE 2030179
  misc_feature: SWISSPROT Homolog: EC 6.3.2.2 Glutamate--cysteine ligase
FDWTNEEREMLRRKVPVTGFKTPFRDGYVRDLAEEVLKLAKDGLERRGYKEVGFLREVEEMVGTGVTPAERLLSLYETKWQRNVDHVFEHLLY

SEQ ID NO: 46359 - DNA, 553 bp, Panicum virgatum
  misc_feature: Ceres CLONE 2030196
  misc_feature: Encodes the peptide sequence at SEQ ID NO. 46360
aacaaacacccatccgactcctcaacaacatcaagtgctgcaaacacgcccgatttccagcaaccagcccattaggaaccacggttcagcaccaaacgtactaccatcacttgatcacgcacataccgccaaaatggttgcccagagcgaagctttccagaaggccgtcgtcgacagcaagaagctgacgtcgaagccgagcaacgacgacctgcttgagatctacgccctctacaagattggaacgggcgaggacatcgagaacgctcccaagccgggcatgttcgacctcaagggcaaggccaagtacaacgcgtggaggtcggccgtcgacgagggcatcacgcccgagcaggcgcaggagaagtacgtcgccaagatcgaggagatgaagagcaagtacggctacgacgagaacaaggagcccgaggccgttggcgggcaataaatgggagcaggagacaccgaggcgtcaagtggaagcattcgttgggcgcatggaagcgagaccgcgatgagctatctgcatctgtagcaagcaagtactgcgttc

SEQ ID NO: 46360 - protein, 104 aa, Panicum virgatum
  misc_feature: Ceres CLONE 2030196
  misc_feature (4)..(91): Pfam Name: ACBP Pfam Description: Acyl CoA binding protein
  misc_feature: SWISSPROT Homolog: EC 5.3.3.8 Dodecenoyl-CoA isomerase
MVAQSEAFQKAVVDSKKLTSKPSNDDLLEIYALYKIGTGEDIENAPKPGMFDLKGKAKYNAWRSAVDEGITPEQAQEKYVAKIEEMKSKYGYDENKEPEAVGGQ

SEQ ID NO: 46361 - DNA, 524 bp, Panicum virgatum
  misc_feature: Ceres CLONE 2030197
  misc_feature: Encodes the peptide sequence at SEQ ID NO. 46362
gattcctcgagagggacagccgtgcccggcagctccgctccgccccgccgccgagaatgtccgacgatgccaggcgcggggccgggggcgtcgcgcaggcggcgctccgggcctcctccgaggaccgcaagccggtgggcgcggggtccccgccgccggcggcggcggcggcggcggcgtacaagatccagctcaagagcgccgacatgaaggaggagatgcggcaggaggccttcgaaatcgcccgcatggcgttcgataggcacaccatggagaaggacatcgcggagtacatcaagaaggagttcgacaagaaccacggcccaacctggcactgcatcgtcggccgtaacttcggttcgtatgtaacgcatgaaacaaactactttgtgtacttctacattgattctaaagccgtcttgctattcaagtctgggtgattggcacagctattgtgatcaccctcgcatgcctgcgtcctgttactctcctgtattgccccccccccccccacagtttattat

SEQ ID NO: 46362 - protein, 127 aa, Panicum virgatum
  misc_feature: Ceres CLONE 2030197
  misc_feature (39)..(127): Pfam Name: Dynein_light Pfam Description: Dynein light chain type 1
MSDDARRGAGGVAQAALRASSEDRKPVGAGSPPPAAAAAAAYKIQLKSADMKEEMRQEAFEIARMAFDRHTMEKDIAEYIKKEFDKNHGPTWHCIVGRNFGSYVTHETNYFVYFYIDSKAVLLFKSG

SEQ ID NO: 46363 - DNA, 529 bp, Panicum virgatum
  misc_feature: Ceres CLONE 2030208
  misc_feature: Encodes the peptide sequence at SEQ ID NO. 46364
acattgctgtgctccaacaaagatgatccacatttctgccctcccccaagagatctccgaggaagcaatcctcaaccatgtgtctgagcacggttctgtcatcaacacaaagcttttcgaggtgaacggcaagaggcaggctctcgtcatgtttgagacggaagaggaggcgacagaggccctcgtgtcgaaacacgccagctcactggaggggaacacgatccggatctctttctcccagatgcagagtatataagccgctcctccagggaaaggtctttagccgctctcttggcctctgtgagctttgtttaggaagcatttgaaactaagatgtgaatcctatgcgctgttctcccagactgatgctctgtctgagttgtactaccctgacatttggtttcttcttcgtttctcgtgatactggccttgcaccaaagggtttctcttctgtttcttccctgttctgtcgtttaggttatcaaaggattttaccccctcatgtcatgctattctgagttgaaaggcc

SEQ ID NO: 46364 - protein, 84 aa, Panicum virgatum
  misc_feature: Ceres CLONE 2030208
  misc_feature (9)..(76): Pfam Name: RRM_1 Pfam Description: RNA recognition motif. (a.k.a. RRM, RBD, or RNP domain)
HCCAPTKMIHISALPQEISEEAILNHVSEHGSVINTKLFEVNGKRQALVMFETEEEATEALVSKHASSLEGNTIRISFSQMQSI

SEQ ID NO: 46365 - DNA, 410 bp, Panicum virgatum
  misc_feature: Ceres CLONE 2030213
  misc_feature: Encodes the peptide sequence at SEQ ID NO. 46366
atgcggtttttcgtttatctcctcagttcgcggagaagtccagcagcgccgcgccagcgccatgaaggacttcgcggggctggggcacctgttcgtggtgtccttcctcttctacttctcctccttcatggtgatcccggcgatcaccgacgtcaccatggaggccgtctgccccggccgcgacgagtgctccgccgccatctacctcagcggcttccagaacgctgtcaccgggctgggggcgctcgtggtgacccccgtcgtcggcaacctgtcggacaggtacgggaggaaggcgctgctgacgctgccggtgaccgtggccatcttgccgctgtgtaagcggaagctcgcaacctgatctcgccttgtttgtttttttagagtaaaatcatgcggcgcgtttgctc

SEQ ID NO: 46366 - protein, 99 aa, Panicum virgatum
  misc_feature: Ceres CLONE 2030213
  misc_feature: Functional homolog of the protein sequence given in SEQ ID NO 50259
  misc_feature: Useful for making plants with modulated cold sensitivity
  misc_feature: Useful for making plants with modulated salt sensitivity
MKDFAGLGHLFVVSFLFYFSSFMVIPAITDVTMEAVCPGRDECSAAIYLSGFQNAVTGLGALVVTPVVGNLSDRYGRKALLTLPVTVAILPLCKRKLAT

SEQ ID NO: 46367 - DNA, 660 bp, Panicum virgatum
  misc_feature: Ceres CLONE 2030222
  misc_feature: Encodes the peptide sequence at SEQ ID NO. 46368
attcatggaaccgccgcatgctccagtcgcggcagaggccggcgccggcgccggcgacgcttacaccatccggccgctcgagctctcggacctctccaagggcttctgcgagcttctcgcacaggtctccccttctccgccgctctcagaggaagccttccgcacgcgcttcgccgaactcgcggcgctgggcgccaaccacctggtcctcgtcgcggaggaagccgcgacgggccgcctcgccgcagcgggggcgattctggtggagcgcaagttcattcggcgctgcggcctcgtgggccacctggaggacgtggtggtggacgctgccgcgagggggcggggtctcggggagcgcctcgtgcgccgcctcgtggagcacgcgagagggagggggtgctacaagatcatattgaactgcacggcggagctgaaggggttctacgccaagtgcggcttcgaggagaggaatgtccagatggggctctacttctgatccaggttccactttatccgatcacacaccctgtttatgttgtcttcgattgattcgtggatttatgatgtgcgatgggggaagatctgcaggttcgcctgtttcttcgaataactgtttgtagttgcctgtgtgagcttgtgatcagtgctgcttgtaatgca

SEQ ID NO: 46368 - protein, 163 aa, Panicum virgatum
  misc_feature: Ceres CLONE 2030222
  misc_feature (71)..(153): Pfam Name: Acetyltransf_1 Pfam Description: Acetyltransferase (GNAT) family
  misc_feature: SWISSPROT Homolog: EC 2.3.1.4 Glucosamine 6-phosphate N-acetyltransferase
MEPPHAPVAAEAGAGAGDAYTIRPLELSDLSKGFCELLAQVSPSPPLSEEAFRTRFAELAALGANHLVLVAEEAATGRLAAAGAILVERKFIRRCGLVGHLEDVVVDAAARGRGLGERLVRRLVEHARGRGCYKIILNCTAELKGFYAKCGFEERNVQMGLYF

SEQ ID NO: 46369 - DNA, 699 bp, Panicum virgatum
  misc_feature: Ceres CLONE 2030241
  misc_feature: Encodes the peptide sequence at SEQ ID NO. 46370
gcacccaacatcctgtccgtggagcacgcgctggagcgcatggagctcgtgcacgcctgcgtcgagaaggtgcgcgtcaacctccgcaccggcgccgtgtcgcgcaccccgctctcggcggggaacctcgacttcggcgtcatccacccgggctacctcggccggcgtaaccggtacgggtacttcggcatcggcgaccccatgcccaagatcggcggcgtggccaagctggacttggagcgcgtcggcacgggcgactgcaccgtggcgcggcgggacttcggggccgggtgcttcgccggggagcccttcttcgtccccgacgacgtggagggggacggcaacgaggacgacggctacgtggtgtgctacgtccacaacgagcgcaccggcgagaaccggttcgtggtgatggacgcgaggtcgccgcagctggacatcgtcgccgaggtggagctgcccgcccgcgtcccctacggcttccacggcctctttgtcacgaaggccgagctccaggcgcagcagcaatgacaaaagcatcatgcgagctcagcaggattccatgataatacacacaaactggatactgaataggtcatagtaagaacaaaactctaggtctcatatcgcagtcgagtgtacgaattgttgtattgtaaatggagcagaacccatacaagagtttcgtgatttgagttg

SEQ ID NO: 46370 - protein, 176 aa, Panicum virgatum
  misc_feature: Ceres CLONE 2030241
  misc_feature (1)..(168): Pfam Name: RPE65 Pfam Description: Retinal pigment epithelial membrane protein
  misc_feature: SWISSPROT Homolog: EC 1.13.11.51 9-cis-epoxycarotenoid dioxygenase
APNILSVEHALERMELVHACVEKVRVNLRTGAVSRTPLSAGNLDFGVIHPGYLGRRNRYGYFGIGDPMPKIGGVAKLDLERVGTGDCTVARRDFGAGCFAGEPFFVPDDVEGDGNEDDGYVVCYVHNERTGENRFVVMDARSPQLDIVAEVELPARVPYGFHGLFVTKAELQAQQQ

SEQ ID NO: 46371 - DNA, 653 bp, Panicum virgatum
  misc_feature: Ceres CLONE 2030253
  misc_feature: Encodes the peptide sequence at SEQ ID NO. 46372
acagccaaaagccaacaacaaccgccgccacacccaccaccaaattcccaatcagccgcttcccaagctcggccgccgactccacccgctcgatcccgtgatggcgcccaaggccgagaagaagcccgccgagaagaagccggcggaggagaaggccgagaagaagccgaaggccgagaagcgcgtgccgggctccggcaaggagggcggcgagaagaaggagaagaagaaggccaagaagagcgtcgagacctacaagatctatatcttcaaggtcctcaagcaggtgcacccggacattggtatctcctccaaggccatgtctatcatgaactcgttcatcaacgacatcttcgagaagctcgcccaggaggccgcccgcctcgcgcgctacaacaagaagcccaccatcacctcccgggagatccagacctcggtgcgcctcgtcctccccggagagctcgccaagcacgccgtttctgagggcaccaaggccgtcaccaagttcacctcctcttagattgccgcacggttttcttttcctccgatgtttagcgcagtgttaggttgctcgaggaacaatgtagaattgtttacgttagctgaatgataatcaatggctattgtggaagttcagaatataatgcaattat

SEQ ID NO: 46372 - protein, 139 aa, Panicum virgatum
  misc_feature: Ceres CLONE 2030253
  misc_feature (46)..(116): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAEKKPAEEKAEKKPKAEKRVPGSGKEGGEKKEKKKAKKSVETYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 46373 - DNA, 687 bp, Panicum virgatum
  misc_feature: Ceres CLONE 2030255
  misc_feature: Encodes the peptide sequence at SEQ ID NO. 46374
attcggagcccagaaaaaaaatctctcgcttccggtctcgcgtggcgtgagtcggagggaagcgaaaactcgcgaaagggtctttgcgcgcgtccacagcggagcggaagccgaggagatggcggggaagggaggtaagggtctgctcgcggccaagaccacggccgccaagtcggccgagaaggacaaggggaagaaggcccccgtttcccggtcctcccgcgccgggcttcagttccctgttggccgtattcaccgccaactcaagcagaggacccaggcaaacggtcgtgttggtgctactgcagcagtctactccgctgccatcctggagtacttgacggcagaggttctggagctggcgggaaatgctagcaaagatctcaaggtgaagcgtatcacccctcgtcaccttcagctggccatccgtggagacgaggagcttgacaccctcatcaagggcaccattgctggtggtggtgtcatcccgcacatccacaagtccctcatcaacaagtcttccaaggagtgaaggctaggaaatgtgcatctcttagtttactggactcttgtgcgctcatgtggtgtaagtcctggttatcctgtaggttttagttgagctctcagacagtggttgtgtaactcttcatggtacctcttcagttattgaaacttgtttgcgtcgag

SEQ ID NO: 46374 - protein, 137 aa, Panicum virgatum; identical to SEQ ID NO: 18918
  misc_feature: Ceres CLONE 2030255
  misc_feature (32)..(106): Pfam Name: Histone Pfam Description: Core histone H2A/H2B/H3/H4
  misc_feature: SWISSPROT Homolog: EC 2.7.7.7 DNA-directed DNA polymerase

SEQ ID NO: 46375 - DNA, 663 bp, Panicum virgatum
  misc_feature: Ceres CLONE 2030272
  misc_feature: Encodes the peptide sequence at SEQ ID NO. 46376
aagacgctctctcctctgatctcgcacccgtcgcccgccgccgctgtcgctcgcaccgtcgcatctccgcagggtttgcaaagatggtggtgccgctgctgacgcagaagatcgtgaagaagcgggtcaagcagttcaagaggccccacctcgaccgctacaagtgcctcaagccaagctggcgcaggcctaagggtattgactcccgtgtcaggcggaagttcaagggatgcaccttgatgcccaacattggatacggctctgacaagaagaccaggcactaccttcccaacaagttcaagaagtttgttgtacacaatgtctccgagcttgaggtgcttatgatgcacaacaggacgtactgtgctgagattgcccacaacgtctccacccgcaagcgcaaggagattgtcgagcgcgctgcgcagctggacatcgtggtcaccaacaagcttgccaggctccgcagccaggaggacgagtgaaatgtttagtagttgcagttgccttgtccgtagaacagtactgagactggagatacctttccaccatttgtattcttgtgttagacttgttctgtggacgaaattttgttactgtgcgtccatgatgtgtcgcaaatattgttctgatcagagatgtgtcgcagatattgttctgagc

SEQ ID NO: 46376 - protein, 133 aa, Panicum virgatum
  misc_feature: Ceres CLONE 2030272
  misc_feature (14)..(123): Pfam Name: Ribosomal_L32e Pfam Description: Ribosomal protein L32
MVVPLLTQKIVKKRVKQFKRPHLDRYKCLKPSWRRPKGIDSRVRRKFKGCTLMPNIGYGSDKKTRHYLPNKFKKFVVHNVSELEVLMMHNRTYCAEIAHNVSTRKRKEIVERAAQLDIVVTNKLARLRSQEDE

SEQ ID NO: 46377 - DNA, 529 bp, Panicum virgatum
  misc_feature: Ceres CLONE 2030292
  misc_feature: Encodes the peptide sequence at SEQ ID NO. 46378
aaaaacagacttcccaaaggcagaacgcaagctcgcggcggcttccttcttccaaacccctcgcttccccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtcgcggcgcggacggcgatcgggttcgtcgtcatgggcttcgtcggcttcttcgtcaagctcatcttcatccccatcaacaacatcatcgtcggttccggctagacctcgaatcgtggagaagtgcagaacgagtgactagcatgggtggattgcaatacttttgaggagagcaaaggctaacgatgatcttggtctttcacaaagtgttgtaaaagacagtttctcatttgtgtttttggagtaatcctcatactgtttaagacttcaggatgcctgcatacctgattctgagttgaccttgatgcagtagcgagtcgtg

SEQ ID NO: 46378 - protein, 69 aa, Panicum virgatum; identical to SEQ ID NO: 12598
  misc_feature: Ceres CLONE 2030292
  misc_feature (10)..(66): Pfam Name: SecE Pfam Description: SecE/Sec61-gamma subunits of protein translocation complex

SEQ ID NO: 46379 - DNA, 657 bp, Panicum virgatum
  misc_feature: Ceres CLONE 2030295
  misc_feature: Encodes the peptide sequence at SEQ ID NO. 46380
atcgccatcctcctcttcgttacgttcgatctcctcaccgcaaagcagctgcgacgcccgatcgacggcgacacacagctagccatggcgtcgtccaaggccctcctgctcgcgctcctcgcggcggccgccgtgctcgccgccgcggcggaccaacgagcccgcacgcatgacagcaaggaggagatggcaaacggcggcgccggcgtggagcactggcacggcggcggcggatcatcaggtgatgagcacagccacggctgcgagcacggctgctgccgccgcgtataccacggcggctgccagaaatgctgcccgccgcccgctgcccggccggaggtggagaactagcaagacctgcatgcggcgtgcccggcgtgacgccgagcaggatcatatcggagatgcccagcgagggtgttcttcaagttcaaactagctagttacccaacacgggtgtagcttattattagcttggtagtgcgtggtatggtagtgcgtggtagcatccttacgagtgaataacgtgcaacgtgcacgaggataggcccttgtatggacgtacgtacacatgtacgccttcctcctcctcctgctgctgctgcttcggaataattatgtgtgtttgtgctgtgcctgtactggtactgccgtagc

SEQ ID NO: 46380 - protein, 88 aa, Panicum virgatum
  misc_feature: Ceres CLONE 2030295
  misc_feature (1)..(73): Pfam Name: GRP Pfam Description: Glycine rich protein family
MASSKALLLALLAAAAVLAAAADQRARTHDSKEEMANGGAGVEHWHGGGGSSGDEHSHGCEHGCCRRVYHGGCQKCCPPPAARPEVEN

SEQ ID NO: 46381 - DNA, 431 bp, Panicum virgatum
  misc_feature: Ceres CLONE 2030301
  misc_feature: Encodes the peptide sequence at SEQ ID NO. 46382
gtacgcggaggccgggaggatcttcagccgtcagtgcacgccgccggagctcgatgacttcctgacgctggacgcgtacaacctcatcgtggtgcaccatcccggagctgccgataaggctgaataaagcttcaagcttgctagatatgaacagcattgaaatgctcacagcatattatatggttgtcatgtagtaaggtgctgatatgtaataaagaacatttacatggtatacttcattgccctgaggctgaagaggtaggactgtactggggagtacaaaacatgtgcagttcactgaaaggtgggaagcgaattttcttgccagaggattgctgagaattacagagtaagatgaatgagttcacactgtaccagttggccagatcttactgttcaacagaggcttgtctgaaaacagacaatggtat

SEQ ID NO: 46382 - protein, 41 aa, Panicum virgatum
  misc_feature: Ceres CLONE 2030301
  misc_feature: SWISSPROT Homolog: EC 2.3.3.9 Malate synthase
YAEAGRIFSRQCTPPELDDFLTLDAYNLIVVHHPGAADKAE

SEQ ID NO: 46383 - DNA, 726 bp, Panicum virgatum
  misc_feature: Ceres CLONE 2030311
  misc_feature: Encodes the peptide sequence at SEQ ID NO. 46384
atccccacctcactccgcttgtgcggccgcgtggaggctgcctgccgcggcgctccggctgcgctccgatccacgccaagagcaaggaccccagcgccccccgccgcgcggctctgacgcgatcggcgccgtcgagccaccccggagcatcccctcgcgtgtgaagctacccagtttgctccaggattgtgtccatttaagaatatggctagaaagaggaacccaattgtctatctggacgtatccataggtgatgaactagatggaagaatgatctttgagttatttgctgatgttgctcccctgatatctgagaacttcagagctttatgcacaggtgagctgggaaagactaagaagccattatgctacaaggggtcaaccttccaccgtgtcatcaaggggttcatggcacaaggaggtgacttcgcaaaaggaaatgggtctggtggagaaagcatatatagtgggaaatttgcagatgaagcttgtgtcctacgccatgatgatcgtggtctcttgacaacagcagatactggctcccaattctgtattactttcaagcctaattctcatcttgacagaaaacacactgtttttggcaagcttgttgttggaaatgatgtgttgaagaggatcgagcaagttgatgtgcatgaatctgattcgactcccgtttttccggttaggatagtagattgtggggagctcacagaccgcaaacaa

SEQ ID NO: 46384 - protein, 173 aa, Panicum virgatum
  misc_feature: Ceres CLONE 2030311
  misc_feature (8)..(169): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MARKRNPIVYLDVSIGDELDGRMIFELFADVAPLISENFRALCTGELGKTKKPLCYKGSTFHRVIKGFMAQGGDFAKGNGSGGESIYSGKFADEACVLRHDDRGLLTTADTGSQFCITFKPNSHLDRKHTVFGKLVVGNDVLKRIEQVDVHESDSTPVFPVRIVDCGELTDRK

SEQ ID NO: 46385 - DNA, 721 bp, Panicum virgatum
  misc_feature: Ceres CLONE 2030319
  misc_feature: Encodes the peptide sequence at SEQ ID NO. 46386
ctcctctctctccttccgtctgctgaagcggagcgggctgctgatccgtccggggtcgtggtacaggaaactcttgggcttatactttgcagcatcgcctttttttgtcagttgtcacatggagagccctgagcctctacaggatgtcatgtgtgagtttcgtgctggtaagatgtctcttgagggaacacgagtggttcctgacacacgcaaggggcttgtccgtgttggtaggggtgaagaaggcttagtccactttcagtggcttgatcgtggacagaacatagttgaagatgaccaaattgtctttcctgatgaggccatcttcgagaaggtaacagaatcgtctggaagggtttacatcttgaagttcaagcatgacaacagaaaattcttcttctggatgcaggaaccaaatgctgatggggattctcagatttgcatccaagttaatgcctacttaaatcggccattagatgctgaggcggatcttgcagtgcctatcgaagcagaaatgtctgaagatacagctgatgatgatatctcttcgagagctgggaatttagttgatcagagcatgacttctgatttggctggtgaagtgacatctgctgctggacctgtacgcttggaggacctgcaacgaatactgagtgcaatacagccatcaggtgtatcaggtgctgcagctgaccctgatgctggagtaggactaggagac

SEQ ID NO: 46386 - protein, 200 aa, Panicum virgatum
  misc_feature: Ceres CLONE 2030319
  misc_feature (9)..(200): Pfam Name: ARM_1 Pfam Description: Adhesion regulating molecule conserved region
MESPEPLQDVMCEFRAGKMSLEGTRVVPDTRKGLVRVGRGEEGLVHFQWLDRGQNIVEDDQIVFPDEAIFEKVTESSGRVYILKFKHDNRKFFFWMQEPNADGDSQICIQVNAYLNRPLDAEADLAVPIEAEMSEDTADDDISSRAGNLVDQSMTSDLAGEVTSAAGPVRLEDLQRILSAIQPSGVSGAAADPDAGVGLG

SEQ ID NO: 46387 - DNA, 726 bp, Panicum virgatum
  misc_feature: Ceres CLONE 2030345
  misc_feature: Encodes the peptide sequence at SEQ ID NO. 46388
gcagaactcagaacagacgagaaacacacacacgagcctgaatcatcgaagcaacagcaatcccagactcccagtctcccgcgtcactcaaacaccaagcaaccacccaccgatcaacaatgtcgctgatccgccgcagcaacgtgttcgaccccttcttcctcgacctctgggatcccttccagggcttccccttcggctccggcagcggcagcagcagcctcttcccctcgtttgcaggcaccaactctgagaccgcggccttcgccggcgcccgcatcgactggaaggagaccccggaggcgcacgtgttcaaggcggacgtcccggggctgaagaaggaggaggtcaaggtggaggtcgaggacggcaacgtgctccagatcagcggcgagcgcaacaaggagcaggaggagaagaacgacaagtggcacagggtggagcgcagcagcggcaagttcctgcgccggttcaggctgccggagaacgccaagacggagcagatcagcgcgtccatggagaatggcgtgctcaccgtcaccgtgcccaaggaggaggtcaagaagcccgaggtcaagcccgtccagatcaccggctagagccgggagcctggctgtttttgcgtcgtgtggagtccctcgacgtggagtctgttcttccattcttgggtccaaaatgctagtgttagcatccgagtccgagtaaagcttcagatgtggtttggaa

SEQ ID NO: 46388 - protein, 159 aa, Panicum virgatum
  misc_feature: Ceres CLONE 2030345
  misc_feature (55)..(158): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFFLDLWDPFQGFPFGSGSGSSSLFPSFAGTNSETAAFAGARIDWKETPEAHVFKADVPGLKKEEVKVEVEDGNVLQISGERNKEQEEKNDKWHRVERSSGKFLRRFRLPENAKTEQISASMENGVLTVTVPKEEVKKPEVKPVQITG

SEQ ID NO: 46389 - DNA, 651 bp, Panicum virgatum
  misc_feature: Ceres CLONE 2030360
  misc_feature: Encodes the peptide sequence at SEQ ID NO. 46390
aagcgagcccagcaaacaaactccgaagcgactgacgatcagaggcgtctttcagagcgcagcagttcgccgacaaatccccactccgaccttcaatcccgatcatcattcaacgacaatgtcgctgatccaccgcagcaacgtgttcgaccccttctccctcgacctctgggaccccttccagggcttccccttcggctccggcagcggcagcctccttccgcgcatctcctccgactccgacgccgcgttcgctggtgcgtgcatcgactggaaggagacccccgaggcccacgtgttcaaggctgacgtgccggggctgaagaaggaggaggtgaatgtggaggtcgacgacggcaacgtgctccagatcagcggcgagcggagcaaggagcaggaggagaagaacgacaggtggcacagggtggaacgcagcagcggcaagttcctaggcaggtttaggctgccggagaacgccaagacggagcagatcaaggcctccatggagaacggtgtgctcaccgtcaccgtgcccaaggaggaggtcaagaagcccgaggtcaagcccgtccagattaccggctaaaaacgaacgcgtcatggggattcagaggaacgccttgttcggctggctggttcagccaccagaac

SEQ ID NO: 46390 - protein, 155 aa, Panicum virgatum
  misc_feature: Ceres CLONE 2030360
  misc_feature (51)..(154): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIHRSNVFDPFSLDLWDPFQGFPFGSGSGSLLPRISSDSDAAFAGACIDWKETPEAHVFKADVPGLKKEEVNVEVDDGNVLQISGERSKEQEEKNDRWHRVERSSGKFLGRFRLPENAKTEQIKASMENGVLTVTVPKEEVKKPEVKPVQITG

SEQ ID NO: 46391 - DNA, 734 bp, Panicum virgatum
  misc_feature: Ceres CLONE 2030365
  misc_feature: Encodes the peptide sequence at SEQ ID NO. 46392
atcagcaacgaagtactcgagatagattcagactttcagagagtgcaggacagttacttctttccaggccaagaatcttgccactttgcttgccagcctactagtacctagtaggatccgttgatccatggaggtggccggaggagctgtcggcgcgccgtccccgccgcggcgcgtggtggtggcggtggacgagagcgaggagagcatgcacgcgctctcctggtgcctctccaacgtcgtctccgccgccagggccgccgcggcgccgccccccgccgtggtgctcgtccacgcccgctcgccgcgcccgttctactgccccgccgtcgacggcgccgggtacgtcctgacgcagcaggtgatggacagcatggaccagtacatggccgccgcggccgacaccgtcgtcaccaaggccaagagcatctgcaccgcgttccccggcgtgagggtggagacgtgcgtggagaagggcgacccgcgcgacgtgatctgcggcgcggcggagaaggccggcgccgacatggtggtgatgggcagccacggctacggcttcctgcagagggcgctgcgggggagcgtcagcaaccactgcgtgcagaactgcaagtgccccgtcgtcgtcgtcaagaggcccggcggcgagcgccgcccggcgccgccgcggacctaggctcttgatgcggccgtatataataaccgtaagtgaataggagcccgactcgcctcgg

SEQ ID NO: 46392 - protein, 182 aa, Panicum virgatum
  misc_feature: Ceres CLONE 2030365
  misc_feature (14)..(169): Pfam Name: Usp Pfam Description: Universal stress protein family
MEVAGGAVGAPSPPRRVVVAVDESEESMHALSWCLSNVVSAARAAAAPPPAVVLVHARSPRPFYCPAVDGAGYVLTQQVMDSMDQYMAAAADTVVTKAKSICTAFPGVRVETCVEKGDPRDVICGAAEKAGADMVVMGSHGYGFLQRALRGSVSNHCVQNCKCPVVVVKRPGGERRPAPPRT

SEQ ID NO: 46393 - DNA, 688 bp, Panicum virgatum
  misc_feature: Ceres CLONE 2030368
  misc_feature: Encodes the peptide sequence at SEQ ID NO. 46394
atctcattccgctttgagcttgcttgcagctccagctcccctcgtctcttggtggctacgccatggccaccgtagtcctgatgagctgcagcctccgcgcgccggccagcagcggcttatctggcgtccgcgccgccccggcaccggccatcgtcgccatgcccgctgccaagcagcaggttgttggccgcggcgccaggctgcgcgcgcaggccacctacaacgtgaagctcatcacgcccgacggcgaggtagagctgcaggtgcccgacgacgtgtacatccttgaccaggccgaggaggaagggatcgacctgccctactcgtgccgcgcggggtcctgctcctcccgcgccggcaaggtcgtctctggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatacatatatatatacatatatataattaaaccctacgtcatgcgtgctatagctatagctatagctatactat

SEQ ID NO: 46394 - protein, 149 aa, Panicum virgatum
  misc_feature: Ceres CLONE 2030368
  misc_feature (58)..(133): Pfam Name: Fer2 Pfam Description: 2Fe-2S iron-sulfur cluster binding domain
  misc_feature: SWISSPROT Homolog: EC 1.14.13.7 Phenol 2-monooxygenase
MATVVLMSCSLRAPASSGLSGVRAAPAPAIVAMPAAKQQVVGRGARLRAQATYNVKLITPDGEVELQVPDDVYILDQAEEEGIDLPYSCRAGSCSSRAGKVVSGSVDQSDQSFLEDDQVAGGWVLTCAAYPTSDVVIETHKEEELTSSS

SEQ ID NO: 46395 - DNA, 695 bp, Panicum virgatum
  misc_feature: Ceres CLONE 2030374
  misc_feature: Encodes the peptide sequence at SEQ ID NO. 46396
agaacagaagacagacttctgatccacaacaccacacttgctaggtagcgagacctgtcgagaggaaccaccgaccggtgcaacatggagcacggccagcaggggcagcacggccacggaaccaccggccgcgtcgaccagtacggcaacccggtcggcggcgtcgggcacggcaccgggaccgggaccgggaccgggaccggcggcatggggtacggtggtaccgccggaaccggcggcatgggccagctgggggagcacggtggcgccggcatgggtggcggccagttccagcctgcgagggaggagcacaagaccggcggcgtcctgcaccgctccggcagctccagctccagctcgtccgaggacgacggcatgggcgggaggaggaagaagggcattaaggagaagatcaaggagaaattgcccggaggccacaaggacgaccagcacaccacggccaccggcggtgcctacgggcagcagggacacaccggcaggaccggcacgggaaccggcggcgccgcatacaccgagggcaccggcgagaagaagggcatcatggacaagatcaaggagaagctgcccggacagcactaagcgcggcctgcgtagtacgcgcgagaagccgtgtgcttgtctgccacggcgttccgagataataagatgaacccagcaggaatgaagtgtccttt

SEQ ID NO: 46396 - protein, 171 aa, Panicum virgatum
  misc_feature: Ceres CLONE 2030374
  misc_feature (14)..(171): Pfam Name: Dehydrin Pfam Description: Dehydrin
MEHGQQGQHGHGTTGRVDQYGNPVGGVGHGTGTGTGTGTGGMGYGGTAGTGGMGQLGEHGGAGMGGGQFQPAREEHKTGGVLHRSGSSSSSSSEDDGMGGRRKKGIKEKIKEKLPGGHKDDQHTTATGGAYGQQGHTGRTGTGTGGAAYTEGTGEKKGIMDKIKEKLPGQH

SEQ ID NO: 46397 - DNA, 746 bp, Panicum virgatum
  misc_feature: Ceres CLONE 2030411
  misc_feature: Encodes the peptide sequence at SEQ ID NO. 46398
  misc_feature (647)..(647): n is a, c, t, g, unknown, or other
aaaaaaaaaaaaatcgtgatttcaaggcgtccaacattttgcttgactcggagttcaatgctaagctttcagactttggattggcaaaagcaggtccaactggggatagaacccatgtttctacccaagtcatgggcacacgaggttatgcagctcctgaatatgttgcaacaggtcgcctctcagtaaaagcagatgtctacagctatggcgtggtgctgctggagttactgacaggacggcgagcgctagataaatcgaaaccggcatccgagcagaacctcgtcgactgggcaagaccctacctgcgagacaagcgccgtctgtaccgcgtcatggactttaagctgggcggacaatacccgaagaaaggcgcacacgcagtcgcaggcatcgccctgcagtgcattggcaatgatgccaaggcacggcccgcaatgtccgaggtccttgagaaactagagcagctgcaggaccccaagtacaacgtcacagcaccgcagatggacccaaagcggacatctttgtcaggctctgtccccaggtcgcccatgaaggcgcagccctcgccacgacgcctgtcgggctcgggttcccctttgccggcagtggcaggctccccgctgccagcttgtaggactgctcangtgcattagatgcgcgactgaaggatgaagtgcagagtttgtgttgtttgtggtgagatgctgaatagtgagaatcaacattctgtgattcgattgatc

SEQ ID NO: 46398 - protein, 217 aa, Panicum virgatum
  misc_feature: Ceres CLONE 2030411
  misc_feature (2)..(153): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50265
  misc_feature: Useful for making plants with modulated drought sensitivity
  misc_feature: Functional homolog of the protein sequence given in SEQ ID NO 50301
  misc_feature: Useful for making plants with modulated heat sensitivity
  misc_feature (215)..(215): Xaa is any aa, unknown, or other
KKKNRDFKASNILLDSEFNAKLSDFGLAKAGPTGDRTHVSTQVMGTRGYAAPEYVATGRLSVKADVYSYGVVLLELLTGRRALDKSKPASEQNLVDWARPYLRDKRRLYRVMDFKLGGQYPKKGAHAVAGIALQCIGNDAKARPAMSEVLEKLEQLQDPKYNVTAPQMDPKRTSLSGSVPRSPMKAQPSPRRLSGSGSPLPAVAGSPLPACRTAXVH

SEQ ID NO: 46399 - DNA, 688 bp, Panicum virgatum
  misc_feature: Ceres CLONE 2030421
  misc_feature: Encodes the peptide sequence at SEQ ID NO. 46400
ttgcaatccaagtggctctctcctgcttcatgtcatatatgctgcagattggtggcagggctcccaacaaaattttgtttgctaaaaatactgggaaaattttccagactgacttccatccagcttacgatccaaatggaatgatcgagttcaacgagcttgttccatttaggctgacacgtaacttgcaagctttcttctcgaattttggtgttgaaggtctcattgtgtctgccatgtgttctgctgcgcagtctgtggtttcccctaaacaaagccagcacatctggcatcatttagctatgtttttccgtgatgaactgttatcttggtcgtggagaaggcctcttggcattccatcagtgcctgtagctgccaaccaattggatttccaacagaaggttacaaacaacgtggaacatgtcatgggtcgtatcaagtcaatatcaccacattatcttgctgacgaggaagagaatgcaactgagcctcctcagtcagtccaaagaggcgtcacagatctggtagaagctgcattatcctcgaggaacttgtgcatgatggacccgacatggcacccgtggttctgaaggcagccagtttcctgccttcctgatgatggtagcctaaattcagaatcatttaaattacaccgcatctgatgatcgattctcttgttatatcagga

SEQ ID NO: 46400 - protein, 195 aa, Panicum virgatum
  misc_feature: Ceres CLONE 2030421
  misc_feature (163)..(195): Pfam Name: FATC Pfam Description: FATC domain
  misc_feature: SWISSPROT Homolog: EC 2.7.11.1 Non-specific serine/threonine protein kinase
AIQVALSCFMSYMLQIGGRAPNKILFAKNTGKIFQTDFHPAYDPNGMIEFNELVPFRLTRNLQAFFSNFGVEGLIVSAMCSAAQSVVSPKQSQHIWHHLAMFFRDELLSWSWRRPLGIPSVPVAANQLDFQQKVTNNVEHVMGRIKSISPHYLADEEENATEPPQSVQRGVTDLVEAALSSRNLCMMDPTWHPWF

SEQ ID NO: 46401 - DNA, 708 bp, Panicum virgatum
  misc_feature: Ceres CLONE 2030432
  misc_feature: Encodes the peptide sequence at SEQ ID NO. 46402
gatcagcttcgaatccatcacaacctcagctcaccacacactgctagctagctgctttacacttcactctcactatacccagctgctagcgatcagatcagtgagtgttaattatttttcatataatggctcgccgcctctccgtctccgtggttgtcgccgtcgtcctggtggctgcgctggtggctgcggagaccgcttcggcggcggtgagctgcggcgaggtgacgtcggccgtggcgccgtgcctggggtacgcgatgggcagctcggcttcgccctcggcggcgtgctgcaacggggtgaggtcgctgagcagccgggcgtcgtcgacggcggaccggcaggcggcgtgcgcctgcctcaagagcatgacggggaggctgggcggcaacatgcgcaacgccgccagcatccccagcaagtgcggtgtcaacgtcggcgtccccatcagcccaaacgtcgactgctccaagataaactgagaagaaggatggatggctatgatgtcggccaatatatatagcagagagcagtcgtttaatttactacctctccattttacatttttacaccaccaccgtaccacctgtgcacgtcgtcgtcgtgtatgtaacaacaataatcctctctctgcttatgggtttgctggctctctgttttcatgtatgtactactaccatgctgctgctgctgctgcttttgtat

SEQ ID NO: 46402 - protein, 119 aa, Panicum virgatum
  misc_feature: Ceres CLONE 2030432
  misc_feature (31)..(115): Pfam Name: Tryp_alpha_amyl Pfam Description: Protease inhibitor/seed storage/LTP family
MARRLSVSVVVAVVLVAALVAAETASAAVSCGEVTSAVAPCLGYAMGSSASPSAACCNGVRSLSSRASSTADRQAACACLKSMTGRLGGNMRNAASIPSKCGVNVGVPISPNVDCSKIN

SEQ ID NO: 46403 - DNA, 365 bp, Panicum virgatum
  misc_feature: Ceres CLONE 2030445
  misc_feature: Encodes the peptide sequence at SEQ ID NO. 46404
cacttgttcggtgggccactccacagttgcatgacattgatgcattggaccggatggttgatccggcactcaagggtctataccctgcaaaatcactatcccgcttcgccgacgttgtcgccctctgtgtccagcctgaaccagagttcaggcctcctatgtctgaggtggtgcaagcactggtccggcttgttcagagggccaacatgaccaggagaatgctcgacggcgaggaggcttctcgacgaccggatgaccaggaccaagaattcctttagcaagtgtgacagatacttcttgcgctgaaccttcatatgaccttactgttgtgactgttactttatttcccgcaacatgtaatgcag

SEQ ID NO: 46404 - protein, 91 aa, Panicum virgatum
  misc_feature: Ceres CLONE 2030445
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
LVRWATPQLHDIDALDRMVDPALKGLYPAKSLSRFADVVALCVQPEPEFRPPMSEVVQALVRLVQRANMTRRMLDGEEASRRPDDQDQEFL

SEQ ID NO: 46405 - DNA, 701 bp, Panicum virgatum
  misc_feature: Ceres CLONE 2030458
  misc_feature: Encodes the peptide sequence at SEQ ID NO. 46406
gcaccaagaagcacacgaacaccagcaatccacagatcaaccaaaccaaacaacaaaatcgatcgaagagaggccaagatccgcggcggcgagatggacgcgaggatgttcgggctggagacacccctgatggcggcgctgcagcaccttcttgacgtcccggacggcgaggccggcgacaaggcgagcgcggcggggagcggccccacgcgcacctacgtccgcgacgcgcgcgccatggcggcgacccccgccgacgtcaaggagctcccgggggcctactcgttcgtggtggacatgccggggctgggcaccggcgacatcaaggtgcaggtggaggacgagcgggtgctggtgatcagcggcgagcggcgccgggaggagcgcgaggaagccaagtacctgcgcatggagcgccggatgggcaagttcatgcgcaagttcgtgctgccggacaacgccgacatggacaagatctctgccatgtgcaaggatggcgtcctcacggtgaccgtggagaagctgccgccgccgaagcccaagaagcccaagaccattgaggtcaaggtcgcctctgaggatcatgcagttgtggcgagtgctgaggtcaagtcagagcagtgccagtgagttgtggcgagtgctgaggagaagcatgcagttgtgcttgtttccttatgtccctctgtgtgtgtgtaccg

SEQ ID NO: 46406 - protein, 178 aa, Panicum virgatum
  misc_feature: Ceres CLONE 2030458
  misc_feature (55)..(158): Pfam Name: HSP20 Pfam Description: Hsp20/alpha crystallin family
  misc_feature: Functional homolog of the protein sequence given in SEQ ID NO 51719
  misc_feature: Useful for making plants with modulated heat sensitivity
  misc_feature: Functional homolog of the protein sequence given in SEQ ID NO 51720
  misc_feature: Useful for making plants with modulated drought sensitivity
  misc_feature: Useful for making plants with modulated water use efficiency
MDARMFGLETPLMAALQHLLDVPDGEAGDKASAAGSGPTRTYVRDARAMAATPADVKELPGAYSFVVDMPGLGTGDIKVQVEDERVLVISGERRREEREEAKYLRMERRMGKFMRKFVLPDNADMDKISAMCKDGVLTVTVEKLPPPKPKKPKTIEVKVASEDHAVVASAEVKSEQCQ

SEQ ID NO: 46407 - DNA, 736 bp, Panicum virgatum
  misc_feature: Ceres CLONE 2030466
  misc_feature: Encodes the peptide sequence at SEQ ID NO. 46408
gcagcgaccagagcccggcgccccggcccaatcagccagccaaagccctcttcgactcacccgacgccgcgccgggagcgggagcggccaccgcgccggcacccgcgtaaatccggagcgcgcgcgccccccggcgatgcgccgctccccgcgctcgtgacgcatggcctcgctctccgctcctcccgcgctcccgagagcttcgtcggtggtggtgggcgcggcgagggggaggagggccgcggtgcgggtgcgcactgccgccacggcattgggcggggggtgcggcggcggcggcggcggaatggagcagcacctcggggacggcccgcgcagcccagtgaaggagaagcctgtaatgtcaaacattgggaaatcaactaatattctatggcatgattgcccgattggacaatcagatagacagatgttgctgggacaaaaaggctgtgttgtatggatcacaggactcagtggttcagggaaaagtactcttgcttgtgcattgagtcgggagttgcattacagaggccacctcacatatgtccttgatggtgacaacctcaggcatggtctaaatcgagatttaagcttcaaggcagaagaccgtgcagaaaatatacgaagagttggagaagtggcaaagctttttgcggatgctggtatcatatgcattgctagcttgatatctccgtacaggagagatcgtgatgcatgccgtgctctactttccgga

SEQ ID NO: 46408 - protein, 190 aa, Panicum virgatum
  misc_feature: Ceres CLONE 2030466
  misc_feature (94)..(190): Pfam Name: APS_kinase Pfam Description: Adenylylsulphate kinase
  misc_feature: SWISSPROT Homolog: EC 2.7.1.25 Adenylyl-sulfate kinase
MASLSAPPALPRASSVVVGAARGRRAAVRVRTAATALGGGCGGGGGGMEQHLGDGPRSPVKEKPVMSNIGKSTNILWHDCPIGQSDRQMLLGQKGCVVWITGLSGSGKSTLACALSRELHYRGHLTYVLDGDNLRHGLNRDLSFKAEDRAENIRRVGEVAKLFADAGIICIASLISPYRRDRDACRALLS

SEQ ID NO: 46409 - DNA, 487 bp, Panicum virgatum
  misc_feature: Ceres CLONE 2030473
  misc_feature: Encodes the peptide sequence at SEQ ID NO. 46410
gtccccgacggccgaccatttcctgtcatctcctctcctctccctcgctttcccacctccatccacccgccgcgcctcgaccccgcgccgccgcatctccggcgagatgtcgcgcttcgggcgatccggcccgccgccaatccgcgacacctactccctcctcgtcctcaacattaccttccgaacgaccgctgatgacctcttccctctattcgacaagtatggcgaggtcgtcgacatctacatccccagggaccgcaggactggtgactcccgagggttcgcgttcgtgaggtacaagtacgaggacgaggcgcagaaggcagttgataggctcgatgggagagtggtagacgggagagagatcatggtgcagtttgccaaatatggcccaaatgctgaacggattaataaagggagaatagtggagccactaccaaggtcaagaggccgttccagaagccacagtccaagacggcgtaatttt

SEQ ID NO: 46410 - protein, 126 aa, Panicum virgatum
  misc_feature: Ceres CLONE 2030473
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGPPPIRDTYSLLVLNITFRTTADDLFPLFDKYGEVVDIYIPRDRRTGDSRGFAFVRYKYEDEAQKAVDRLDGRVVDGREIMVQFAKYGPNAERINKGRIVEPLPRSRGRSRSHSPRRRN

SEQ ID NO: 46411 - DNA, 692 bp, Panicum virgatum
  misc_feature: Ceres CLONE 2030480
  misc_feature: Encodes the peptide sequence at SEQ ID NO. 46412
gctccccattactccgcagtcgagcaagcaagagcgaggcgagcgtcccgatccgtcaatggcgtctcctgctcccgtcaagaaggtgctggtgccgatcgccgccggctccgagcccgtggaggcgaccgtccctatcgacgtcctccgccgcgcgggcgcccacgtcaccgtcgcggccgcgggcggcctgctcgtccacgccatgtacggcgtcaagatcgtcgcggacgccaccgtcgcctactgcgccgacgcgtcctacgacctcgtcgccctccccggagggatccccggcgcggccaacctcggcgactgcgccgcgctggagagcatcgtgaggaggcacgcgctcaagggccggctctacgccgccatctgcgccgcgccgccgctggccttggcgcgctggggcctgctcaacggcctcaagcaggcaactgctcatccggcgttcgtcgacgagttcccggccgaggtgacccccctggacgccaacgtggtggtcgacggcaaggtcgtcacagcccgtgggccggcgatggcgatggagttcgctctcgccttggtggaacagctctacgggaaggacaaagttgaccagattgccaaaccaatgcttgtcagatatgaacctgggtataccttcaaggaactcaacccgatccaatggcaatgcaacggcacgccca

SEQ ID NO: 46412 - protein, 211 aa, Panicum virgatum
  misc_feature: Ceres CLONE 2030480
  misc_feature (36)..(175): Pfam Name: DJ-1_PfpI Pfam Description: DJ-1/PfpI family
MASPAPVKKVLVPIAAGSEPVEATVPIDVLRRAGAHVTVAAAGGLLVHAMYGVKIVADATVAYCADASYDLVALPGGIPGAANLGDCAALESIVRRHALKGRLYAAICAAPPLALARWGLLNGLKQATAHPAFVDEFPAEVTPLDANVVVDGKVVTARGPAMAMEFALALVEQLYGKDKVDQIAKPMLVRYEPGYTFKELNPIQWQCNGTP

SEQ ID NO: 46413 - DNA, 715 bp, Panicum virgatum
  misc_feature: Ceres CLONE 2030481
  misc_feature: Encodes the peptide sequence at SEQ ID NO. 46414
gaaccatccaaaccctccggccaccatcggtgtcgcggaaggccagagtgagtcgatccaaggcggcgcgctgcaggacgccgacgcggcgggatcaaggaagcaaggaaccagggcaagcgagcgaggttctcataggctccgacgaccgccatggacatggcctccgcgtccgcgcccagcacctcctcccacaacatctccctggcgcaggccgtgctgacactctccatcaacgccgtcctcgtcttcctcaccgccgtcatcaagtccgccacctcctcctcatcgtcctcgtcccgcggccgcgaggctgcccccgctcctgctcctgcggccgccgccgcacccgcatcgccggctccggctaagcccgccgccgccgcggccgctggcgcgatcgacatggacgtggtgctcggggtgatgggcgccggcggcgccgccgtgtcggtggggttcgaggaggccgcggcgctgttcgacgaggaggaggcgaccgtggaggaggcccgcgccgcgttcgcggtcttcgaccgcgacggcgacgggttcatcgacgccgcggagctccggagcgtgctcgggtcgctcgggctcggcgccggcgccggcgccgcggagtgccagcgcatgatcgacgcgtacgacgaggacagggacggcaggatcgacttcagcgagtttcgtcagctcatggagacgagctcgtgag

SEQ ID NO: 46414 - protein, 102 aa, Panicum virgatum
  misc_feature: Ceres CLONE 2030481
  misc_feature (73)..(101): Pfam Name: efhand Pfam Description: EF hand
  misc_feature (35)..(63): Pfam Name: efhand Pfam Description: EF hand
MDVVLGVMGAGGAAVSVGFEEAAALFDEEEATVEEARAAFAVFDRDGDGFIDAAELRSVLGSLGLGAGAGAAECQRMIDAYDEDRDGRIDFSEFRQLMETSS

SEQ ID NO: 46415 - DNA, 741 bp, Panicum virgatum
  misc_feature: Ceres CLONE 2030494
  misc_feature: Encodes the peptide sequence at SEQ ID NO. 46416
gaacgggtggccctcctgcatgctgtcctgatggccccgtcttctctgacgctcctcctcctctccctcctgaccctgacgacgtcgtcctccgccaccaccgccggagacgacggcgacggcctcacgcacatccacctctacgtgcacgagacgtacaccggcccgaacgccacggcggccgccgtgctgcagtccccgctcggcgccaactcgtcgttcgggagcatcggggtggtggacgacgagctgcgcgccgggccggaccgcgcgtccccgctcctcggccggtaccaggccgtcttcttcggcacgagcttgcaggcgggcgcggggtacctgtcctccgtcacgctcgtgttcaccgccggcgagtacgccgggagcacgctctcggtgcagggccccgtgctcgggttcgcgggcaccatcgagcgcgccgtcgtcggcggcaccggcaggtttaggctcgcccgcgggtacatgctcttcaagatggtcagcaagcccacgccggagacggacgtcaacgaggtccacctcttcgtgctcatgcaccatggcaagtactagccttgctgctgctctttctgtctcgatgtctgccactccaacaagtactgtttcttgatctgttcttgtcgaactactgtactgtgcgtatgtgcaggatcacatttcatctgtaataaaggtttaatttagatgctcatagggggtaaatttgcgctcgtgcgttca

SEQ ID NO: 46416 - protein, 180 aa, Panicum virgatum
  misc_feature: Ceres CLONE 2030494
  misc_feature (10)..(175): Pfam Name: Dirigent Pfam Description: Dirigent-like protein
MAPSSLTLLLLSLLTLTTSSSATTAGDDGDGLTHIHLYVHETYTGPNATAAAVLQSPLGANSSFGSIGVVDDELRAGPDRASPLLGRYQAVFFGTSLQAGAGYLSSVTLVFTAGEYAGSTLSVQGPVLGFAGTIERAVVGGTGRFRLARGYMLFKMVSKPTPETDVNEVHLFVLMHHGKY

SEQ ID NO: 46417 - DNA, 553 bp, Panicum virgatum
  misc_feature: Ceres CLONE 2030507
  misc_feature: Encodes the peptide sequence at SEQ ID NO. 46418
gcagaactcagaacagccgagaaacacacacgactagcctgaatcaataatcatcggagcgaagcaacagcaatcccagactcccagtctcccgcgtcactcaaacaccaagcaaccacccaccgatcgacaatgtcactgatccgccgcagcaacgtgttcgaccccttctccctcgacctatgggatcccttccaaggattccccttcggctccggcagcggaagcagcaacctcttcccctcgtatgcaggcaccaactctgagaacgcaggcttcgtcggcgcccacgacgactggaaggagacccaggaggcgcacgtgttcagggcggacgtcccggggctgaagaacgaggaggtcaaggtggaggtcgaggaccgcaacctgctccaaatcaacggcgagcgcaacagggagcacgaagagaacgacaagtggcacatggtggagcgcaacagcgggaagttcctgcgccggtgcaagatgccagaaaacgcccagacggagcagatcagcgcgtccatggagaatggcgtgctcaccgtcaccg

SEQ ID NO: 46418 - protein, 140 aa, Panicum virgatum
  misc_feature: Ceres CLONE 2030507
  misc_feature (55)..(140): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFQGFPFGSGSGSSNLFPSYAGTNSENAGFVGAHDDWKETQEAHVFRADVPGLKNEEVKVEVEDRNLLQINGERNREHEENDKWHMVERNSGKFLRRCKMPENAQTEQISASMENGVLTVT

SEQ ID NO: 46419 - DNA, 699 bp, Panicum virgatum
  misc_feature: Ceres CLONE 2030517
  misc_feature: Encodes the peptide sequence at SEQ ID NO. 46420
cttttggcgtatccgtgagggtatatcagaggcgtctgtcaaagttggagctgtgtacaaatatgacttgtccatacctgtagagaagctctatgatattgttgaagaaatgcgctgtcgtcttggtgataatgcagaggtgttgggctatggccaccttggagatgggaatctgcatttaaacatcctatcaagcaaatacgacgacagtattcttacacaaattgaaccatttgtctatgagtggacttcagcacaaagaggaagcatcagtgcagagcatggtttgggcctaatgaaagcagagaagattcactacagcaaatcaaccgaagcagtgcaactaatggcctccatcaagaagttgctggaccccaattcaatcctgaacccctacaaggttctgccacagtctgtactgtagctaaaggttaggacccgtaactcactgagcttgtagctgagcagagctgcttgatacttgactgagctgagcagagctgcatgatgcttgactgagctgagaggaggcaaagtgaatagttgatgcgaacacggttatcataatatcatgggattatgggaagcatgctgtggtttctactctgatggtaccagtaggttaacagatcgcatgccctcaactgcacctcgtcgaaaggcagctgaaataagtctggagaacttttatccaaaaag

SEQ ID NO: 46420 - protein, 140 aa, Panicum virgatum
  misc_feature: Ceres CLONE 2030517
  misc_feature (1)..(134): Pfam Name: FAD-oxidase_C Pfam Description: FAD linked oxidases, C-terminal domain
  misc_feature: SWISSPROT Homolog: EC 1.1.2.4 D-lactate dehydrogenase (cytochrome)
FWRIREGISEASVKVGAVYKYDLSIPVEKLYDIVEEMRCRLGDNAEVLGYGHLGDGNLHLNILSSKYDDSILTQIEPFVYEWTSAQRGSISAEHGLGLMKAEKIHYSKSTEAVQLMASIKKLLDPNSILNPYKVLPQSVL

SEQ ID NO: 46421 - DNA, 705 bp, Panicum virgatum
  misc_feature: Ceres CLONE 2030526
  misc_feature: Encodes the peptide sequence at SEQ ID NO. 46422
aggaagcaaccgacccaatccaatcccaatcccagaagaggggatggtgggcaagggcgaggccccggctccgcgtgagcccgaggaggaggacaccggaggcgtcgtcaagctcatcagcgccgagggtttcgagttcgtcgtcgataagaaggcagccatggtctccaacaccctgcgcaacatgctcacgtcgccaggcggcttctccgagacgcgccagggcgaggtccgcttcccggagatctctacccacatcctcgagaagatctgccagtacttctactggtcgctccactactccagtgggaaggagacagcggagttcccaattgagcccgagataaccctggatctgatgatggcagcgaactacctggacacatgaggtggaggaagatgagggagaaactgttgcgctgcaatggatgaaatcatcccaacctcatcgtgtttacatccaccagatgtgaatttttcttctttttccatggatccgatacaatctgatctgactcggtgctgtgtaatgaagaagtgtaagcatcgaatgggacgtgtaaaatgtgtgcaagtagttttctaatccacctgcagtgtgtaacagcctgcgactgctgatgcccaagacatatcaaagagaaaaaaaacaatcttttagcaccttgttttgctgtgggactaattgaatcctcccttcccctg

SEQ ID NO: 46422 - protein, 114 aa, Panicum virgatum
  misc_feature: Ceres CLONE 2030526
  misc_feature (20)..(82): Pfam Name: Skp1_POZ Pfam Description: Skp1 family, tetramerisation domain
MVGKGEAPAPREPEEEDTGGVVKLISAEGFEFVVDKKAAMVSNTLRNMLTSPGGFSETRQGEVRFPEISTHILEKICQYFYWSLHYSSGKETAEFPIEPEITLDLMMAANYLDT

SEQ ID NO: 46423 - DNA, 751 bp, Panicum virgatum
  misc_feature: Ceres CLONE 2030531
  misc_feature: Encodes the peptide sequence at SEQ ID NO. 46424
ctcttcaaacaaagagacacatcgccgcctgcgtcgaagcaatccttctcctctagtcgtcctccgcctcatcccctttgctggcctgtggtggagcggaggtgcatccgcagttggattggtttcttctttcgttgacttgtgttcccagcgaggctaaggacacaccttgagggctaagacaggatgcctaagataaagacaagccgtgttgaatatcctgcgggatgggatattattgagccaacaattcgtgagctggatgcaaaaatgagagaagctgaaaatgatccacatgatggaaagaggaagtgcgaagcgctctggccgattttccgaatttctcatcagagaagtcgctacatatacgatcttttctacagaaagaaggagatatcgaaggagctgtatgagttttgcctgaaccagggttatgcagaccgtaatctgattgcaaagtggaaaaagccgggttatgaacgcctttgttgcctgcgctgcatacagacacgtgaccacaacttcgcaactacttgtgtctgccgggtccccaagcacctcagggaggagcaagtcatagaatgtgtccattgcggctgcaggggatgtgccagcggtgactaatcttgtcattatgttgttttggtcatggatcatcatcacaatccaaccacttgagatgtctcatgagcatgggacaaaggagtgcgtgcgctgcctagtgaagtgattcacttgaaatgattttaac

SEQ ID NO: 46424 - protein, 145 aa, Panicum virgatum
  misc_feature: Ceres CLONE 2030531
  misc_feature (1)..(143): Pfam Name: G10 Pfam Description: G10 protein
MPKIKTSRVEYPAGWDIIEPTIRELDAKMREAENDPHDGKRKCEALWPIFRISHQRSRYIYDLFYRKKEISKELYEFCLNQGYADRNLIAKWKKPGYERLCCLRCIQTRDHNFATTCVCRVPKHLREEQVIECVHCGCRGCASGD

SEQ ID NO: 46425 - DNA, 737 bp, Panicum virgatum
  misc_feature: Ceres CLONE 2030534
  misc_feature: Encodes the peptide sequence at SEQ ID NO. 46426
gctcttctcccgcgaccttttcacagcgcagaaatatctcctctcctcgccttcgcttccatttccacccagcagccacagcagcaagtatcccaacagattccctccgcgatccgccacttgtccgggcgattccagctcccgatcgcgcgaatcgagttcgttcttggccgcaggagccgggttctggccgcaatcgggtggttcgttctcgaccggaggggaggcagctcaatcgggggttcttggtttccgcgggccgagtcctcgggcggcggctgcggccatggagccgtcggcggcggccgcgggcattgtgaaggaggagctcctggagcagcagccgctgcaggacggcgtgcgcggcggggacgcgccgcgcccgatggaggggctgcacgaggtcggccccccgccgttcctgaccaagacgttcgacctggtggaggacctggccaccgacgcggtcgtctcctggagccgcgccggcaacagcttcgtcgtctgggacccgcacgtcttcgccgacgcgctgctcccgcgcctcttcaagcacagcaacttctccagcttcgtccgacagctcaacacctatgtgagtccgcaaagcccaaagccccctttctttcctcactatggaatggtcgcttcttgttcttgctcacggcctgctaatgctgatgtactagtttggtaatctgcgtttgattgtcggcatttgttgggtgcaaactatt

SEQ ID NO: 46426 - protein, 136 aa, Panicum virgatum
  misc_feature: Ceres CLONE 2030534
  misc_feature (43)..(134): Pfam Name: HSF_DNA-bind Pfam Description: HSF-type DNA-binding
  misc_feature: The sequence is a functional homolog of SEQ ID NO 1686 in the 10/412,699 US patent application
MEPSAAAAGIVKEELLEQQPLQDGVRGGDAPRPMEGLHEVGPPPFLTKTFDLVEDLATDAVVSWSRAGNSFVVWDPHVFADALLPRLFKHSNFSSFVRQLNTYVSPQSPKPPFFPHYGMVASCSCSRPANADVLVW

SEQ ID NO: 46427 - DNA, 671 bp, Panicum virgatum
  misc_feature: Ceres CLONE 2030540
  misc_feature: Encodes the peptide sequence at SEQ ID NO. 46428
ccaaaccctcgccgccgccgctgctgctgccaagcacatcgcacccggcgcgacaccccccggcgagagcccaccccccatcccacccaaccatggcggaccgcggaggcgagagaggcggcgagcgcggcggcttcggccgcgggttcgggcgcggcgggcgcggcgaccgcggcgggcgcaggggcggccggcgcggcgggcgccagcaggaggaggagaagtgggtgcccgtgactaagctcgggcgccttgtcaaggagggcaggatcaagcagatggaggagatctacctccactcgctccccgtcaaggagcaccagatcgtggaggccctcctcccggggctcaaggacgaggtcatgaagatcacgccggtgcagaagcagacgcgcgccgggcagcgcacgcgcttcaaggccttcgtcgtcgtcggcgacggcaacggccacgtcgggctcggggtcaagtgcgccaaggaggtcgccaccgccatccgcggcgccatcatcctcgccaagctctcggtcgtgcccgtcaggaggggctactgggggaacaagatcggccagccgcacaccgtgccgtgcaaggtcaccggcaagtgcggctccgtcaccgtgcgcatggtgccggcgcccagggggtccgggatcgtcgccgcgcgcgtg

SEQ ID NO: 46428 - protein, 192 aa, Panicum virgatum
  misc_feature: Ceres CLONE 2030540
  misc_feature (85)..(151): Pfam Name: Ribosomal_S5 Pfam Description: Ribosomal protein S5, N-terminal domain
MADRGGERGGERGGFGRGFGRGGRGDRGGRRGGRRGGRQQEEEKWVPVTKLGRLVKEGRIKQMEEIYLHSLPVKEHQIVEALLPGLKDEVMKITPVQKQTRAGQRTRFKAFVVVGDGNGHVGLGVKCAKEVATAIRGAIILAKLSVVPVRRGYWGNKIGQPHTVPCKVTGKCGSVTVRMVPAPRGSGIVAAR

SEQ ID NO: 46429 - DNA, 527 bp, Panicum virgatum
  misc_feature: Ceres CLONE 2030544
  misc_feature: Encodes the peptide sequence at SEQ ID NO. 46430
atatcacaggttcctctcaccattcaccaatttgcctccttttctgttcctctcttgacgggggttctaggcctctgggcaccgccctcagtgtcgaccatgaccgccgataccacgacgcctgaggagcagctcctcgccttgctggaggagcacaatatccaagaaggagatgacctgcttgttgaggatgagggtgatgatgaagatgacgatgatgaggatgacatggatgatgatgatgctgagggagttgatgctagtgagagatctaaggccagccccagtgagaaaaagagcaggaaggcgatgaagaacgttgccatgaaggcgatcactggtgtcagccgtgttactgtcacgaagagcaagagtatgctctgtgtcatctcggaaccagatgtcttcgagagccctgcatcagacacctacgtgatctttggggaggctaagattgaggacctgagttcacagcgacaaacaccggctgcagagcggttcacggcaccatacatgagcagcgtcct

SEQ ID NO: 46430 - protein, 142 aa, Panicum virgatum
  misc_feature: Ceres CLONE 2030544
  misc_feature (62)..(121): Pfam Name: NAC Pfam Description: NAC domain
MTADTTTPEEQLLALLEEHNIQEGDDLLVEDEGDDEDDDDEDDMDDDDAEGVDASERSKASPSEKKSRKAMKNVAMKAITGVSRVTVTKSKSMLCVISEPDVFESPASDTYVIFGEAKIEDLSSQRQTPAAERFTAPYMSSV

SEQ ID NO: 46431 - DNA, 784 bp, Panicum virgatum
  misc_feature: Ceres CLONE 2030546
  misc_feature: Encodes the peptide sequence at SEQ ID NO. 46432
agcaagtccagcaaacaaactccgaagcgactgacgatcagaggcgtctttcagagcgcagcagttcgccgacaaatccccactccgaccttcaatcccgatcatcattcaacgacaatgtcgctgatccgccgcagcaacgtgttcgaccccttctccctcgacctctgggaccccttccagggcttccccttcggctccggcagcggcagcctcttcccgcgcatctcctccgactccgacgccgcggcgttcgctggtgcgcgcatcgactggaaggagacccccgaggcccacgtgttcaaggcggacgtgccggggctgaagaaggaggaggtggaggtggaggtcgaggacggcaacgtgctccagatcagcggcgagcggagcaaggatcaggaggagaagaacgacaggtggcacagggtggaacgcagcagcggcaagttcctgcgcaggttcaggctgccggggaacgccaagacggagcagatcaaggcctccatggaaaacggcgtgctcaccgtcaccgtgcccaaggaggaggtcaagaagcccgaggtcaagcccgtccagattaccggctaaaaaagaacgcgtcatggggattcagaggaagatccgattacctgtgcagactaccgtccgtcgtgtgtctgtcgttttgaagtttcagggtgtgtagtctggttctgtaaatctatttcgccaagagttcctagtgtctcggcgtgccactctccatagatgctatcgagacgtcttgtggctctgaggtctgtgt

SEQ ID NO: 46432 - protein, 156 aa, Panicum virgatum
  misc_feature: Ceres CLONE 2030546
  misc_feature (52)..(155): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFQGFPFGSGSGSLFPRISSDSDAAAFAGARIDWKETPEAHVFKADVPGLKKEEVEVEVEDGNVLQISGERSKDQEEKNDRWHRVERSSGKFLRRFRLPGNAKTEQIKASMENGVLTVTVPKEEVKKPEVKPVQITG

SEQ ID NO: 46433 - DNA, 510 bp, Panicum virgatum
  misc_feature: Ceres CLONE 2030553
  misc_feature: Encodes the peptide sequence at SEQ ID NO. 46434
tgatgaattggagtttctgattgtagctagtgatgggctgtgggaccgggttccgaatgaggatgcggtttcacttgtgaagatggaggaggaaccagaggcagcagcccggaagctgacagagactgcattctcccgcgggagcagcgataacatcacgtgcatagttgtgaaattccagcacaacaagccgagcggtgattctccctcgccttcgggcgacaagagttgattccatttgttcgttatacatgttgtcggtcctttcaccttaagccggattttcctggcccccatccatggtgatccccttatagcggcacggctggtatatatgcccccctaattttggtcctcccggtgggttacaggtcgcagtgctatttacagatacgttcaccactggttctccctgcactgcattgctgtagtagttgctgttgtattaatgactgttaggaagggaagtcccaaatgccagataccggtgtcgtcgaggcttttccacgc

SEQ ID NO: 46434 - protein, 76 aa, Panicum virgatum
  misc_feature: Ceres CLONE 2030553
  misc_feature: SWISSPROT Homolog: EC 3.1.3.16 Phosphoprotein phosphatase
DELEFLIVASDGLWDRVPNEDAVSLVKMEEEPEAAARKLTETAFSRGSSDNITCIVVKFQHNKPSGDSPSPSGDKS

SEQ ID NO: 46435 - DNA, 835 bp, Panicum virgatum
  misc_feature: Ceres CLONE 2030554
  misc_feature: Encodes the peptide sequence at SEQ ID NO. 46436
tgctccgtcaccgcgaggcaccaccgccggcgccgccaacgcgaggatggctgcttccgccggcgaggctgccgacggaacgactccggaggcaccctcgcctttctccgaggactggagggagcggatcatcatcccggtcgccgccgccggggttcttggagccgcgttcgggctgctgtcgcggcaccgggcgcgccttggagccgcccgcgccgctgtcacctacgccgctaaccttgccatcgtcgccgggtgctacggaggagcacgtgaactcgcaagagatgctcgagccacaacacccaatgatcccatgaattctgttgttggtgggctagcaagtggagctgttctcggtcgaatacaaggtggacacttcggagcagtgaagtatgcagtcacctttgcagctgctggtaccgcgttggattacgccgcgctgaagctggcccctgaatggcatgcatggaaagaacagttctctggaaagaaagactggtttacactacccgagtggtcaccgatccaagtgttgtatgaggaagctttggctaagaaaaaagctcgagaggaaaagctgttcgctcagcgagcactgggtaaacttgacaaggaggatccctagatacactgcattttggaggaccacttaccaatgatttttaggtgctatatctttttgtctctgaaaccgtagtgttagaaaacattgagatctgtatttttccttttcctgtactttgggcgtttggggatgcctatgaaagaggtaggcgccgtacctccaggttttgacggctaaaaacatctctgcaaatgcttgtactttgtc

SEQ ID NO: 46436 - protein, 193 aa, Panicum virgatum
  misc_feature: Ceres CLONE 2030554
  misc_feature (17)..(135): Pfam Name: Tim17 Pfam Description: Tim17/Tim22/Tim23 family
MAASAGEAADGTTPEAPSPFSEDWRERIIIPVAAAGVLGAAFGLLSRHRARLGAARAAVTYAANLAIVAGCYGGARELARDARATTPNDPMNSVVGGLASGAVLGRIQGGHFGAVKYAVTFAAAGTALDYAALKLAPEWHAWKEQFSGKKDWFTLPEWSPIQVLYEEALAKKKAREEKLFAQRALGKLDKEDP

SEQ ID NO: 46437 - DNA, 633 bp, Panicum virgatum
  misc_feature: Ceres CLONE 2030562
  misc_feature: Encodes the peptide sequence at SEQ ID NO. 46438
gatgaaatactttcttccctagaccgagtaaatatcagccatggacttctgtatggtcgtgtcaattcagattctcagcctcatcgagatccatatagcaaatggtacataacccctgaggaatggcctgaggagagttatcctccatgggcacatggaccaggatacattgtttcacaggatgtagcaaaggaagtttacaggaagcacaagaggggggaattaaagatgttcaagctggaggatgtcgcaatggggatatggatcaatgagatgaagaaggatggattgaatgtcaaatatgagaatgatgggaggatcttggtcgaaggctgtgaggatgggtatgtgattgcccactaccaagaaccaagggatatgatgtgcctctgggacaaatttcaggaaacaaaacgaggaacatgttgcaaagagtaacagaactaacgaaaagtagcccttcatcctacggtggtggctgctgttggccgttgcctgaacccaaaccttcgcgcaatgacaatcttgacacatccctatctataaggacttgcagaacttggaaggctacaaagttttggatatcttccagtttagttttgttcacagttggaagaatttcaagtctaacta

SEQ ID NO: 46438 - protein, 145 aa, Panicum virgatum
  misc_feature: Ceres CLONE 2030562
  misc_feature: SWISSPROT Homolog: EC 2.4.1.134 Galactosylxylosylprotein 3-beta-galactosyltransferase
DEILSSLDRVNISHGLLYGRVNSDSQPHRDPYSKWYITPEEWPEESYPPWAHGPGYIVSQDVAKEVYRKHKRGELKMFKLEDVAMGIWINEMKKDGLNVKYENDGRILVEGCEDGYVIAHYQEPRDMMCLWDKFQETKRGTCCKE

SEQ ID NO: 46439 - DNA, 603 bp, Panicum virgatum
  misc_feature: Ceres CLONE 2030566
  misc_feature: Encodes the peptide sequence at SEQ ID NO. 46440
aaaaagaaaaaaaaacagcataggcagatatcaccgttgcaaaattggatattcgagtggggcttattacaaaagcatataagcatccagatgctgattccctttacgtagaggagatcgatgttggggaggacacaccaagaacagtggtcagtgggctcgtgaaattcatacctcttgaagaaatgcagaatcggaaagtctgtgttctctgcaacctgaaaccggtggcaatgcgcggtataaaatcacacgccatggttttggctgcatcaaatgaggaccacacgaaggttgagttggtggagccaccagaatctgctgccgagggggagcgtgtcaccttcgctgggtactcgggagatcccgaggcttccctcagtggcaagagcaagacgtgggagaagctggccgccgagctgcacagcaacggcgagctcgtggcgtgctacaaagacgtgccctttacaacctcggccggagtctgcgaggtcaagacaatagcgaacggggagattcgctaggcacatggccggaccgcaacccagctgacagaatctgtgtctggtttcattggaagtgatggttcctgattttcatttt

SEQ ID NO: 46440 - protein, 112 aa, Panicum virgatum
  misc_feature: Ceres CLONE 2030566
  misc_feature (1)..(51): Pfam Name: tRNA_bind Pfam Description: Putative tRNA binding domain
  misc_feature: SWISSPROT Homolog: EC 6.1.1.1
MQNRKVCVLCNLKPVAMRGIKSHAMVLAASNEDHTKVELVEPPESAAEGERVTFAGYSGDPEASLSGKSKTWEKLAAELHSNGELVACYKDVPFTTSAGVCEVKTIANGEIR

SEQ ID NO: 46441 - DNA, 709 bp, Panicum virgatum
  misc_feature: Ceres CLONE 2030576
  misc_feature: Encodes the peptide sequence at SEQ ID NO. 46442
gctcttctcccgcgacccgacccttttcacggcgcagaaatatctccccctccccttccctccccttggcttccatttccaccgccacagcagcaggtatctatccccctccgcgattcgccacttgtccgggcggttccagctcccgatcgcgcgaatcgagtccgttcttggccgcagaagccgtcgggtggtttgttttcgaccggaagcgtctcaatcgcggggttcttggtttccgcgggccgagtccttgggcgggcggcggcggcggccatggagccggcggcggcggccgcgggcattgtgaaggaggagctcctggagcagcagccgctgcaggacggcgtgcgcggcggcggcggggacgcgccgcgcccgatggaggggctgcacgaggtcgggcccccgccgttcctgaccaagacgttcgacctggtggaggacccggccaccgacgccgtcgtctcctggagccgcgccggcaacagcttcgtcgtctgggacccgcacgtcttcgctgacacgctgctcccgcgcctcttcaagcacagcaacttctccagcttcgtccgacagctcaacacctatgtgagggatccgtgaggtgttggctaacctctccatgctgactgacaaagaagtcctacagacacagaacagagaagacatacagctgttatcagctcttatccagtagctcttacaa

SEQ ID NO: 46442 - protein, 109 aa, Panicum virgatum
  misc_feature: Ceres CLONE 2030576
  misc_feature (45)..(109): Pfam Name: HSF_DNA-bind Pfam Description: HSF-type DNA-binding
  misc_feature: Functional homolog of the protein sequence given in SEQ ID NO 50267
  misc_feature: Useful for making plants with modulated heat sensitivity
  misc_feature: The sequence is a functional homolog of SEQ ID NO 1685 in the 10/412,699 US patent application
  misc_feature: The sequence is a functional homolog of SEQ ID NO 1686 in the 10/412,699 US patent application
  misc_feature: Functional homolog of the protein sequence given in SEQ ID NO 50697
  misc_feature: Useful for making plants with modulated biomass
  misc_feature: Functional homolog of the protein sequence given in SEQ ID NO 50268
  misc_feature: Useful for making plants with modulated low light sensitivity
  misc_feature: Useful for making plants with modulated nitrogen use efficiency
  misc_feature: The sequence is a functional homolog of SEQ ID NO 1805 in the 10/374,780 US patent application
MEPAAAAAGIVKEELLEQQPLQDGVRGGGGDAPRPMEGLHEVGPPPFLTKTFDLVEDPATDAVVSWSRAGNSFVVWDPHVFADTLLPRLFKHSNFSSFVRQLNTYVRDP

SEQ ID NO: 46443 - DNA, 659 bp, Panicum virgatum
  misc_feature: Ceres CLONE 2030577
  misc_feature: Encodes the peptide sequence at SEQ ID NO. 46444
acaccaaccagcaaccaccgccgcctccatcgccaccatgcagcagcagcagccgcgccgccgcgcctccccggccgcgtcgtcgctctgacgtgccggaggctttggcttggagctagctagcccgaccgacgcgccaagcagcagggaccgatcgatcgatgggggttcacctgcagctgctgaagaagcagccgtcgtcggcgtcgctggggggctcgagcagcggcggggggtcgtcgtcgacgtcgtcgccgatgccgcccaaggggtgcatggcggtgcgcgtggtggggcccggcggggaggaggaggaggaggagcggttcgtggtgccggtgggctacctgaagcacccgctgttcgtggcgctgctcaaggcggcggaggacgaatacggcttcgagcagaagggcgccatcaccatcccctgcggcgtcgaccacttccgccgcgtccagggcatcatccaccaccagaagcacaaccaccaccacatctccggcggagccgccggccaccatgcccaccacaacaacaaccaccacttccacatcgcgggctgcttccgcgcctgatgcgatgcatgcgggaagcagaagggagatccatgcatcatgcccgtggatggatagtagatcttgcggccgcgccgccgg

SEQ ID NO: 46444 - protein, 138 aa, Panicum virgatum
  misc_feature: Ceres CLONE 2030577
  misc_feature (4)..(104): Pfam Name: Auxin_inducible Pfam Description: Auxin responsive protein
  misc_feature: Functional homolog of the protein sequence given in SEQ ID NO 51721
  misc_feature: Useful for biocontainment applications
  misc_feature: Useful for making plants with modulated cold sensitivity
MGVHLQLLKKQPSSASLGGSSSGGGSSSTSSPMPPKGCMAVRVVGPGGEEEEEERFVVPVGYLKHPLFVALLKAAEDEYGFEQKGAITIPCGVDHFRRVQGIIHHQKHNHHHISGGAAGHHAHHNNNHHFHIAGCFRA

SEQ ID NO: 46445 - DNA, 496 bp, Panicum virgatum
  misc_feature: Ceres CLONE 2030626
  misc_feature: Encodes the peptide sequence at SEQ ID NO. 46446
aagcagctcaaagcagcagagtactctttctctgctccttcttcagcttctacgcaggcctctgcaggcgcgaggaagaagcagcagcgcagaaggcgatcgccatggctcagggaaggggcagtgcgacgacacggtgcctcgccgtcggcggcctgctcgccgtgtgcctcctcctcggcgccgccgacgcggccacccacagggtcgactggtcgttcaacgcggacagctggtgccggggcaagagcttccgcgccggggacgtcctcgagttcaactacgacccctccgtgcacaacgtggtggccgtggacgccggcggctactccggctgcggcttctccggcagcggcagggcatacagctccgggagcgaccgcatcacgatcggctccgggaccagctacttcatctgcagcctcaacgggcactgcgggatggggatgaagatggccgtccacgccagctgaaggctgaagcccccccccccccc

SEQ ID NO: 46446 - protein, 122 aa, Panicum virgatum
  misc_feature: Ceres CLONE 2030626
  misc_feature (37)..(115): Pfam Name: Cu_bind_like Pfam Description: Plastocyanin-like domain
MAQGRGSATTRCLAVGGLLAVCLLLGAADAATHRVDWSFNADSWCRGKSFRAGDVLEFNYDPSVHNVVAVDAGGYSGCGFSGSGRAYSSGSDRITIGSGTSYFICSLNGHCGMGMKMAVHAS

SEQ ID NO: 46447 - DNA, 256 bp, Panicum virgatum
  misc_feature: Ceres CLONE 2030626-R
cccccccccccccccccccccccccgctgcttgcagagcaccaataataagcgatgcgtgtcactggcggtccggtcgtgcaacaactcaatcgttttggcagcgccgatacaggtctcatgtgtcatgtatgtgtgtagtggagtggtagttgaggcatggtgtgtgtatggttactggcagggcagtgaagcgttactcagcttttgttgtttgtttgaactttgatgaagcagtagactcttttctttgtttc

SEQ ID NO: 46448 - DNA, 672 bp, Panicum virgatum
  misc_feature: Ceres CLONE 2030660
  misc_feature: Encodes the peptide sequence at SEQ ID NO. 46449
gccacatcgcagaacgcaaagcagcataggaagaaccagcagagctctcgccacccacaatcctccatcgagttgcagcgagctgcagcagcgtccagcgaggagggagtaagaaaggaagccatgacggagctgttcgacacggccgtgaccagcctcctccacctgccggaggttctcgaccgcctcgccgcagcggacggcgaccgccgctccggcggccaccacggcgcgcaccaccacggcgcgcacgcgcgcgtccacggccttggcgccggcgccggcggcgcgccggtggacatcgtggagactcccggcgagtacaccttcctgctcgacgtccccggtctctccaagtccgacatccaggtgacgctggaggaggaggaccgggtgctggtgatgaagggcggcggcggcggcggcggcggcaacaacaacaacaacgggaagcggaagcgcgaggaggaggagggcgaggggtgccgctacatctgcctggagcggcgcgcgtcgccgcggtcgttcgtgcgcaagttccggctgccggaggacgcggacgtgggcggcatcgcggcgcgctgcgagaacggggtgctcaccgtcaccgtgaagaagcagccgccgccggagaagaagaccaagtccgtgcaggtcaccatcgcctgagct

SEQ ID NO: 46449 - protein, 181 aa, Panicum virgatum
  misc_feature: Ceres CLONE 2030660
  misc_feature (59)..(179): Pfam Name: HSP20 Pfam Description: Hsp20/alpha crystallin family
MTELFDTAVTSLLHLPEVLDRLAAADGDRRSGGHHGAHHHGAHARVHGLGAGAGGAPVDIVETPGEYTFLLDVPGLSKSDIQVTLEEEDRVLVMKGGGGGGGGNNNNNGKRKREEEEGEGCRYICLERRASPRSFVRKFRLPEDADVGGIAARCENGVLTVTVKKQPPPEKKTKSVQVTIA

SEQ ID NO: 46450 - DNA, 864 bp, Panicum virgatum
  misc_feature: Ceres CLONE 2030661
  misc_feature: Encodes the peptide sequence at SEQ ID NO. 46451
attttcctcctcctcccccacctgctctcccccgtccaccctccacgcccgcgagcccgccgcccccgtcgcatgccgccatggaccgcgccgacgctggcggcagcagtagcattagcgaccccgacgcgccctactccgcggcggccgcgctgctgctggagcccaagctcgaggacgaggagctgccgctgcggcagctggcgtcgccgggccccttcgtgcccctggaccagctgatgccgccggcggccgagccgccgcgcccgctcgaggcgctgctgcagggcccgcagctgccgccgttcctctccaagacctacgacctggtgagcgagccggcgctggacggggtcatctcctggggcgccgcggggaacagcttcgtcgtgtgggacccctccaccttcgcgcgcgacgtgctgccgcacaacttcaagcacaacaacttctccagcttcgtcaggcagctcaacacctatgtgcgtacacaatccttccttccttcctttctcctccctcacgagtcacgatccgtcgctctgttcttgaaatgctctatcactctgctcgcgacatgctctgcttgggacgaaaaaatcatggtcccttgtttctggtatttatgatcttgggtgcctaagattccccctgccgtgtagattgccgatgatgaagaccctgctgccgacttgttctttttttttttcctgtgcgattctcttggttattggtgttgtatcgtgtggacctttgtaaaatctggcctgtaaatggagtgtgtatactttactacctttcttttctgagcggaatcgcaagatatatgtaatacaaacctgcccgagtgataatataaactgg

SEQ ID NO: 46451 - protein, 182 aa, Panicum virgatum
  misc_feature: Ceres CLONE 2030661
  misc_feature (74)..(178): Pfam Name: HSF_DNA-bind Pfam Description: HSF-type DNA-binding
MDRADAGGSSSISDPDAPYSAAAALLLEPKLEDEELPLRQLASPGPFVPLDQLMPPAAEPPRPLEALLQGPQLPPFLSKTYDLVSEPALDGVISWGAAGNSFVVWDPSTFARDVLPHNFKHNNFSSFVRQLNTYVRTQSFLPSFLLPHESRSVALFLKCSITLLATCSAWDEKIMVPCFWYL

SEQ ID NO: 46452 - DNA, 560 bp, Panicum virgatum
  misc_feature: Ceres CLONE 2030665
  misc_feature: Encodes the peptide sequence at SEQ ID NO. 46453
actccgaatcgactgacgatctcaggcgtctttcacagcgcaccacttggcctacaaatccccacgccgaccttcactcccgatcatctttcctcgagactgtcgctgatccgccgcagcaacgtgttcgaccccttctccctcgacctctgggaccccttccagggcttccccttcggctccggcagctgcctcctccttccgcgcatctcctccgactccgacgcctcgttcgctggtgcgtgcatcgactgcaaggacacccccaaggcccacgtgttcggggatgacgtgccggggctgaagagggacgaggtgaatgtggaggtctacgacggcaacctgctcctgatcgtcatccagcggagctgggagcaggacgagaagatcgactggtggcacacggaggaactcagcagcggcaagttcctaggcaggttaaggctgccggataacgccaagaccgagcatatcaaggcctccatggagagcggtgtgctcaccgtcaccgcgcatacagaggaggacaataatcccgatgtcgagctcgtccagattag

SEQ ID NO: 46453 - protein, 186 aa, Panicum virgatum
  misc_feature: Ceres CLONE 2030665
  misc_feature (84)..(184): Pfam Name: HSP20 Pfam Description: Hsp20/alpha crystallin family
TPNRLTISGVFHSAPLGLQIPTPTFTPDHLSSRLSLIRRSNVFDPFSLDLWDPFQGFPFGSGSCLLLPRISSDSDASFAGACIDCKDTPKAHVFGDDVPGLKRDEVNVEVYDGNLLLIVIQRSWEQDEKIDWWHTEELSSGKFLGRLRLPDNAKTEHIKASMESGVLTVTAHTEEDNNPDVELVQI

SEQ ID NO: 46454 - DNA, 773 bp, Panicum virgatum
  misc_feature: Ceres CLONE 2030674
  misc_feature: Encodes the peptide sequence at SEQ ID NO. 46455
aaaaaaaaaaaatcgcggcgtaccaagcgaagacacaccagcaagagcacaaagcaagcggcagctttgatccgcgcatagctttgcgaccttaatccggcggggttgttgatcacctgatcttcttctgctcgatcgcgtgaagggcggaggcacttccttggatcggcgacggcgatgtcgaagggagccgcggcaatcgcgctcgcgtgcctcgccgtgatggcggcggcggtggcggacggcgcgctgctcccgtggttcggcgacggcaggcgcgggcgcgacgaggccacggcggcggcggcggccgtgtcgccgctgtccgacctgggcctcctggcggacccgttccggatcctggagcacgtgcccttcggcttcgaccgcgacgacgtggccatggtgtccctggcgcgcgtggactggcgcgagacccccgacgcgcacgagatcgtcatcgacgtgcccgggatgcgcagggaggacctcaagatcgaggtcgaggacaaccgggtgctgcgggtgagcggcgagcggcggcgcgcggaggagcagaggggcgaccactggcacagcgaggagcgctcctacggcaggttctggcgccagttccgcctccccgagaacgccgacctcgactccgtcgccgccagcctcgacaacggcgtgctcgccgtgcggttcaggaagctggcgcccgagcagatcaagggcccgcgcgtcgtcggcatctccggcgggggacggcgacgccaagagcagcatcggcg

SEQ ID NO: 46455 - protein, 198 aa, Panicum virgatum
  misc_feature: Ceres CLONE 2030674
  misc_feature (83)..(187): Pfam Name: HSP20 Pfam Description: Hsp20/alpha crystallin family
MSKGAAAIALACLAVMAAAVADGALLPWFGDGRRGRDEATAAAAAVSPLSDLGLLADPFRILEHVPFGFDRDDVAMVSLARVDWRETPDAHEIVIDVPGMRREDLKIEVEDNRVLRVSGERRRAEEQRGDHWHSEERSYGRFWRQFRLPENADLDSVAASLDNGVLAVRFRKLAPEQIKGPRVVGISGGGRRRQEQHR

SEQ ID NO: 46456 - DNA, 1210 bp, Panicum virgatum
  misc_feature: Ceres CLONE 2030680
  misc_feature: Encodes the peptide sequence at SEQ ID NO. 46457
gactccaccacagaagcggcggcgcggcggagggtgtagagggggcgaaggcgagggcgcggggaagggagaggagcaccagcaatggtgcacgtcagcttctaccgtaactatggtaagacattcaagaagccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcgctgctccgccgcatgaaccgctatgggctgcttgctgagggtcagaacaatcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccgtcattcatggtgagggtggagtctgagaagcacattgacttttcactgtcaagcccattcggcggaggtcccccaggcagggtgaagaggaagaaccagaagaaggcaagcggtggtggcggcgacggcggcgatgaggacgaggagtgaggatgaaccctccccgcaaccgcgccgccgccgccgctacaaccgcgcgcctcgcttcctctcccgtcgccgagatgacgaagcgcaccaagaaggccggaattgttggcaaatatggaactcggtatggtgctagcttgcgtaagcaaatcaagaagatggaggtatctcagcactccaagtacttctgcgagttctgtgggaagtttgctgtgaagaggaaagcagttggaatttggggatgcaaggactgtgggaaggtcaaggctggtggtgcttataccatgaacactgctagtgccgtcactgtcaggagcacaatccgtcgcttgagggagcagactgaagcgtaattgtagctcttctcatcaggcatcatggggttctctatttgaatgactatatgctgtttagccgagaacatgctccagtatttttggtttttgctttaggatatctgaaagtgtggtgctaagatttgtacttggttgccattatgactttgacaagtgatatttgatgctatgcccatccttat

SEQ ID NO: 46457 - protein, 195 aa, Panicum virgatum
  misc_feature: Ceres CLONE 2030680
  misc_feature (7)..(108): Pfam Name: Ribosomal_S4 Pfam Description: Ribosomal protein S4/S9 N-terminal domain
  misc_feature (109)..(156): Pfam Name: S4 Pfam Description: S4 domain
MVHVSFYRNYGKTFKKPRRPYEKERLDAELKLVGEYGLRCKRELWRVQYALSRIRNAARHLLTLDEKNPRRIFEGEALLRRMNRYGLLAEGQNNLDYVLALTAENFLARRLQTLVFKAGMAKSIHHARVLIKQRHIRVGRQIVNVPSFMVRVESEKHIDFSLSSPFGGGPPGRVKRKNQKKASGGGGDGGDEDEE

SEQ ID NO: 46458 - DNA, 723 bp, Panicum virgatum
  misc_feature: Ceres CLONE 2030687
  misc_feature: Encodes the peptide sequence at SEQ ID NO. 46459
acgcaacgcaatcttgcaatccagcccccgaaagagacctaaaaaccgccaccaggctttcgatcgcgccgagggaggaggacgagcaatggcggccgaggagggagtcgtgatcgcgtgccacaccaaggaggagttcaagaaccagatgaacaaggccaaggatgccggcaagctggtgatcattgacttcactgcctcctggtgtggtccttgccgcatcatcgccccggtgtttgctgaattagccaagaagttcactgacgctttcttcctgaaggtcgatgttgacgagctgaaggaagtagcctcagagtacgagatccaggcgatgccgaccttcctcttcattaagaacggtgagaagatccacactgttgttggtgccaggaaggaggacctccagaccagcatcgagaagcacgcctccgccactgctgcttccgcctccgcctaaggcaatagcgccaccagttatcaataagggccagcccacggcgtggtagcagtaggcgtcgtaattttcagtttggtttgggtgaattgtgagctatgttcaaatctggagtcctgatatgtttggttcctgtgctggacctgttatcgtcctgaatacctgtgttgatatggatgctttgtgactgaaagtttgaatatgggttgtctgactatattcctgcggtcgtgccccaaactccggcaattctgtgattctaaagttgg

SEQ ID NO: 46459 - protein, 122 aa, Panicum virgatum
  misc_feature: Ceres CLONE 2030687
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAAEEGVVIACHTKEEFKNQMNKAKDAGKLVIIDFTASWCGPCRIIAPVFAELAKKFTDAFFLKVDVDELKEVASEYEIQAMPTFLFIKNGEKIHTVVGARKEDLQTSIEKHASATAASASA

SEQ ID NO: 46460 - DNA, 701 bp, Panicum virgatum
  misc_feature: Ceres CLONE 2030722
  misc_feature: Encodes the peptide sequence at SEQ ID NO. 46461
agagtgaaaagcaggatctgtttcaagttctgtaacctctgcttcagccatgaagaggaaggagctgatgatcgtgcacggccttctgattcttggatggttcatagcctctgcagctggccgcatcgcaccgcaggagaaggcggagtcggtgaccccgataccgacgctgtcgccgccagaaggcaacacgacgttcatcaacggcgtgacgtggtgcgtggcccggccgggcgcctcccaggaggacctccagaacgcgctggactgggcgtgcggccccggcggcgccgactgctcccagctgcagccgggcggccggtgctaccagccgaacacgctcctcacccacgcctcctacgccttcaacatcttctaccagcagaacggcaactccgacatcgcctgcaacttcggcggcgccggagccctcgtcaagcgggacccgagttttggatcatgcaagttcctggcatctgagacttctgcagcagcttcctcggcgatgttgggaagggcgtggacggccatggtcgctgcatctctgatcgcgcttcggctgatagtttaggaattctccattcgtgatgtagacacggtctcttgcgtgaaggttgagggctcacgattcctttgttttggatctcgtaaactatcattatgtttttgtatggctattttattattttatttaatggact

SEQ ID NO: 46461 - protein, 173 aa, Panicum virgatum
  misc_feature: Ceres CLONE 2030722
  misc_feature (55)..(140): Pfam Name: X8 Pfam Description: X8 domain
  misc_feature: SWISSPROT Homolog: EC 3.2.1.39 Glucan endo-1,3-beta-D-glucosidase
MKRKELMIVHGLLILGWFIASAAGRIAPQEKAESVTPIPTLSPPEGNTTFINGVTWCVARPGASQEDLQNALDWACGPGGADCSQLQPGGRCYQPNTLLTHASYAFNIFYQQNGNSDIACNFGGAGALVKRDPSFGSCKFLASETSAAASSAMLGRAWTAMVAASLIALRLIV

SEQ ID NO: 46462 - DNA, 839 bp, Panicum virgatum
  misc_feature: Ceres CLONE 2030725
  misc_feature: Encodes the peptide sequence at SEQ ID NO. 46463
ggcctccttccctgtgctgtgcggtgacttgtcctgtaccgggctgttgactggaggagggatccattcgtccgcacctctcttcttttgctgcatcatgtcggagacgaaggactccaactctgctgctcttgatggaaatcctgaacctatggatcaaagtgaagacaattctatgccgtcagctcagcaacaggaagaagcaatcaagaagaagtttggtggactaatgcccaaaaagccaccactcatctcaaaggatcatgagcgggcctactttgattctgctgattgggctctaggaaagcaaggtgttgccaaacccaaaggaccactggaggcacttaggccaaagctgcagccaacacgtcaacagcaacaacaacgtgcaaggcgctctatttacacttcgtcagaaaacgaggacggtgacagcgctggtgctgaggatatgagcatcaactgaagtggccctggaatctgcacgacgtgctgcgttgttggagaattcagttacttcaagcaggcagcccgctttcggtcgtcgtgtggattgattcgtataagaaaatcctcattatcaagtgttgcgttgcatttcccccattgaaggacagaggtgatccatgcatctccacatgagaatgagatgatggtgtacaaggttaattagttcagcatttggcatgagatagcctatgatatcattatactgcatatttgtttgtggataaatatatgctgcgtgtttcgttgagcatgtatgaatgaaattatcgatgacggtggtggagctgcagacctgcagtaacatgatggctggaccaatcataccaatc

SEQ ID NO: 46463 - protein, 122 aa, Panicum virgatum
  misc_feature: Ceres CLONE 2030725
  misc_feature (38)..(121): Pfam Name: Lg106 Pfam Description: Lg106-like protein
  misc_feature: Functional homolog of the protein sequence given in SEQ ID NO 50181
  misc_feature: Useful for biocontainment applications
MSETKDSNSAALDGNPEPMDQSEDNSMPSAQQQEEAIKKKFGGLMPKKPPLISKDHERAYFDSADWALGKQGVAKPKGPLEALRPKLQPTRQQQQQRARRSIYTSSENEDGDSAGAEDMSIN

SEQ ID NO: 46464 - DNA, 655 bp, Panicum virgatum
  misc_feature: Ceres CLONE 2030745
  misc_feature: Encodes the peptide sequence at SEQ ID NO. 46465
tcgccccccttcttctccaagcctctctctcgtctctcccatctcttcctcggcgtgccccacatcgcaacgggggaccttgttcgcgacgagctcgcctccaccgggccacttgctgcgcagcttgctgaaattgttaaccaggggaaattggtttctgatgagattattatcaatctattgtccaaaaggcttaaaaaaggagaagacaagggagaatctggatttattcttgatggttttccacgtacagtaaaacaagcggaaattcttgatggagttacggacatcgatatggtggttaatctaaaactgagggaagatatcttagtagaaaagtgccttggtaggaggatttgcagccagtgcggaaagaacttcaatgtggcttgcattgatgttaagggtgaaaacgggttaccagcaatctacatggcaccattattacccccaaataactgcatgtcgaagatgatcacccgagctgatgatactgaagaggtggtcaggaatcggcttcagatctataatgacatgagtcaacctgtggaggatttctaccgggagcaggggaagctcttggaatttgacttgcctggagggatccctgaatcttggccaaagcttctccatgttctgaatcttgaagaccaag

SEQ ID NO: 46465 - protein, 218 aa, Panicum virgatum
  misc_feature: Ceres CLONE 2030745
  misc_feature (17)..(192): Pfam Name: ADK Pfam Description: Adenylate kinase
  misc_feature: SWISSPROT Homolog: EC 2.7.4.3 Adenylate kinase
SPPFFSKPLSRLSHLFLGVPHIATGDLVRDELASTGPLAAQLAEIVNQGKLVSDEIIINLLSKRLKKGEDKGESGFILDGFPRTVKQAEILDGVTDIDMVVNLKLREDILVEKCLGRRICSQCGKNFNVACIDVKGENGLPAIYMAPLLPPNNCMSKMITRADDTEEVVRNRLQIYNDMSQPVEDFYREQGKLLEFDLPGGIPESWPKLLHVLNLEDQ

SEQ ID NO: 46466 - DNA, 721 bp, Panicum virgatum
  misc_feature: Ceres CLONE 2030746
  misc_feature: Encodes the peptide sequence at SEQ ID NO. 46467
caaaaaaaaaaaaaaaaaaactctccatgcaagaaaaggagaaaaatcaaatcaggagacggggattcgagagagctccgcccggtagggggaagggaagagaaggcgaaggggaggagcgaggaggtgccgaggcaggatgggggcggtcgagtccgtgccggagacctccatacacgaattcaccgtcaaggattgcatcggcaaggaagtgagcctggagacctacaaggggaaggtcctcctcgttgtcaacgtcgcctccaaatgtgggttcacggagaccaattacacgcagctgacggagctttatcagaagtacagggacaaagactttgagatattagcattcccctgcaatcagttcttgcggcaagagccagggactgctgagcaggcaaaagactttgcttgcaccagatttaaagcagaatacccagtttttcagaaggtgcgtgtaaatggtccagatgctgcgccggtctacaagtttctgaaagcgagcaagcctggtttgtttgggtcaagaatcaaatggaattttactaagtttctcgtcgacaaaaatgggaaggtcattgaaagatatgcaacttcgactgctccaatgtcaattgagaaggacatccagaaggcccttgaggaatagatctcatgtcctctaatctcatccatcacccacttgcagaagtaggcgcttgcaaaaaatatattccattgt

SEQ ID NO: 46467 - protein, 169 aa, Panicum virgatum
  misc_feature: Ceres CLONE 2030746
  misc_feature (12)..(120): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Functional homolog of the protein sequence given in SEQ ID NO 50170
  misc_feature: Useful for making plants with modulated flowering time
  misc_feature: Functional homolog of the protein sequence given in SEQ ID NO 50171
  misc_feature: Useful for making plants with modulated nitrogen use efficiency
MGAVESVPETSIHEFTVKDCIGKEVSLETYKGKVLLVVNVASKCGFTETNYTQLTELYQKYRDKDFEILAFPCNQFLRQEPGTAEQAKDFACTRFKAEYPVFQKVRVNGPDAAPVYKFLKASKPGLFGSRIKWNFTKFLVDKNGKVIERYATSTAPMSIEKDIQKALEE

SEQ ID NO: 46468 - DNA, 647 bp, Panicum virgatum
  misc_feature: Ceres CLONE 2030753
  misc_feature: Encodes the peptide sequence at SEQ ID NO. 46469
gcgtcagttcccaattgctcatagtgcggcgcaacgccatccggagtaaagctaccccgcttccggaaactcttgatcagtggtgctcaattcaatggcttccttggcgtctcgcttgcctctggcagtgctgctgctcgtggcctgctcctccacggctgccgccagcacctacaccgtcggcgacggctccggctggaccaccggcgtcgactacacctcgtgggccgcctcaaaaaacttcaaggtcggcgacaatctcgtgttcaactacgcgaaaggtctgcacacggtggtggaggtgagcgcggccgagtacatggcgtgcacggcggccagcccgctgggctccgacagcagcggcgcgaccacggtgcccctcaagacgcccggcacccactacttcgtctgcagcatcacgggccactgcgccgccgggatgaagctcgccgtgaccgtcggcggctcctcctcccccgccacgccgacgccgacgaccccaaggacgtcgccaacccccaccacgccctacacgacgccggcgactccgaccaccacgccgtacacgacgccgaccaccaccacgccgtacacgacgccgacgaccccgacgtgctccggaggcggaggcaccacgacaacaaccc

SEQ ID NO: 46469 - protein, 184 aa, Panicum virgatum
  misc_feature: Ceres CLONE 2030753
  misc_feature (35)..(116): Pfam Name: Cu_bind_like Pfam Description: Plastocyanin-like domain
MASLASRLPLAVLLLVACSSTAAASTYTVGDGSGWTTGVDYTSWAASKNFKVGDNLVFNYAKGLHTVVEVSAAEYMACTAASPLGSDSSGATTVPLKTPGTHYFVCSITGHCAAGMKLAVTVGGSSSPATPTPTTPRTSPTPTTPYTTPATPTTTPYTTPTTTTPYTTPTTPTCSGGGGTTTTT

SEQ ID NO: 46470 - DNA, 361 bp, Panicum virgatum
  misc_feature: Ceres CLONE 2030766
  misc_feature: Encodes the peptide sequence at SEQ ID NO. 46471
acagaaggacccagcagagaggatgtctgcttcagaactcttgaatcaccctttcatcaagaagtttgagggtaaggatttagacctgcagactctggtggagagcctggaacctccgatgaacatacccgagtagagagccattaggatggatcgacaatccttttgcaatgtattcagggtcaccgtgatggccttttgacatccgcacatatttttcctgaacagcgtgcatcgcgtccctaaacgcgagatgctgtgtgtatgtttttgaccgtgtcaaaaaaaactcccatggatcattgtggcacccaagttttccttgtggcgagtatttctcttgataaggctgtccatatat

SEQ ID NO: 46471 - protein, 44 aa, Panicum virgatum
  misc_feature: Ceres CLONE 2030766
  misc_feature: SWISSPROT Homolog: EC 2.7.12.2 Mitogen-activated protein kinase kinase
QKDPAERMSASELLNHPFIKKFEGKDLDLQTLVESLEPPMNIPE

SEQ ID NO: 46472 - DNA, 440 bp, Panicum virgatum
  misc_feature: Ceres CLONE 2030776
  misc_feature: Encodes the peptide sequence at SEQ ID NO. 46473
tatgacttcccaggctatatagatgcacaagaccgggtggatgcagcctacaaggataagaagaaatggatcaagatgtccatcttgaacactgctgggagtggcaagttcagcagcgaccgtaccatcgcccagtatgccaaggagatctgggacatcaagcctagccctgttgcgtgaaagaataggtcgatgcagccaacaccaaatgccgtccgtcggatgatgctataataataaggttgaataatgacccacggtgcatgacaccggcttccgtttgtagctgggaggcaaggaacggcgcacgaagcctgttctaccgcgcgctgtgcttatttcgaagtgcgtgctatacgcaattttttttctttgtctgggacaagatcattttgctctatgttggaatactccgtcatgaaataaaataattcaaagtt

SEQ ID NO: 46473 - protein, 59 aa, Panicum virgatum
  misc_feature: Ceres CLONE 2030776
  misc_feature: SWISSPROT Homolog: EC 2.4.1.1 Phosphorylase
YDFPGYIDAQDRVDAAYKDKKKWIKMSILNTAGSGKFSSDRTIAQYAKEIWDIKPSPVA

SEQ ID NO: 46474 - DNA, 989 bp, Panicum virgatum
  misc_feature: Ceres CLONE 2030777
  misc_feature: Encodes the peptide sequence at SEQ ID NO. 46475
aatccatcgaaaccccggcaaactccctaatcccctcccctggggccgtcgagatgctcccttcctccattggctcagctcccgccgcgccgttcgccgctccaagagccatgccctgcttgctgcttccagctccgtcgcctcgcctctgtctaattgccttgctgcgtcggccaccgcgctgctgcaaagatcggttcttgctgccccgtatccggaggcggccaaggctgcggcggcttggcttgcgcatggccgagatggtcagggttgggagcggcggggagccgttgccggaggtcggggtttccgtggagagtgacccgatgctgggaggggaggagtcgcccggccagagaagggaggcgagccggtgggcgcccgtcgaggaggcgctgaaccgtatgagtaaatggctggtggccggttgttttactttagcagctctttggaagcatgatgctgaaattatctggatttcgttgggtgccgttgccaactctctgctttcagtgattctgaaaaggatgctaaaccatgaaagaccttcatcagctttgcggtctgatcctgggatgccatcgtcccatgcacaatccattttctatgcggtgatcgtcctaattctttcgttgtactactggaatgggacaaattatctaaccgtgattcttgggcctgcaactctgtcagtggccgcctatctgtcatggttacgggtgtcccagcgccttcatacactaaaccaggtcatggtgggagctgctgtaggatctgcctttggtactctatggtttttgctctggcattcacttgtgcaggaggcattcgctgcttcactgttggtccgggttgtggtcatcctcggatcatgtgtattttgtgttggctttgtcatctacatgatacgtcattggctcaaggatgagtgattgtacttcatagctgcaagcctgcgatgggagattgattgataggcattacgaacc

SEQ ID NO: 46475 - protein, 273 aa, Panicum virgatum
  misc_feature: Ceres CLONE 2030777
  misc_feature (119)..(237): Pfam Name: PAP2 Pfam Description: PAP2 superfamily
  misc_feature: SWISSPROT Homolog: EC 3.6.1.43 Dolichyldiphosphatase
MPCLLLPAPSPRLCLIALLRRPPRCCKDRFLLPRIRRRPRLRRLGLRMAEMVRVGSGGEPLPEVGVSVESDPMLGGEESPGQRREASRWAPVEEALNRMSKWLVAGCFTLAALWKHDAEIIWISLGAVANSLLSVILKRMLNHERPSSALRSDPGMPSSHAQSIFYAVIVLILSLYYWNGTNYLTVILGPATLSVAAYLSWLRVSQRLHTLNQVMVGAAVGSAFGTLWFLLWHSLVQEAFAASLLVRVVVILGSCVFCVGFVIYMIRHWLKDE

SEQ ID NO: 46476 - DNA, 577 bp, Panicum virgatum
  misc_feature: Ceres CLONE 2030785
  misc_feature: Encodes the peptide sequence at SEQ ID NO. 46477
gcaggggtacaaagaaaagctcgttgatatcagagaagaaattctccgcaagcgcagagctggtaaacttcctggggataccgcatccatattgaaggcttggtggcaggctcattccaagtggccatacccaactgaagacgacaaggctcgactggtgcaggaaacaggattacagctgaagcagatcaacaactggttcattaaccaacgcaaacggaactggcacagtaacccaacatcctctggtgaaaagaccaagaagaaaaggtgagggcggccgaagcaatattgacgaggctagatatacacagtactatactttattggcacgcacgttcgccctcactctagagatttggagacctacctgttgggagggaactttatggagtaatgaagatacgggtcacccggggaccttagctgtcacctaatgccctagtttgaccacgtggtggaagtggatgttggtaatgacttttgcagtatagcgtttgctaatgtgatatggtgaatcatgtgttgtatggccgacggaacgggaggcagtaatttatgttgtattgtacttgtg

SEQ ID NO: 46477 - protein, 90 aa, Panicum virgatum
  misc_feature: Ceres CLONE 2030785
  misc_feature: The sequence is a functional homolog of SEQ ID NO 710 in the 10/374,780 US patent application
  misc_feature: The sequence is a functional homolog of SEQ ID NO 711 in the 10/374,780 US patent application
  misc_feature: Functional homolog of the protein sequence given in SEQ ID NO 50864
  misc_feature: Useful for making plants with altered lignin content
  misc_feature: Useful for making plants with altered sterol content
  misc_feature: Useful for making plants with altered terpenoid content
  misc_feature: Useful for making plants with modulated flowering time
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 713 in the 10/374,780 US patent application
  misc_feature: The sequence is a functional homolog of SEQ ID NO 712 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: The sequence is a functional homolog of SEQ ID NO 709 in the 10/374,780 US patent application
  misc_feature: Functional homolog of the protein sequence given in SEQ ID NO 50865
  misc_feature: Useful for making plants with altered carbohydrate content
  misc_feature: Functional homolog of the protein sequence given in SEQ ID NO 50866
  misc_feature: Useful for biocontainment applications
  misc_feature: Useful for making plants with modulated biomass
  misc_feature: The sequence is a functional homolog of SEQ ID NO 200 in the 10/225,066 US patent application
  misc_feature: The sequence is a functional homolog of SEQ ID NO 2334 in the 10/374,780 US patent application
  misc_feature: The sequence is a functional homolog of SEQ ID NO 272 in the 10/412,699 US patent application
  misc_feature: The sequence is a functional homolog of SEQ ID NO 601 in the 11/479,226 US patent application
  misc_feature: The sequence is a functional homolog of SEQ ID NO 2674 in the 10/374,780 US patent application
  misc_feature: The sequence is a functional homolog of SEQ ID NO 76 in the 10/225,066 US patent application
QGYKEKLVDIREEILRKRRAGKLPGDTASILKAWWQAHSKWPYPTEDDKARLVQETGLQLKQINNWFINQRKRNWHSNPTSSGEKTKKKR

SEQ ID NO: 46478 - DNA, 739 bp, Panicum virgatum
  misc_feature: Ceres CLONE 2030789
  misc_feature: Encodes the peptide sequence at SEQ ID NO. 46479
atcgagcagagcacgcagacagagcaaacgcatacaaccttcagcaatccactcgcactcgaccgcgctcagtcacctaaccgacgacgatgtcgctggtgaggcgcagcaacgtgttcgaccccttcgccgacttctgggaccccttcgacggcgtcttccgctccctggtcccgtccgtcgcgccgtcgggccgcgacaccgccgccttcgccaacgcgcgcatcgactggaaggagacccccgaggcgcacgtcttcaaggccgacctccccggtgtcaagaaggaggaggtcaaggtcgaggtggaggacggcaacgtcctggtcatcagcggcgagcgcagtaaggagaaggaggacaagaacgacaagtggcaccgcgtcgagcgcagcagcggcaagttcctccgccggttccgcctgccggagaacgccaagacggacgaggtgaaggccgggctggagaacggcgtgctcacggtcaccgtgcccaaagccgaggtcaagaagcctgaggtgaaggccatcgagatctccagttaagcaaccctggtccctggacgtgggaagaagctgtgatgatgatgctccggttctggtcgtgatcggttgatgtctgtgtcatgcataagcataacctgctgcctgcaatcagtgttctctgtatgtaatcatgcatgttgagcatatatgaaagtaaataaagcactactcctgcatccagcatccttttctgg

SEQ ID NO: 46479 - protein, 151 aa, Panicum virgatum
  misc_feature: Ceres CLONE 2030789
  misc_feature (47)..(150): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFADFWDPFDGVFRSLVPSVAPSGRDTAAFANARIDWKETPEAHVFKADLPGVKKEEVKVEVEDGNVLVISGERSKEKEDKNDKWHRVERSSGKFLRRFRLPENAKTDEVKAGLENGVLTVTVPKAEVKKPEVKAIEISS

SEQ ID NO: 46480 - DNA, 720 bp, Panicum virgatum
  misc_feature: Ceres CLONE 2030797
  misc_feature: Encodes the peptide sequence at SEQ ID NO. 46481
acacacaatcacacaacaaagactctcatcagtggccagtaagtcttcagttcttcactgatcagtgccaaccgacttgcttgttgccacgatggttgtcggcaaagtcacactggagtacccggtggccgtgtcggtcgagctgctgtggaaggtggcgttctccggcgacgtgtccatcttcaccaaggcctgcgtcggcatgattgacgccgtggaggtcgatggcgacggcgggcctgggaccgtcaccaccatgaagctcaaccctgccgtgggcgacgcgaaggtgttcaagacccggctcctgtcacgtgatgcggtggcacgtgtcgtgaagtcggagatggtggtggagggcagcgagctgtccgtgcagttcaagtcgcaggtgtccgaggtgaaggtggtgccggccggcgagtgtgctagcatggtgcacatgacggtggagtacgaacgggtggacggtgcgctgctgccgccggaggaggaggccaggattgggcagggctacctcggcctcatcaagaaggtggaggagtacctcgtcgcgcaccccaccgagttcgcctaaagctaccataagcatcgtcggggcgatggagccagagaaatccgtgttaaataatgatggtgattgcatatgggtgtgttcttgatttgaaaatcggaataacaagagggagtgatcctctgcctggtcggttgattgtgctt

SEQ ID NO: 46481 - protein, 161 aa, Panicum virgatum
  misc_feature: Ceres CLONE 2030797
  misc_feature (1)..(156): Pfam Name: Bet_v_I Pfam Description: Pathogenesis-related protein Bet v I family
MVVGKVTLEYPVAVSVELLWKVAFSGDVSIFTKACVGMIDAVEVDGDGGPGTVTTMKLNPAVGDAKVFKTRLLSRDAVARVVKSEMVVEGSELSVQFKSQVSEVKVVPAGECASMVHMTVEYERVDGALLPPEEEARIGQGYLGLIKKVEEYLVAHPTEFA

SEQ ID NO: 46482 - DNA, 676 bp, Panicum virgatum
  misc_feature: Ceres CLONE 2030809
  misc_feature: Encodes the peptide sequence at SEQ ID NO. 46483
acacacacaagcacacaacaaagactctcatcactgaccagtacgtcttcagttcttcactgatcagtgtcaaccgacttgttgccacgatggttgtcggcaaagtcacactggagtacccggtggccgtgtcggtcgagctgctgtggaaggtggccttctccggcgacgtgtccatcttcaccaaggcctgcgtcggcatgattgatgccatcgaggtcgacggcgatggtgggcccgggagcgtcaccaccatgaagctcaaccctgccgtgagcgacgcgaaggtgttcaagacccggctcctgtcccgcgatgcggcggcgcgcgtggtgaagtcggagatggtggtggagggcgagttggccgggaagttcaagtcgcaggtgtccgaggtgaaggtggtgccagccggcgacggcgccagcgtggtgcacatgacggtggattacgagcgggtggacggcacgctgctgctgccggaggaggaggccaggatagggcagggctacctcggcctcatcaagaaggtggaggagtacctcgtcgcgcaccccagtgagttcgcctaaagctaccatgagcatcgtccgtgttaaataaatcaaatgatggtgatcatggcatcatgtcattgccatgggtgtgttcttgatttcaaaatcggaataacgag

SEQ ID NO: 46483 - protein, 160 aa, Panicum virgatum
  misc_feature: Ceres CLONE 2030809
  misc_feature (1)..(155): Pfam Name: Bet_v_I Pfam Description: Pathogenesis-related protein Bet v I family
MVVGKVTLEYPVAVSVELLWKVAFSGDVSIFTKACVGMIDAIEVDGDGGPGSVTTMKLNPAVSDAKVFKTRLLSRDAAARVVKSEMVVEGELAGKFKSQVSEVKVVPAGDGASVVHMTVDYERVDGTLLLPEEEARIGQGYLGLIKKVEEYLVAHPSEFA

SEQ ID NO: 46484 - DNA, 771 bp, Panicum virgatum
  misc_feature: Ceres CLONE 2030829
  misc_feature: Encodes the peptide sequence at SEQ ID NO. 46485
cctgctaaactgagattgtcctcttcagctgtgagggttcctagggctacttcccctgcggctgttgaggatgggagcaacactgatacagaccctatcccgaaagttataatagatcaagactcagatccggatgcaaccattgtagaagtaaccttgggtgaccgtcttggcgatcttgttgatacaatgagtgccctgaagaacttagggctaaatgttgttaaagctagtgtctgcctcgattctaccggcaagcataacaagttttctataactaaatcgtccactggccgcaaaattgatgacccagagttgttagaagcagtacgattgacgatcattaacaacatgatacaatatcatccggagtccagcagtcaattggctatgggagcaacatttgggccagaagcccctgcagagcaggtcgatgtggacatagcaacccacatagatatctacgatgatggccctgaaagaagcttacttgtggtggaagccgcagatcgtccagggttacttgttgatcttgttaaggccatctccgataccaacgggctactggctaaagcaaaattccatgtcagttataggggcagagctttgagcaagactttgcaacaggttctttctaatagcttgcgctatttcttgaggcggccgacaacagaagatgccagcttctagccagatgaccatgaatgccccgcctcagtcatttactgaatttgtgtgatgggattcacatgaattcgatagtatgtagaa

SEQ ID NO: 46485 - protein, 229 aa, Panicum virgatum
  misc_feature: Ceres CLONE 2030829
  misc_feature: Functional homolog of the protein sequence given in SEQ ID NO 50834
  misc_feature: Useful for making plants with altered alkaloid content
  misc_feature: Useful for making plants with altered lignin content
PAKLRLSSSAVRVPRATSPAAVEDGSNTDTDPIPKVIIDQDSDPDATIVEVTLGDRLGDLVDTMSALKNLGLNVVKASVCLDSTGKHNKFSITKSSTGRKIDDPELLEAVRLTIINNMIQYHPESSSQLAMGATFGPEAPAEQVDVDIATHIDIYDDGPERSLLVVEAADRPGLLVDLVKAISDTNGLLAKAKFHVSYRGRALSKTLQQVLSNSLRYFLRRPTTEDASF

SEQ ID NO: 46486 - DNA, 727 bp, Panicum virgatum
  misc_feature: Ceres CLONE 2030832
  misc_feature: Encodes the peptide sequence at SEQ ID NO. 46487
aacgccatctccaaaaccccaaaccctcgttccccttcgccattatccgaacccagaccaagcaccaagctccgaccacagagccgagccccaaatggccgccgcctcttccatgctgaccgccgcgtcgctctccttcgccgccctcccggtctcgcgcctccgagccgcccttcccaccgccgcctccttcgcggcgctgcggcgcgcggcggccgcacccgtcgtcgtgcgcgcggcggccgcctcgtccaaggccactgctgcggcggaggcggccccgaagaagaaaagggcgaccggcatcacccagcccaagcccgtctcgccggcgctgcaggcaatcgtgggcgcaccggagatcccccgcaccgaggcactcaagcgcctctgggcctacatcaagcagcacaacctccaggatcctgcagacaagaaggtggtcgtctgtgatgagaagctgaaggtcctgtttgctgggcgggagcgcgttggattcctcgagatcgccaagcttctcaacccccactttgtgaagtgaggatcctcttccatggagactggagttaccctagatggtttctagcgatctagacttttagagagtgcgtcggttggcttttgttggccctgagtttgctcgacttagtaggatcatctagcccttcgctgacaatgttagtgtgcccctgatggtggcggttatctgaattgctggttaatgtcc

SEQ ID NO: 46487 - protein, 148 aa, Panicum virgatum
  misc_feature: Ceres CLONE 2030832
  misc_feature (71)..(147): Pfam Name: SWIB Pfam Description: SWIB/MDM2 domain
MAAASSMLTAASLSFAALPVSRLRAALPTAASFAALRRAAAAPVVVRAAAASSKATAAAEAAPKKKRATGITQPKPVSPALQAIVGAPEIPRTEALKRLWAYIKQHNLQDPADKKVVVCDEKLKVLFAGRERVGFLEIAKLLNPHFVK

SEQ ID NO: 46488 - DNA, 692 bp, Panicum virgatum
  misc_feature: Ceres CLONE 2030869
  misc_feature: Encodes the peptide sequence at SEQ ID NO. 46489
agatacctcaactaacggtggagataaccagggcacttttggtgggagagtcattttggtcaaatggggtgattacactaaaagaataggaattgatggtacttctgaggcaattaaggaagctatcaaatcagcatttggacttagaacaagacgtgctttctggcttgaagatgaagatgaggttgttcgtacattggacagggatatgccaattggaacatacacacttcatcttgatgatggtgtgacaatcaaactttgcgatgctagccgcatgcagacctcggaagacaagacgttctacaccgaagaggactttcgagatttcctcacacggcgtggttggacactcctcagggagtatggtggctatagaaatgttgacagcctggatgatctccgtcctggggtgatttatcaagggttgcggtcccttggggactaattttgtgacatctgcctgggctaggcatgtatgtgtgtcagtggaagcatagtatactaccatttagtgtaatttaagtcagtccatcctttattctctgattatatgcaaagtgtaaatgtagctgatgatattgttaattagaatataaatgtagctgattatatgcaattggagtgtaagtgattctctagttaattagaatgtaaatgtggctgattatatgcaaagtgtgcattaagtg

SEQ ID NO: 46489 - protein, 148 aa, Panicum virgatum
  misc_feature: Ceres CLONE 2030869
  misc_feature: The sequence is a functional homolog of SEQ ID NO 414 in the 10/412,699 US patent application
  misc_feature: The sequence is a functional homolog of SEQ ID NO 46 in the 10/286,264 US patent application
  misc_feature: The sequence is a functional homolog of SEQ ID NO 963 in the 11/479,226 US patent application
DTSTNGGDNQGTFGGRVILVKWGDYTKRIGIDGTSEAIKEAIKSAFGLRTRRAFWLEDEDEVVRTLDRDMPIGTYTLHLDDGVTIKLCDASRMQTSEDKTFYTEEDFRDFLTRRGWTLLREYGGYRNVDSLDDLRPGVIYQGLRSLGD

SEQ ID NO: 46490 - DNA, 714 bp, Panicum virgatum
  misc_feature: Ceres CLONE 2030871
  misc_feature: Encodes the peptide sequence at SEQ ID NO. 46491
aagaagaaaggagagcagcagagcaacaggaaggactctgtcagatcgagccttgttctccctctcatccaagaacagcatcaaacaagaaaccagagaggtagaacagagcaagatggcctgagccaggctaagccaaacgcacgcacgctcctcctagacgcacgcacgcacgtagaggacggacgcgcaggaaggacttgcactccggcgcatgggtctcctggaccagctgtgggacgacacggtggccgggccgcgcccggactccggcctcggcaagctccgcaagtacgcctccttctcgccctcctcctcctcggtgtccgcggccgcggccgcgtcgccgcccgcggagggggcggccggcgccgtgccgccacccgtgacgcgcagcatcagcatgctccgcccctcggcgctgtccgtcgtcacgtcgccgcgcagcgagtccagctctggcgccccggactcgcccttcggcgcagcgacgacgcccaagggagagggctggaagaagctgcgccggaaaggcaggatggccgccgacggcgccgacgcccccggcacgccgaggagccccaccgtctacgactgctcgctggaccggtgaacgacagccaactgaagggcgggtcggagcacaagggccatgtgcatcctctctcagaggtcctgacgatggtgtttctgtgttttggatacgttaaaatt

SEQ ID NO: 46491 - protein, 132 aa, Panicum virgatum
  misc_feature: Ceres CLONE 2030871
  misc_feature (7)..(132): Pfam Name: Auxin_repressed Pfam Description: Dormancy/auxin associated protein
MGLLDQLWDDTVAGPRPDSGLGKLRKYASFSPSSSSVSAAAAASPPAEGAAGAVPPPVTRSISMLRPSALSVVTSPRSESSSGAPDSPFGAATTPKGEGWKKLRRKGRMAADGADAPGTPRSPTVYDCSLDR

SEQ ID NO: 46492 - DNA, 517 bp, Panicum virgatum
  misc_feature: Ceres CLONE 2030880
  misc_feature: Encodes the peptide sequence at SEQ ID NO. 46493
cagcgggagggagaggtcgtcgtcgtcggccgccgatcgattggtccagggatcgcacggtctctcgctcccctcctctcttctcgctcgctcccaggctcctcccatacagcggttacgttgattgctggtgccatggagatggaggcgaggcgggtgctgtggctggcggcggtggcgtggtgggcggcggcggtggcgcggggcgacccgcaggtgccgtgctacttcatcttcggcgactcgctcgtggacaacggcaacaacaactacatcgtggcgctggcgcgcgccaactacccgccctacggcatcgacttcgccggacgcccgtcggggcgcttcaccaacggggtcaccaccgtagacgacatcgctcaactcctgggtttcgacaacttagctcttccagaggagaccgggagtcgcacgacgacagcaccaggagcagcagcgagccatggcgtacaccgcgtgattcctccaccagtccgacgccagcttcggcgccgccgtg

SEQ ID NO: 46493 - protein, 127 aa, Panicum virgatum
  misc_feature: Ceres CLONE 2030880
  misc_feature: SWISSPROT Homolog: EC 3.2.1.51 Alpha-L-fucosidase
  misc_feature: Functional homolog of the protein sequence given in SEQ ID NO 50895
  misc_feature: Useful for making plants with modulated phosphate use efficiency
MEMEARRVLWLAAVAWWAAAVARGDPQVPCYFIFGDSLVDNGNNNYIVALARANYPPYGIDFAGRPSGRFTNGVTTVDDIAQLLGFDNLALPEETGSRTTTAPGAAASHGVHRVIPPPVRRQLRRRR

SEQ ID NO: 46494 - DNA, 742 bp, Panicum virgatum
  misc_feature: Ceres CLONE 2030885
  misc_feature: Encodes the peptide sequence at SEQ ID NO. 46495
aggcaaaaaagcccgaagtatatcgatcagaagttcagaactcagaagaagcctcttcgatcgcacaagccactcgatcccaagcactgttccaacgttcagttcaaaacaccaactcgcatcatgtcgctgatcccccgtgccaacgctttcgaccccttctccctcgacctctgggaccctttccggggcttcccgttcggtccaagcggcggcagcctgttccctcgcatcccctccgactccgagaccgcggcgttcgccggtgcgcgcatcgactggaaggagacgccggaggcccatgtcttcacggcggacgtgccggggctgaagaaggaggaggtcaaggtggaggttgaggacggcaacgtcctccagatcagcggcgagcgcagcaaggagcacgaagagaagagcgaccggtggcaccgggtggagcgcagcagcggcagcttccttcgcaggttcaggctgccggagaacgccaaggcagagcagatcaaggcgtccatggagaacggcgtgctcgccgtcaccgtgcccaaggaggagggtaagaggcccgacgtcaatcccgtccagatcaccggctaggaagggaggagcacgcgtggtctgtggagctcaagtaaccgttttggaaacgaatgcgttctgttttggtgcgctggtgtcagtttagtctgtgtggttctttttactccctccgtcctaaaataaatgccattttatgggtcaaaat

SEQ ID NO: 46495 - protein, 156 aa, Panicum virgatum
  misc_feature: Ceres CLONE 2030885
  misc_feature (52)..(155): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIPRANAFDPFSLDLWDPFRGFPFGPSGGSLFPRIPSDSETAAFAGARIDWKETPEAHVFTADVPGLKKEEVKVEVEDGNVLQISGERSKEHEEKSDRWHRVERSSGSFLRRFRLPENAKAEQIKASMENGVLAVTVPKEEGKRPDVNPVQITG

SEQ ID NO: 46496 - DNA, 720 bp, Panicum virgatum
  misc_feature: Ceres CLONE 2030888
  misc_feature: Encodes the peptide sequence at SEQ ID NO. 46497
gattttcaacaaggcacacttccatgtgtttccgctgatggtagatttattatggagacaccatatagggtagcgaaggctcctgatggaaatggtggagtatatgctgctctgaagtccaaaaagttgatggaagatatggctgcacgaggtgtgaaatatgttgattgctatggagttgataacgcactggttcgtgttgcagatccgacattcctagggtacttcattgacaaaggtgtatccgctgctgctaaagtggttaggaaggcctatccacaagagaacgttggggtattcgttcaacgaggtcgcggtggacctctctctgtagttgagtacagtgaaatggatgcagctatgactactgaaattaatcaatcaacagggcgtctccgttattgctggagcaatatctgcctgcatatgttcactttggactttttgaaccaagtggcaaacagtcttgaaaaggacagtgtatatcatctagctgagaagaagattccttccatccatgggtatacaacaggcctgaagcttgaacagtttatattcgatgctttcacttactccccatctacagcactttttgaggtcatgcgggaagaggaattcgcaccagtaaagaatgccaacggcgcaacatatgacactcctgatagcgcaaaactcatgctgctccgtctccatagcagatgggttgtcgctgctggcggc

SEQ ID NO: 46497 - protein, 239 aa, Panicum virgatum
  misc_feature: Ceres CLONE 2030888
  misc_feature (1)..(239): Pfam Name: UDPGP Pfam Description: UTP--glucose-1-phosphate uridylyltransferase
  misc_feature: SWISSPROT Homolog: EC 2.7.7.23 UDP-N-acetylglucosamine diphosphorylase
DFQQGTLPCVSADGRFIMETPYRVAKAPDGNGGVYAALKSKKLMEDMAARGVKYVDCYGVDNALVRVADPTFLGYFIDKGVSAAAKVVRKAYPQENVGVFVQRGRGGPLSVVEYSEMDAAMTTEINQSTGRLRYCWSNICLHMFTLDFLNQVANSLEKDSVYHLAEKKIPSIHGYTTGLKLEQFIFDAFTYSPSTALFEVMREEEFAPVKNANGATYDTPDSAKLMLLRLHSRWVVAAG

SEQ ID NO: 46498 - DNA, 404 bp, Panicum virgatum
  misc_feature: Ceres CLONE 2030891
  misc_feature: Encodes the peptide sequence at SEQ ID NO. 46499
aaaaaaaaatcgctctccctccccacaccaccacctcctcctccacagcaggctagccaggctttttctggggtttgcgagggggacgctccggtccggcgagaggggggagatggcggcggagcgggcgcaggggacggtcaagtggttcaacgggagcaaggggttcggcttcatcagccccgacgacggcagccaggacctcttcgtccaccactcctccgtcaaggccgacggcttccccaacctcaaggacggcgaagccgtcgagttcgccgtcggcgccgacagcgacggccgcgccaaggccatcgacgtcaccgcgcccggtaggagcacgctcaccggctggaaactcccggacagggggtactgcgcgcgcgccggctgccgcgggaaaggac

SEQ ID NO: 46499 - protein, 97 aa, Panicum virgatum
  misc_feature: Ceres CLONE 2030891
  misc_feature (5)..(72): Pfam Name: CSD Pfam Description: 'Cold-shock' DNA-binding domain
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature: The sequence is a functional homolog of SEQ ID NO 468 in the 11/479,226 US patent application
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
MAAERAQGTVKWFNGSKGFGFISPDDGSQDLFVHHSSVKADGFPNLKDGEAVEFAVGADSDGRAKAIDVTAPGRSTLTGWKLPDRGYCARAGCRGKG

SEQ ID NO: 46500 - DNA, 604 bp, Panicum virgatum
  misc_feature: Ceres CLONE 2030897
  misc_feature: Encodes the peptide sequence at SEQ ID NO. 46501
  misc_feature (90)..(90): n is a, c, t, g, unknown, or other
aatgggttgtccagacagatgatacaagtttcctttgaggatggactctctgttgatgctcaagtttgcacggaagaaaggtcgttccgngctgtggattaacatccttggaatttccacttgcctcagccacgtatttgaataccttaaaaatggatgggttctccttgaggtgattgacaacattgctcctggctcagttaactggaagatggtaaattgtccgcccatcaaactaccgttcaagagagttcaaaactgccaccaaggtttgaaaaacggaaaagaattaaacttttccctggtgaatattgctggaaatgatatagtgcaaggaaacaagaaactgatattagcttttctatgacaattgaagcggcaccaccttcttcaactgctgaagaatcgtagatttcactcacatggaaaagagatcgcatataatgacatattggtatgggccaataagaaattaaactattctggaaagcacctatctcgtatggaaagatccaaggataaaagcctttctagtggcacctttttccgtgacttactacgtgctgtggagcctcgagttgtgaattggagccttgtgacgaaa

SEQ ID NO: 46501 - protein, 108 aa, Panicum virgatum
  misc_feature: Ceres CLONE 2030897
  misc_feature (11)..(108): Pfam Name: CH Pfam Description: Calponin homology (CH) domain
  misc_feature (17)..(17): Xaa is any aa, unknown, or other
MDSLLMLKFARKKGRSXLWINILGISTCLSHVFEYLKNGWVLLEVIDNIAPGSVNWKMVNCPPIKLPFKRVQNCHQGLKNGKELNFSLVNIAGNDIVQGNKKLILAFL

SEQ ID NO: 46502 - DNA, 643 bp, Panicum virgatum
  misc_feature: Ceres CLONE 2030903
  misc_feature: Encodes the peptide sequence at SEQ ID NO. 46503
attcagctgagtgtgctcgatcatcaagcaatcaacaaagcctcccaattatcttttcatcagatcatcttccttcttccaagatgtcttgcagctgcggatcaagctgcaactgcggctccaactgcaagtgcagcaagatgtaccctgaccttgaggagaagagcagcggcggcgctcaggccaccatcgtcctcggcgtggccccggagaagaaggccggccagttcgaggcagcggcggagtccggcgagaccgcccacgcctgcaagtgcggtaacagctgcagctgcgacccctgcaactgctgatttcgatggggaacatcagaacacacctgcatgcatgctagctactacctactactctgcttgtgtgtgacgatgattgaacaagaataaggatgagcctgagccatcatgtctcatggatcggtttggctccggcctcatcgagcatgcatgcgtctgcccctgtgtgtgctttgctaccttcccttaccctgtgctgcttggcgtccgtcctgtgtctgtatgtgttgatcattgcaaataaaccatgcaggcatacatctctgcatgtgtctctgtaatgatcggtccagagtggtgaatatataaaactgggtttgctttatctgcct

SEQ ID NO: 46503 - protein, 75 aa, Panicum virgatum; identical to SEQ ID NO: 20165
  misc_feature: Ceres CLONE 2030903
  misc_feature (1)..(75): Pfam Name: Metallothio_2 Pfam Description: Metallothionein

SEQ ID NO: 46504 - DNA, 705 bp, Panicum virgatum
  misc_feature: Ceres CLONE 2030908
  misc_feature: Encodes the peptide sequence at SEQ ID NO. 46505
aaaaaaaaaaaaaaaacgcgaccactgcttcaaatgcagacgagagtagctggggaacttactgccctggcgagaacccgagccctccgccagagtatgacacctgcttgggagacttgtatagtattgcttggatggaagacagtgatttccacaatttgcaaactgagtctctcaagcagcaatacaatttggtcaaggataggacatcggctcacaatacttacacctatggttcccatgtgatgcaatacggttcactgaacctgaatgtgcaacatttatcttcgtacattggaacaaaccctgctaacgatggcaacaagtttgttgaaggcaattccttgccatcatccacaagagctgttaatcagcgtgatgctgatcttgtttacttctggcagaagtaccggaaattggctgagggctcacctgggaaaaatgatgcccggaaggaattgcttgaagtgatggcccaccgatctcatgttgacaacagtgttgagctgattggaagccttctctttggatcagaggacggtccaagggttctgaaggctgttcgtgcagctggtgaacctttggttgatgactggagctgcctcaagtccatggttcgtgcatttgaggcgcagtgtgggtcgttggctcagtatggaatgaagcacatgaggtcctttgcaaacatctgcaatgccggcatcc

SEQ ID NO: 46505 - protein, 234 aa, Panicum virgatum
  misc_feature: Ceres CLONE 2030908
  misc_feature (1)..(100): Pfam Name: Peptidase_C13 Pfam Description: Peptidase C13 family
  misc_feature: SWISSPROT Homolog: EC 3.4.22.34 Legumain
KKKKNATTASNADESSWGTYCPGENPSPPPEYDTCLGDLYSIAWMEDSDFHNLQTESLKQQYNLVKDRTSAHNTYTYGSHVMQYGSLNLNVQHLSSYIGTNPANDGNKFVEGNSLPSSTRAVNQRDADLVYFWQKYRKLAEGSPGKNDARKELLEVMAHRSHVDNSVELIGSLLFGSEDGPRVLKAVRAAGEPLVDDWSCLKSMVRAFEAQCGSLAQYGMKHMRSFANICNAGI

SEQ ID NO: 46506 - DNA, 640 bp, Panicum virgatum
  misc_feature: Ceres CLONE 2030954
  misc_feature: Encodes the peptide sequence at SEQ ID NO. 46507
gcactccacggacgcacgcaggcgccgcccgaccaggcgcccgcacgagcgccgccggtcgccgtcgccggctgcccaccggctaggaggagcgacggctgaaatctccgacgagaagaaggctcaaggaagaggaagctgaaggcgagcgagtggggagggaagaagatgaaggtccgcgcgtcggtgaagcggttgtgcgggttctgcaaggtggtgaagcgccgaggcatcgtcttcatccactgcaccgccaaccccaagcacaagcagcgccagggcttctccaccctcgccgaagccgccgcatcaggcacccacctgccgccgcccccgccaccgactgccagcagcaccgcctccgccgcagcgtttgcggaggcttccaaggtggctaggcaagagatgtttacaaaatttaattggcctctaggtttagctgctctgctcaagaatggtgaaaaataatgcgtctgctctactatactctgacaattcagaagcagatttggcactttgatattaagtgagtttgtagccaaaacctgaagctgtatcatcatgatgtattttgcagtcactactagtcagttgagttggtcctgtggtggaataatatcagcacatattttttacgctc

SEQ ID NO: 46507 - protein, 99 aa, Panicum virgatum
  misc_feature: Ceres CLONE 2030954
  misc_feature (1)..(38): Pfam Name: Ribosomal_L36 Pfam Description: Ribosomal protein L36
MKVRASVKRLCGFCKVVKRRGIVFIHCTANPKHKQRQGFSTLAEAAASGTHLPPPPPPTASSTASAAAFAEASKVARQEMFTKFNWPLGLAALLKNGEK

SEQ ID NO: 46508 - DNA, 925 bp, Panicum virgatum
  misc_feature: Ceres CLONE 2030955
  misc_feature: Encodes the peptide sequence at SEQ ID NO. 46509
aaaaaaaaaaaacgccactcctccttctcttctccctctcctctcgtctcggcctcaggatcatcagcggcaatggcgatggcgtcgtcgagcgggctccggagctgcagcgccgtcggcgtgcccagcctgctggcgccgtcgtcgtcgcgcgccgggcggctgccgttctgcgccagcgccaccacctccggccgcgtcatcatgtcggccgagtggatgcccggccagccccgccccgcccacctcgacggctcctcccccgggatcttggtgccggaggcgctggggctcggcaactgggtgaaggcgcaggagtgggcggcggtgcccggcgggcaggccacgtacctgggcaacccggtgccgtggggcacgctgcccaccatcctggtgatcgagttcgtggccatcgccttcgcggagcaccagcgcaccatggagaaggaccccgagaagaataagtaccccggcggcgccttcgacccgctcggcttctccaaggaccccgtcaagttcgaggagtacaagctcaaggagatcaagaacggccggctggcgatgctggcgttcgtggggttctgcgtgcagcagtcggcgtacccgggcacggggccgctggagaacctggccacccacctcgccgacccgtggcacaacaacatcggcgacatcatcatccccagaacgatctacccttgagctgatgagaccacggcggcggcgaagaacggagatgagacgagacgacgggcggacgggaagtgtgtactggatagatcaatggtgttttctgtgtgtggattactgctgggcactgcctgcgtgcgtgcagcaactgtacaacgaacgacggcggcggcgactttccggccgtcggccgggaacccattgtccttgtgtaatgtaaagcttacttgttatt

SEQ ID NO: 46509 - protein, 209 aa, Panicum virgatum
  misc_feature: Ceres CLONE 2030955
  misc_feature (54)..(175): Pfam Name: Chloroa_b-bind Pfam Description: Chlorophyll A-B binding protein
MAMASSSGLRSCSAVGVPSLLAPSSSRAGRLPFCASATTSGRVIMSAEWMPGQPRPAHLDGSSPGILVPEALGLGNWVKAQEWAAVPGGQATYLGNPVPWGTLPTILVIEFVAIAFAEHQRTMEKDPEKNKYPGGAFDPLGFSKDPVKFEEYKLKEIKNGRLAMLAFVGFCVQQSAYPGTGPLENLATHLADPWHNNIGDIIIPRTIYP

SEQ ID NO: 46510 - DNA, 676 bp, Panicum virgatum
  misc_feature: Ceres CLONE 2030956
  misc_feature: Encodes the peptide sequence at SEQ ID NO. 46511
gcaaaaaccactcgagcacaaccggcagaggcactccagagctaagcgttcgatcgacagccgatccagaacaagatgtgtcagatgaagatgaagatgaagatgaagatggagatgggcgccgagccgtcgggctcgccctcgacctcggagcaggagcaccaccggacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacgccgccatgctcgccatcgcgggcccgggcgcctgcctcaacttcgcggactcggcgtggttgctcgcggtcccggcctcgtactccagcctcaccgaggtgcgccgcgcggtcgccgaggccgtggaggagttccagcgccgggaggcgctcccggaggaggaggaggaggacgcgcgctcggccacgtcgtcgacgccgtcctcccccgccagcggcgaagacgaggcctccaccgacgaggacggggaggagtcctcgccggccgccgaggactcgccgttcgaactggacctgttcggtggcttgagctcggacttgtactacgcgagcttggcgc

SEQ ID NO: 46511 - protein, 200 aa, Panicum virgatum
  misc_feature: Ceres CLONE 2030956
  misc_feature (53)..(109): Pfam Name: AP2 Pfam Description: AP2 domain
  misc_feature: The sequence is a functional homolog of SEQ ID NO 1230 in the 10/374,780 US patent application
  misc_feature: The sequence is a functional homolog of SEQ ID NO 724 in the 11/435,388 US patent application
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 2 in US patent 7138277
  misc_feature: The sequence is a functional homolog of SEQ ID NO 1248 in the 10/374,780 US patent application
  misc_feature: The sequence is a functional homolog of SEQ ID NO 1235 in the 10/374,780 US patent application
  misc_feature: The sequence is a functional homolog of SEQ ID NO 714 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1227 in the 10/374,780 US patent application
  misc_feature: The sequence is a functional homolog of SEQ ID NO 706 in the 11/435,388 US patent application
  misc_feature: The sequence is a functional homolog of SEQ ID NO 752 in the 11/435,388 US patent application
  misc_feature: The sequence is a functional homolog of SEQ ID NO 1236 in the 10/374,780 US patent application
MCQMKMKMKMKMEMGAEPSGSPSTSEQEHHRTVWTSPPKRPAGRTKFRETRHPVFRGVRRRGNAGRWVCEVRVPGRRGCRLWLGTFDAAMLAIAGPGACLNFADSAWLLAVPASYSSLTEVRRAVAEAVEEFQRREALPEEEEEDARSATSSTPSSPASGEDEASTDEDGEESSPAAEDSPFELDLFGGLSSDLYYASLA

SEQ ID NO: 46512 - DNA, 660 bp, Panicum virgatum
  misc_feature: Ceres CLONE 2030961
  misc_feature: Encodes the peptide sequence at SEQ ID NO. 46513
cccacagtaatctccgtccaccccctccgtccgtccattcgtccgtcttcctttcctctcctgcccccatcgctcgctcactcagtggcagcaaagcagatccctgcatcccctttagatcacctttgtgcatgctttcttgcggcaaggaggccgctcttgtccccctcctctagcatggacgccgtggagcgcttgaagagcgggttcgagcagttcaagacccaggtctacgacaagaagccggagctgttcgagccgctcaaggccggccaatcccccaggtacatggtgttcgcctgcgccgactcccgctgctgcccgtcggtgaccctgggcctgcagcccggcgaggccttcaccatccgcaacatcgccgccatggtcccgccctacgacaagaacaagtacgccggcatcggggccgccatcgagtacgccgtctgcgccctcaaggtggaggtcctcaccgtcattggccacagccgctgcggtggcatcaaggcgctcctctccctccaggacggcgcagccgacaccttccacttcgtcgaggactgggtcaggatcggctaccaggccaagaagaaggtgcagaaagagcaccccactgttccgttcgacgatcagtgctccatcttggagaaggaggctgtgaac

SEQ ID NO: 46513 - protein, 160 aa, Panicum virgatum
  misc_feature: Ceres CLONE 2030961
  misc_feature (30)..(160): Pfam Name: Pro_CA Pfam Description: Carbonic anhydrase
  misc_feature: SWISSPROT Homolog: EC 4.2.1.1 Carbonate dehydratase
MDAVERLKSGFEQFKTQVYDKKPELFEPLKAGQSPRYMVFACADSRCCPSVTLGLQPGEAFTIRNIAAMVPPYDKNKYAGIGAAIEYAVCALKVEVLTVIGHSRCGGIKALLSLQDGAADTFHFVEDWVRIGYQAKKKVQKEHPTVPFDDQCSILEKEAV

SEQ ID NO: 46514 - DNA, 670 bp, Panicum virgatum
  misc_feature: Ceres CLONE 2030972
  misc_feature: Encodes the peptide sequence at SEQ ID NO. 46515
acccaccccccgcaccccgtctttccccgagctccagttcttctcgctcgcggtctcgccgccgtctcgcgaaccgaggagatgtcgtacctgctgccgcacctgcactccgggtgggcggtggaccaggccatcctcgccgaggaggagcgcctcgtcatcatccgcttcggccacgactgggacgagacgtgcatgcagatggatgaagtgctggccgcagttgcagagactataaagaactttgcagttatctacctcgttgatatcacggaggttcctgacttcaacacgatgtatgagctgtatgatccgtcaaccgtgatgttcttcttccggaacaagcacatcatgattgatctcgggacaggaaacaacaacaagatcaactgggccttaaaggataagcaggagttcatcgacattgtggagactgtgtacaggggtgcccggaagggccgcggtctcgtgattgctccaaaggactactccaccaagtaccgttactaggccatttgtatcgggtattgttgtgcaggtttgggtctaccatgttgggcaaatgccaactctcagacatttaacgcataactcaatggttgtttacttgctgagtgttgcttaactttgttgacaatcaaataaattgtaatctgatttgatccttaga

SEQ ID NO: 46515 - protein, 142 aa, Panicum virgatum
  misc_feature: Ceres CLONE 2030972
  misc_feature (4)..(136): Pfam Name: DIM1 Pfam Description: Mitosis protein DIM1
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETVYRGARKGRGLVIAPKDYSTKYRY

SEQ ID NO: 46516 - DNA, 1168 bp, Panicum virgatum
  misc_feature: Ceres CLONE 2030977
  misc_feature: Encodes the peptide sequence at SEQ ID NO. 46517
cttctccctcagcctccagctccgtcggaacgggcagccgctgcattccccctccctcacctccaccctcgcagctagggtttgctcccaatccaacgcctccgccatggccaagacgaagcaggggaagcgggacgtcgaagcctacaccatcaagggcaccaacaaggtggtccgagtgggggactgcgtgctgatgcggccggcggacacggacaacccgccgtacgtggcgcgggtggagaggatggagtcggatgggcgcggcggcgtgcgggtgcgggtgcgctggtactaccgccccgaggaggccaagggcggccgccgcccgttccatggcgccaaggagctcttcctctccgaccacttcgacacgcagagcgcgcacaccatcgagggcaagtgcgtcgtccactccttcaagaactacaccaagctcgacaacgtcgggcctgaggatttctactgccgatttgactacaaggcgagcagcggcgcattcacccccgaccgtgtcgccgtgtattgcaagtgtgagatgccatataacccggatgacctcatggtgcagtgtgagggatgcaaggactggttccatccatcctgtatgggaatgaccattgagcaggccaaaaagatagaccactacatgtgttcggactgtgctaaagaaaatggtgcaaagagaacatcaaattcatacctagttccaccaaactctgattctaagattgaagcaaagaggcgcaagagataaatgctgtaacagaaacatccctggcgagaaaatgtgctgtttatggcgccagctctttgttgctggtgcagatttaagctgtggagatgtacaactgtgagagaagagccagttcatttgtaggacaaaatcgtgtttgacttattgttctgctgtgtatcctggggacgtttcctgcagtttagaacattagagtgctgagtaggttaatttccctccggctgtgcaacgagtgatcagccgcctcaggcggcgggaaagaagtcgagaaatgctagaatgctgctgactctgtcaatgtaaccgtatcagtgtgtgtttaacatattcccctgctggaaacgttcccttgtgtgaatgatgttgatgatagctgactgtttcataatttaattagatgttgcgaagagt

SEQ ID NO: 46517 - protein, 216 aa, Panicum virgatum
  misc_feature: Ceres CLONE 2030977
  misc_feature (21)..(136): Pfam Name: BAH Pfam Description: BAH domain
  misc_feature (140)..(189): Pfam Name: PHD Pfam Description: PHD-finger
MAKTKQGKRDVEAYTIKGTNKVVRVGDCVLMRPADTDNPPYVARVERMESDGRGGVRVRVRWYYRPEEAKGGRRPFHGAKELFLSDHFDTQSAHTIEGKCVVHSFKNYTKLDNVGPEDFYCRFDYKASSGAFTPDRVAVYCKCEMPYNPDDLMVQCEGCKDWFHPSCMGMTIEQAKKIDHYMCSDCAKENGAKRTSNSYLVPPNSDSKIEAKRRKR

SEQ ID NO: 46518 - DNA, 711 bp, Panicum virgatum
  misc_feature: Ceres CLONE 2030979
  misc_feature: Encodes the peptide sequence at SEQ ID NO. 46519
gatcttcatccattccattccacgcactagtgttgttaagcctcctattagcacccaagtcccatccctaatcaccgtctaatcaggctccccaaccatggcggcggcggcggcggcggtggaggtcccagtgtcggcgccggtgagaacagtgaaggtcacaaacgtctcacttactgcaactgtacaagacattaaggagttcttttccttttcaggagatattgaacatgtggagatgcaaagtggtgatgagtggtctcaagttgcatatgtgactttcaaagatgcacaaggtgcagagactgcacttcttctttcgggtgccacaatagttgatctttctgtcatcattgcacctgctccagaatatcagccaccccctactgcctctgctccaccaatgagtggaaccagagttccagttggtggagacaacaacgttgtccacaaggccgaggatgtcgtcagcactatgcttgctaagggttttgtcctaggcaaagatgcagttggcaaggccaaagcttttgatgagaagcacggcttcacatccacagctggtgctaaggtggcctccattgacaagaaaatcggcctgagcgagaagatcaccacaggcacttccatggtgagtgggaaggtgaaaggagatggacagaagttccaggtctcagacaagaccaagtccgctttcgctgctgctgagca

SEQ ID NO: 46519 - protein, 204 aa, Panicum virgatum
  misc_feature: Ceres CLONE 2030979
  misc_feature: Functional homolog of the protein sequence given in SEQ ID NO 50683
  misc_feature: Useful for making plants with altered lignin content
  misc_feature: Functional homolog of the protein sequence given in SEQ ID NO 51548
  misc_feature: Useful for making plants with altered alkaloid content
  misc_feature: Functional homolog of the protein sequence given in SEQ ID NO 50372
  misc_feature: Useful for making plants with modulated biomass
MAAAAAAVEVPVSAPVRTVKVTNVSLTATVQDIKEFFSFSGDIEHVEMQSGDEWSQVAYVTFKDAQGAETALLLSGATIVDLSVIIAPAPEYQPPPTASAPPMSGTRVPVGGDNNVVHKAEDVVSTMLAKGFVLGKDAVGKAKAFDEKHGFTSTAGAKVASIDKKIGLSEKITTGTSMVSGKVKGDGQKFQVSDKTKSAFAAAE

SEQ ID NO: 46520 - DNA, 727 bp, Panicum virgatum
  misc_feature: Ceres CLONE 2030989
  misc_feature: Encodes the peptide sequence at SEQ ID NO. 46521
tgttccgcatcatgttcgaccgccgcttcgagagcgagcaggacccgctcttcaacaagctcaaggcgctcaacgccgagcgcagccgcctctcccagagcttcgagtacaactacggcgacttcatccccgtcctccgccccttcctccgcggctacctcaaccgatgccacgacctcaagacccgccgcatgaaggtcttcgaggacaacttcgtccaggagcgcaagaatgtgatggcgcagactggcgagatccggtgcgccatggaccacatcctcgaggccgagaggaggggcgagatcaaccacgacaacgtcctctacatcgttgagaacatcaacgtcgcagcgatcgagactaccttgtggtcggtcgagtggggtatcgctgagctggtgaaccacccggcgatccagtccaagctccgcgaagagatcacctccgtgctgggcgccggcgtggcggtgacggagccggacctggatcgcctgccctacctgcaggccgtggtcaaggagaccctccgcctgcgcatggccatcccgctgctggtcccgcacatgaacctcaacgacggcaagctccacggctacgacatccccgccgagtccaagatcctcgtcaacgcgtggttcctcgccaacgaccccaagcggtgggtgaagcccgaggagttccgccccgaccgggttctggaggaggagaagggcggtggaggcccacg

SEQ ID NO: 46521 - protein, 241 aa, Panicum virgatum
  misc_feature: Ceres CLONE 2030989
  misc_feature (1)..(241): Pfam Name: p450 Pfam Description: Cytochrome P450
  misc_feature: SWISSPROT Homolog: EC 1.14.13.11 Trans-cinnamate 4-monooxygenase
  misc_feature: Functional homolog of the protein sequence given in SEQ ID NO 51193
  misc_feature: Useful for making plants with altered carbohydrate content
  misc_feature: Functional homolog of the protein sequence given in SEQ ID NO 51196
  misc_feature: Useful for biocontainment applications
  misc_feature: Useful for making plants with altered cell wall content and/or composition
  misc_feature: Useful for making plants with modulated biomass
  misc_feature: Useful for making plants with modulated flowering time
  misc_feature: The sequence is a functional homolog of SEQ ID NO 8 in US patent 7148406
FRIMFDRRFESEQDPLFNKLKALNAERSRLSQSFEYNYGDFIPVLRPFLRGYLNRCHDLKTRRMKVFEDNFVQERKNVMAQTGEIRCAMDHILEAERRGEINHDNVLYIVENINVAAIETTLWSVEWGIAELVNHPAIQSKLREEITSVLGAGVAVTEPDLDRLPYLQAVVKETLRLRMAIPLLVPHMNLNDGKLHGYDIPAESKILVNAWFLANDPKRWVKPEEFRPDRVLEEEKGGGGP

SEQ ID NO: 46522 - DNA, 689 bp, Panicum virgatum
  misc_feature: Ceres CLONE 2030990
  misc_feature: Encodes the peptide sequence at SEQ ID NO. 46523
caagaaagctgcatacagtctcattgtgagatcacgtgcgaacgtaaattttgtttggggagatatgccttctagttcatgtttgactcttggaaaagcacttcagctagagcaaacagctttgacacctgatggaagtcctagatttttcgattgcaattctcatgacaagatttctccaagagagcccctttcccctgctagcacaagttcacgcacagatgatatggaggacagttgtgaaggtttctccttgcttcatcttgcatgccgtgtcgcagatgttgggatggttgaattactgctgcagtatggctctagtgtaaatatgactgattcaaagggtcggacaccccttcatcactgcattttgaaaggaagacatcagcatgccaagcttctcctctccagaggggtcgattcacaagccatggatcgagatggtagaacagcattacagtatgcaattgatggtggaacaagcgatgaagatattcttattttgttagaggaccatagtagataatcttgcaatcacaccttcagaaaatcaaccccccccccctcttggtgtggtcgactcaactaacatggctccagttccgcctggtcccagcttgtcttgcagataatccaagtttgtggcgtgaaagcaatttatgtatatgtcgttctggatggagcttcct

SEQ ID NO: 46523 - protein, 174 aa, Panicum virgatum
  misc_feature: Ceres CLONE 2030990
  misc_feature (81)..(113): Pfam Name: Ank Pfam Description: Ankyrin repeat
  misc_feature (114)..(146): Pfam Name: Ank Pfam Description: Ankyrin repeat
  misc_feature: SWISSPROT Homolog: EC 2.4.2.30 NAD(+) ADP-ribosyltransferase
KKAAYSLIVRSRANVNFVWGDMPSSSCLTLGKALQLEQTALTPDGSPRFFDCNSHDKISPREPLSPASTSSRTDDMEDSCEGFSLLHLACRVADVGMVELLLQYGSSVNMTDSKGRTPLHHCILKGRHQHAKLLLSRGVDSQAMDRDGRTALQYAIDGGTSDEDILILLEDHSR

SEQ ID NO: 46524 - DNA, 346 bp, Panicum virgatum
  misc_feature: Ceres CLONE 2030994
  misc_feature: Encodes the peptide sequence at SEQ ID NO. 46525
acaagccagggtcatctacgacagggagagtgggaggtctagggggtttggttttgtcacgtatggatcctccgaggaggtggagaatgcaatatcgaaccttgatggcgctgaattggatggccgacggatccgtgtcacggtagccgagtcgagaccgcctaggcaacaatactgaaattccacttcagaaactgctcagaatggattgtagtatggactgtagtatcgccagtctttattcttcaggattttgttagctgtagtatctccaccaaccatacatgatctgatctggtcttgaccatgcatcactgagcttataaagttctcatggttcaatacg

SEQ ID NO: 46525 - protein, 58 aa, Panicum virgatum
  misc_feature: Ceres CLONE 2030994
  misc_feature (2)..(46): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50182
  misc_feature: Useful for making plants with modulated biomass
  misc_feature: Functional homolog of the protein sequence given in SEQ ID NO 50210
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
QARVIYDRESGRSRGFGFVTYGSSEEVENAISNLDGAELDGRRIRVTVAESRPPRQQY

SEQ ID NO: 46526 - DNA, 737 bp, Panicum virgatum
  misc_feature: Ceres CLONE 2031001
  misc_feature: Encodes the peptide sequence at SEQ ID NO. 46527
cattcgtgatattattcagaaccatttgttgcaggttttctgtttggttgcaatggaaaagcctgtttcccttaagcctgagcacatcagagatgagaaagtcaaggttctgcaatctgtgaaccctattaatcctgaagaggtagtccttggacaatacgatggctacaaggatgaccctacagtgccagatgactctaataccccaacttttgcatctgttgttcttcgggtacacaacgaaagatgggaaggtgttcctttcattcttaaagctggtaaagcattaaactcaaggaaagcagaagttcgagtgcaattcaaggatgttcctggtgacatttttaaatgtaagaagcaaggaagaaatgagtttgttatacgcctccagccatcggaagccatgtacatgaaactaactgttaagaaacctggtttagaaatggctactgaacagagtgagcttgatctgtcatatgggatgcgctaccaaaatgtcaaaattcctgaggcatatgaacgactcatcttggatacaatacgaggagaccagcagcactttgttcgcagagatgagctaaaggctgcttggcagatcttcactcctttgctgcatgacattgatgacggcaagctgaaggccgttccatatcaacctgggagtcgaggccccaaggaagctgatgaattgagcacgagagttggttatgtccagacccacgggtatatatggatac

SEQ ID NO: 46527 - protein, 245 aa, Panicum virgatum
  misc_feature: Ceres CLONE 2031001
  misc_feature (1)..(241): Pfam Name: G6PD_C Pfam Description: Glucose-6-phosphate dehydrogenase, C-terminal domain
  misc_feature: SWISSPROT Homolog: EC 1.1.1.49 Glucose-6-phosphate 1-dehydrogenase
IRDIIQNHLLQVFCLVAMEKPVSLKPEHIRDEKVKVLQSVNPINPEEVVLGQYDGYKDDPTVPDDSNTPTFASVVLRVHNERWEGVPFILKAGKALNSRKAEVRVQFKDVPGDIFKCKKQGRNEFVIRLQPSEAMYMKLTVKKPGLEMATEQSELDLSYGMRYQNVKIPEAYERLILDTIRGDQQHFVRRDELKAAWQIFTPLLHDIDDGKLKAVPYQPGSRGPKEADELSTRVGYVQTHGYIWI

SEQ ID NO: 46528 - DNA, 710 bp, Panicum virgatum
  misc_feature: Ceres CLONE 2031004
  misc_feature: Encodes the peptide sequence at SEQ ID NO. 46529
aacccaccgaagaacacacaacaccaccagagagataacaaagccttcttcctacagcactcttgcaatccacagagctagctcagttcatccaagcacacagaagcatcagcaatgtcgctcgtcaggcgcggcaacgtgttcgaccccttctccatggacctctgggaccccttcgacagcatgttccgctccatcgtcccatcgtcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaatgtgctggtcatcagcggccagcgcagcaaggagaaggaggacaagaacgacaagtggcaccgcgtcgagcgcagcagcggccagttcatgaggcgcttccgcctgccggaggacgccaaggtggagcaggtgaaggccgggctggagaacggcgtgctcacggtcaccgtgcccaaggccgagggcaagaagccggaggtgaagagcatccagatctccggttaagcggccgcggagacggatggtgaggtgagcgtgtgcggcggaggggacaggggaggaccgccggttcgcgctactacagtctgtcgttgctctgctttggtgtgtgtactgttgttcagcctgccatggtagtgcctgct

SEQ ID NO: 46529 - protein, 151 aa, Panicum virgatum
  misc_feature: Ceres CLONE 2031004
  misc_feature (47)..(150): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRGNVFDPFSMDLWDPFDSMFRSIVPSSSSDSDTAAFANARIDWKETPEAHVFKADLPGVKKEEVKVEVEDGNVLVISGQRSKEKEDKNDKWHRVERSSGQFMRRFRLPEDAKVEQVKAGLENGVLTVTVPKAEGKKPEVKSIQISG

SEQ ID NO: 46530 - DNA, 996 bp, Panicum virgatum
  misc_feature: Ceres CLONE 2031017
  misc_feature: Encodes the peptide sequence at SEQ ID NO. 46531
cctatattaagaaaattaactttgtacctcacagaagttagagaaaaagtaactttgcagtccatgaataatagaaaatgtaactttgtgatccatgcctgtattaagaaaattatccctgtactccgtgaaagttagtaaacagtaacgtcgtagtccttgaatgttagaaaaatttaacaataattagaactgtagtgcactttgttgctgtgaagtgtgaacacagtgagtgatggcatcatggactgtttactggcatatcacttctatggtgaccattaataggtactcgatttcatatatcaacatctgattaaccatgttttttttgttgcagctgtcatgcaaaccgatgggtttgattatttgcagcaaagctgcctgtcccttctgaccgagcttcttgagtatgtggccaaggtaggagagcactctgtcactccctgcttgtattcaactgaagtccttgatggtggcgatgccaatggaagacgtgtgaaaccaagaatctaacggctgcccagatgagcctagaagaggagatccttgtgtcttttttcattgtaaagtgttttcctatatcgggtgcttttgtggtgccatgtcatgaatattgtagcgtgtgtttgtgtgtgttgtgacttccaccctttcttcctagccctattgctgcaactgtggagcgagttatggctaatatatatcctactgactagtgtactccaattgtattgctgcgaagcatggttgcgtcgcagcctgtggtcataagtgcaaacaggtggcacggcgaaggtgcttttgcgcaaggtttgatcaagtggggatgacggcaaaggtttgatcaagtggggatgacagcgcagaatgttcattttaccaagttttcaccttgtgctaggccagatttgtcgattcgtagtcatctgtatttgactgtattcaattgaaatgatgaaatgcaatgaaatatgtatctgtggtcattcttgg

SEQ ID NO: 46531 - protein, 56 aa, Panicum virgatum
  misc_feature: Ceres CLONE 2031017
  misc_feature: Functional homolog of the protein sequence given in SEQ ID NO 50896
  misc_feature: Useful for making plants with modulated biomass
MQTDGFDYLQQSCLSLLTELLEYVAKVGEHSVTPCLYSTEVLDGGDANGRRVKPRI

SEQ ID NO: 46532 - DNA, 716 bp, Panicum virgatum
  misc_feature: Ceres CLONE 2031024
  misc_feature: Encodes the peptide sequence at SEQ ID NO. 46533
ctatgaatgtggtgattcttgcaactgttctacaaattgccggaacagagtgacccaaaagggagccaggttacattttgaggtcttcaggaccaccaaccgaggctggggtcttcgctgctgggaccctattcgttctggtgcgtttatatgtgagtatgccggtgaagtcattgatgagctcaaagttaatctcaatgatagtgaagatgattacatttttcagactgtatgtcctggtgataagactttaaaatggaattgtgggcctgaactgttaggtgaggatagcccatacgtaacagcagatgaatttgagccactgcccatcaagataagtgcaaagaacatgggaaatgtctcacgtttcattaaccacagttgctcaccgaatgtcttctggcaacccgttcaatatgaccatggagatgacaggcatccacatataatgttctttgcactgaagcatattcctcccatgacagagctgacttatgactatggtgttgctggagctgagtctagtggttcaggttctcggaggacgaagaactgcatgtgtggatcacgaaactgccggggtttattttgatttgtcaagacttacgcgttgcggctaatcagattctgctagatcaattccaccagacccaagtttgagctactataaggtattgtgccccaaggatgatgcaccggaagatgccgtcgtttgc

SEQ ID NO: 46533 - protein, 196 aa, Panicum virgatum
  misc_feature: Ceres CLONE 2031024
  misc_feature (18)..(174): Pfam Name: SET Pfam Description: SET domain
  misc_feature: SWISSPROT Homolog: EC 2.1.1.43 Histone-lysine N-methyltransferase
YECGDSCNCSTNCRNRVTQKGARLHFEVFRTTNRGWGLRCWDPIRSGAFICEYAGEVIDELKVNLNDSEDDYIFQTVCPGDKTLKWNCGPELLGEDSPYVTADEFEPLPIKISAKNMGNVSRFINHSCSPNVFWQPVQYDHGDDRHPHIMFFALKHIPPMTELTYDYGVAGAESSGSGSRRTKNCMCGSRNCRGLF

SEQ ID NO: 46534 - DNA, 711 bp, Panicum virgatum
  misc_feature: Ceres CLONE 2031049
  misc_feature: Encodes the peptide sequence at SEQ ID NO. 46535
ctagaagtggttcctaagcacatatctgttaaggaagctgttcttccatttgagaaattccaaggttgtgacattcttctcggaccagagatgcgcagcactggagaggtgatgggtatggactacgagttctctggtgcctttgccaaggcacagattgctgctggacagaagctcccctcaaatggcactgtgttccttagcctgaacgacctgacaaaacggcacctcgctgagattggacgtggattccggaaccttggcttcaacatcatcgccacatctggaacagccaaagtgctccagctcgagggcatcccggtggagccagttctgaaaatacatgaggggcgacccaacgctagagatatgctggagaatgatcagattcaggtgatggtgataacaagctctggtgacgcgctatactcaaaagatggcctccaactccgcaggctagccctcgcctacaagatcccaataatcacaactgtggatggggcacgagcaaccatggatgctatcaagagtctggagaagaacaagtcggtcaagatcctcgccttgcaagattacttccagactgctgatgcatcgcctgacttgcaagcagcgccacaaaccactccttagaggcatgccccctcccctaattcatgtaatacgagcctagtgcgaactaaaacacagcccatgcgatgttatacatgt

SEQ ID NO: 46535 - protein, 210 aa, Panicum virgatum
  misc_feature: Ceres CLONE 2031049
  misc_feature (76)..(163): Pfam Name: MGS Pfam Description: MGS-like domain
  misc_feature: SWISSPROT Homolog: EC 6.3.5.5 Carbamoyl-phosphate synthase (glutamine-hydrolyzing)
LEVVPKHISVKEAVLPFEKFQGCDILLGPEMRSTGEVMGMDYEFSGAFAKAQIAAGQKLPSNGTVFLSLNDLTKRHLAEIGRGFRNLGFNIIATSGTAKVLQLEGIPVEPVLKIHEGRPNARDMLENDQIQVMVITSSGDALYSKDGLQLRRLALAYKIPIITTVDGARATMDAIKSLEKNKSVKILALQDYFQTADASPDLQAAPQTTP

SEQ ID NO: 46536 - DNA, 617 bp, Panicum virgatum
  misc_feature: Ceres CLONE 2031052
  misc_feature: Encodes the peptide sequence at SEQ ID NO. 46537
aatgctggtacaataaacaagaataacaagacatggaacgttccagctgaagattttgatatggtgattgatacgaatatcaagggaacagcaaatgtgcttcgccattttgtaccactcatgatagagaagagacatgggattataatcaatctgtcctctggttggggaagatctgctgctgcagaggttgctccatattgtgcttcaaaatgggcgattgagggcttgacacgctccttagctaaggagctgcctccaggattggcagccattgctcttagccctggtgttgtgaacactgacatgcttacttcatgctttggaagctcagctgcattataccaaacgactgaaacatgggcacccaaggcggctacaatgatactaagcctttccctcgacgacaacggcgcctcactgactgtatgaaccggtgaaaaatttgcactgagccagattgctgatgggttctcctgtagtagcctgacatgtagatttcgcgagattattatgatgctgtaaaatagtagctgagaatgtgtgtctgcagtctgcactacaaataccctagccgctgtctgaacatatatattgttgcagtaacatttaccgtc

SEQ ID NO: 46537 - protein, 143 aa, Panicum virgatum
  misc_feature: Ceres CLONE 2031052
  misc_feature: SWISSPROT Homolog: EC 1.1.1.100 3-oxoacyl-[acyl-carrier-protein] reductase
NAGTINKNNKTWNVPAEDFDMVIDTNIKGTANVLRHFVPLMIEKRHGIIINLSSGWGRSAAAEVAPYCASKWAIEGLTRSLAKELPPGLAAIALSPGVVNTDMLTSCFGSSAALYQTTETWAPKAATMILSLSLDDNGASLTV

SEQ ID NO: 46538 - DNA, 751 bp, Panicum virgatum
  misc_feature: Ceres CLONE 2031063
  misc_feature: Encodes the peptide sequence at SEQ ID NO. 46539
ccgctccatcctttcacggatccatccaaggccgagcagtgtggaggcagcaggaagaagctttatgctacctagcttgattgagtagcaggggtagtattagtaggatccgtagggtgttctttttggtaggttgattaggggacttgtgaggatgttggcggtgttcagcggcgaggttgtggaggtgccggcggacctcgtggcggccggcagccggacgccgtcgcccaagacgagggcgtccgagctagtgagccgcttcctcgggagctcggagccggccgtgtccatccagctcgccgacctcgggcacctcgcctactcccacaccaaccaggccctcctccgcccaaggtcgttcgcggcaaaggacgagatattctgcctgttcgagggtgtgctggacaacctggggcggctgagccagcagtacgggctgtccaagggcaccaacgaggtggtcctcgtcatcgaggcttacaagacactgcgggaccgggcgccatacccggccagcttcatgctctcgcagctcaccggcagctatgccttcgtgctcttcgacaagtccaccaactccctgctcgtcgcatctgatcccgagggcaaggtgccgctcttctgggggatcactgcggatggctgcgtcgccttctctgacgacattgacatgctcaaaggatcctgtggcaagtcacttgcacctttcccacaaggttgcttctactccaatgctcttggaggcttg

SEQ ID NO: 46539 - protein, 198 aa, Panicum virgatum
  misc_feature: Ceres CLONE 2031063
  misc_feature: SWISSPROT Homolog: EC 6.3.5.4 Asparagine synthase (glutamine-hydrolyzing)
MLAVFSGEVVEVPADLVAAGSRTPSPKTRASELVSRFLGSSEPAVSIQLADLGHLAYSHTNQALLRPRSFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIDMLKGSCGKSLAPFPQGCFYSNALGG

SEQ ID NO: 46540 - DNA, 974 bp, Panicum virgatum
  misc_feature: Ceres CLONE 2031068
  misc_feature: Encodes the peptide sequence at SEQ ID NO. 46541
cctctctctctctttcctctcccctctcccgctcgtcctccgtccgtccatgaggatcaggaggcggcctccgggccagcctctcgcctacctgctgccctcagatccgcccgcgccacagccaccgcgcggcgcgtcgggagatcaccaggaccgccctgccgtggacaagagagaggaggaggggttgcacttgcacccgagcgcggccgcggatctcggggacgaccgctcctcggcggcgaggcgcccggcattgctgccgcaggacggtgcggtggaacgcggcaggggcctgggtgcacaacaacaggggcctgcagatggccacaggagactagagaatggtcgtcaccgcgtgctgaagccggtgatcaaggccggagagcgtctcaatctcagcaacggcggcgacaggttagccttggcaatagtgccatcaacaacaacaatgatcaagcctcaagagatgaagtatgccggcggcggcagcagcaagaagccgcgggccccgggtgtgctgctggaggggtcacggtgcagccggaagaacgggcgcgggtggcgctgcagccagccgacgatggtgggctacgccctctgccagtaccacctcggcaagggccggatgcggagcgcggcggcggccgccgccgcgcgctccgtcgccgggcagctcggccgcaccgagaacgggaacagagcgcccgccgtggcggccgcggccaccgccaccgccgcgccgcccaaggccgccgacgtgccgccggcgagcgtgcagcactggtaggcgcgcgcatggctgatggccggcggagatcgatgggaccgtaagattcttggacatcgcggtggggttgcacataatctggtggcgactgaattctttgctgcgttcccattcccaaacttgcaaatgctgtggtgccgtaccccgtggggaaaagtttttgccgcggattgtggtcgtcgtc

SEQ ID NO: 46541 - protein, 246 aa, Panicum virgatum
  misc_feature: Ceres CLONE 2031068
  misc_feature (158)..(203): Pfam Name: WRC Pfam Description: WRC
MRIRRRPPGQPLAYLLPSDPPAPQPPRGASGDHQDRPAVDKREEEGLHLHPSAAADLGDDRSSAARRPALLPQDGAVERGRGLGAQQQGPADGHRRLENGRHRVLKPVIKAGERLNLSNGGDRLALAIVPSTTTMIKPQEMKYAGGGSSKKPRAPGVLLEGSRCSRKNGRGWRCSQPTMVGYALCQYHLGKGRMRSAAAAAAARSVAGQLGRTENGNRAPAVAAAATATAAPPKAADVPPASVQHW

SEQ ID NO: 46542 - DNA, 727 bp, Panicum virgatum
  misc_feature: Ceres CLONE 2031069
  misc_feature: Encodes the peptide sequence at SEQ ID NO. 46543
atgctcaaattgttgatgccaggtactacctcaaggacgcggtgctggagggcggcatcccgttcaacaaggcgtacggcatgacggcgttcgagtaccacggcacggacccgcgcttcaaccgcgtgttcaacgagggcatgaagaaccactcggtgatcatcaccaagaagctgctcgagttctacgccggcttcgagggcgtcggcaccctggtcgacgtcggcggcggcgtcggcgccaccctgcacgccatcacctcccgctaccccggcatcaggggggtcaacttcgacctgccccacgtgatctccgaggcgccgccgttccccggcgtggagcacgtcggcggggacatgttcaaggccgtgcccgccggcgacgccatcctcatgaagtggatcctccacgactggagcgacacccactgcgcggcgatcctcaagaactgctacgacgcgctccccgccggcggcaaggtgatcgccgtcgagtgcatcctgccggtgaacccggaggccacgcccaaggcgcagggcgtgttccacgtcgacatgatcatgctcgcgcacaaccccggcggcaaggagcgctacgagagggagttcgaggagctcgccaagggcgccggcttcaccgggttcaaggccacctacatctacgccaacgcatgggccatcgagttcaccaagtagatctgttgtcgcgcatgtgcttgtgcttaatt

SEQ ID NO: 46543 - protein, 230 aa, Panicum virgatum
  misc_feature: Ceres CLONE 2031069
  misc_feature (1)..(207): Pfam Name: Methyltransf_2 Pfam Description: O-methyltransferase
  misc_feature: SWISSPROT Homolog: EC 2.1.1.68 Caffeate O-methyltransferase
  misc_feature: Functional homolog of the protein sequence given in SEQ ID NO 50400
  misc_feature: Useful for making plants with altered carbohydrate content
  misc_feature: Functional homolog of the protein sequence given in SEQ ID NO 50401
  misc_feature: Useful for making plants with altered cell wall content and/or composition
  misc_feature: Functional homolog of the protein sequence given in SEQ ID NO 50402
  misc_feature: Useful for making plants with altered lignin content
AQIVDARYYLKDAVLEGGIPFNKAYGMTAFEYHGTDPRFNRVFNEGMKNHSVIITKKLLEFYAGFEGVGTLVDVGGGVGATLHAITSRYPGIRGVNFDLPHVISEAPPFPGVEHVGGDMFKAVPAGDAILMKWILHDWSDTHCAAILKNCYDALPAGGKVIAVECILPVNPEATPKAQGVFHVDMIMLAHNPGGKERYEREFEELAKGAGFTGFKATYIYANAWAIEFTK

SEQ ID NO: 46544 - DNA, 618 bp, Panicum virgatum
  misc_feature: Ceres CLONE 2031078
  misc_feature: Encodes the peptide sequence at SEQ ID NO. 46545
attctatgtgaccgcgcgtctaagaaccctaacagtagacagaacctaggagctagcgctgtgcgcgacactgaactgagagaaggcaccgccggccggaccatcatgccgaaggaggatgtgagcatcgaggcggcggccgccgagaaggcgccgtactgggacccgccgcctgcgccggcgctggacacgagcgagctgcagaagtggtcgctgtaccgcgcgctcatcgccgagttcgtggccaccctcatcttcctctacgtgagcatcgccaccgtcttcgggtacaacgcccagtccaacaacctgcagacgtgcaccggcgtcgggttcctcggcgtctcctggtccctcggcgccaccatcttcatcctcgtctactgcaccggcggcgtctcaggccggcacataaacccagccgtgacgttcgggctgttcgaggggcggaagctgcctctggtgcgcaccgtgctgtacatcgtggcgcagtgcctgggcgccatctgcggcgcgcgcatgaggaagggcaccacgaggggcgatctctacgacgccttgggcggcggcgctaacacgatcggcagcgggttctccgccgcgtcggccctcgccacc

SEQ ID NO: 46545 - protein, 170 aa, Panicum virgatum
  misc_feature: Ceres CLONE 2031078
  misc_feature (31)..(170): Pfam Name: MIP Pfam Description: Major intrinsic protein
  misc_feature: Functional homolog of the protein sequence given in SEQ ID NO 50196
  misc_feature: Useful for making plants with modulated drought sensitivity
  misc_feature: Functional homolog of the protein sequence given in SEQ ID NO 50197
  misc_feature: Useful for making plants with modulated cold sensitivity
  misc_feature: Functional homolog of the protein sequence given in SEQ ID NO 50195
  misc_feature: Useful for making plants with modulated water use efficiency
MPKEDVSIEAAAAEKAPYWDPPPAPALDTSELQKWSLYRALIAEFVATLIFLYVSIATVFGYNAQSNNLQTCTGVGFLGVSWSLGATIFILVYCTGGVSGRHINPAVTFGLFEGRKLPLVRTVLYIVAQCLGAICGARMRKGTTRGDLYDALGGGANTIGSGFSAASALA

SEQ ID NO: 46546 - DNA, 734 bp, Panicum virgatum
  misc_feature: Ceres CLONE 2031080
  misc_feature: Encodes the peptide sequence at SEQ ID NO. 46547
catccatctcctcttgaattccccccaaacatcatccgtcagagaaagagattgaagaagccatggcggccgccgccgcgattcccgctgccgccatcagtcgccccaaccagcgcatctcgctcgctcccagtcccagtcccaggccgccttgctcttccctttccctccgctcgggctttgtggggcgcgcgctggccaccgggcagccggtggccgttgttgtcccgcgccgccgcgtgtcggtgcggatggcgtgggacgggccgctctcctcggtgcgcctcatcgtgcagggcaggaacgtcaaggtgtcggacaaggtgaaggagcacatcgaggacaaggtcgggcgggccgtgtccaagcactgccacctcgtccgcgaggtagacgtccggctctcggcccgcggcggcgacctcggcaggggccccaagacctcccgctgcgagatcacgctcttcagcaagcgccacggcgtcctccgcgccgaggaggacgccgagtccacctacgccagcatcgacatggccgccgccatcattaagcgcaagctccgcaagatcaaggagaaggagacggagctgcgcgcgcgccacatcaaggacgactgggacctccttccggatgccattattgccggcgatgacgaccaacaacaagaaggcgccgatgccgagcaggacctgacggaggccttgggagctgaggacgaggacacggtgctcacc

SEQ ID NO: 46547 - protein, 223 aa, Panicum virgatum
  misc_feature: Ceres CLONE 2031080
  misc_feature (74)..(176): Pfam Name: Ribosomal_S30AE Pfam Description: Sigma 54 modulation protein / S30EA ribosomal protein
MAAAAAIPAAAISRPNQRISLAPSPSPRPPCSSLSLRSGFVGRALATGQPVAVVVPRRRVSVRMAWDGPLSSVRLIVQGRNVKVSDKVKEHIEDKVGRAVSKHCHLVREVDVRLSARGGDLGRGPKTSRCEITLFSKRHGVLRAEEDAESTYASIDMAAAIIKRKLRKIKEKETELRARHIKDDWDLLPDAIIAGDDDQQQEGADAEQDLTEALGAEDEDTVL

SEQ ID NO: 46548 - DNA, 691 bp, Panicum virgatum
  misc_feature: Ceres CLONE 2031091
  misc_feature: Encodes the peptide sequence at SEQ ID NO. 46549
cttgttctgatgagtcatatctaggaatattgctgaattgctgcctttgttgctcactggcttcaatacttcatacaccgctaaatgagtcatctgcaaagttctttgcagcctcagttgttattgctctagaagaacttcatcagaagtccattatatatagaggtgtttcggcagacattcttatgcttgacagatcaggacatctgcagctggtggattttaggtttgcaaagaaaatggaaggtgaaaggacatacacaatatgtgggattgctgactctctagcaccagagatagttcttggtaggggccatggatttcctgctgactggtgggcacttggggtcttgatctatttcatgctgcagtctgacatgccatttgggtcctggagggagagcgagctggaacctgttacaaaaattgccaaaggccaccttgttattccatcaacgttcagtgcggaagttgttgaccttataaccaagctacttgtggtagatgaaaatgttcgccttggaaccagtggtgctgaagctgtgaaaaaacatccctggtttgatggctttgactgggaacaagtggcatctgggacttatgcagtacctgatgaagtcactgagcgcatcaatagctgtatagaaactcttaatgaggacttgacagcgtctccttctgtgtctattga

SEQ ID NO: 46549 - protein, 229 aa, Panicum virgatum
  misc_feature: Ceres CLONE 2031091
  misc_feature (1)..(187): Pfam Name: Pkinase Pfam Description: Protein kinase domain
  misc_feature: SWISSPROT Homolog: EC 2.7.11.11 cAMP-dependent protein kinase
CSDESYLGILLNCCLCCSLASILHTPLNESSAKFFAASVVIALEELHQKSIIYRGVSADILMLDRSGHLQLVDFRFAKKMEGERTYTICGIADSLAPEIVLGRGHGFPADWWALGVLIYFMLQSDMPFGSWRESELEPVTKIAKGHLVIPSTFSAEVVDLITKLLVVDENVRLGTSGAEAVKKHPWFDGFDWEQVASGTYAVPDEVTERINSCIETLNEDLTASPSVSI

SEQ ID NO: 46550 - DNA, 727 bp, Panicum virgatum
  misc_feature: Ceres CLONE 2031092
  misc_feature: Encodes the peptide sequence at SEQ ID NO. 46551
aactcagaacagccgagaaacacacacacgagcctgaatcatcgaagcaacagcaatcccagactcccagtctcccgcgtcactcaaacaccaagcaaccacccaccgatcaacaatgtcgctgatccgccgcagcaacgtgttcgaccccttcttcctcgacctctgggatcccttccagggcttccccttcggctccggcagcggcagcagcagcctcttcccctcgtttgcaggcaccaactctgagaccgcggccttcgccggcccccgcatcgactggaaggagaccccggaggcgcacgtgttcaaggcggacgtcccggggctgaagaaggaggaggtcaaggtggaggtcgaggacggcaacgtgctccagatcagcggcgagcgcaacaaggagcaggaggagaagaacgacaagtggcacagggtggagcgcagcagcggcaagttcctgcgccggttcaggctgccggagaacgccaagacggagcagatcagcgcgtccatggagaatggcgtgctcaccgtcaccgtgctcaccgtcaccgtgcccaaggaggaggtcaagaagcccgaggtcaagcccgtccagatcaccggctagagccgggagcctggctgtttttgcgtcgtgtggagtcgctcgacgtggagtctgttcttccattcttgggtccaaatgctagtgttagcgtccgagtccgagtaaagcttcagatgt

SEQ ID NO: 46551 - protein, 164 aa, Panicum virgatum
  misc_feature: Ceres CLONE 2031092
  misc_feature (55)..(163): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFFLDLWDPFQGFPFGSGSGSSSLFPSFAGTNSETAAFAGPRIDWKETPEAHVFKADVPGLKKEEVKVEVEDGNVLQISGERNKEQEEKNDKWHRVERSSGKFLRRFRLPENAKTEQISASMENGVLTVTVLTVTVPKEEVKKPEVKPVQITG

SEQ ID NO: 46552 - DNA, 691 bp, Panicum virgatum
  misc_feature: Ceres CLONE 2031099
  misc_feature: Encodes the peptide sequence at SEQ ID NO. 46553
tgatagtatggcacgtcgtgcattgaaaaatacatgccttgcataccttgcatctctgaatgagccagatgtcactgaacttgcactgcatgagtacaagactgcgactaacatgacagagcagtttgctgccttagtagcactatctcaaaatgcaggcaaagttcgggatgatgcccttatggatttctataaccagtggcagaacgactatttggttgtgagcaagtggtttgctcttcaagctacttcagagattcctggaaacgtggtaaatgttcagaagctgctgtctcaccctgcttttgacatgaggaatcccaacaaggtgtactcactaatcgggggattctgtgggtcacctgtgaacttccatgcgaaagatggctccgggtacaagttcttgggtgaagttgttttgcagcttgacaagataaatcctcaggtggcttcccgcatggtttcagcattctctcggtggaggcggtacgacgagaccagacaagctcttgctaaggctcagctggagatgattgtgtcggccaatggtctctcagagaatgtgtacgagatagcttccaagagcttggcagattagtttggggggtttggtcaaggaaatgaattggacatggcagtgggggtagcaactgcaaagcgtgcgtaactgaaatgggtatcttcatctatt

SEQ ID NO: 46553 - protein, 198 aa, Panicum virgatum
  misc_feature: Ceres CLONE 2031099
  misc_feature: SWISSPROT Homolog: EC 3.4.11.2 Membrane alanyl aminopeptidase
DSMARRALKNTCLAYLASLNEPDVTELALHEYKTATNMTEQFAALVALSQNAGKVRDDALMDFYNQWQNDYLVVSKWFALQATSEIPGNVVNVQKLLSHPAFDMRNPNKVYSLIGGFCGSPVNFHAKDGSGYKFLGEVVLQLDKINPQVASRMVSAFSRWRRYDETRQALAKAQLEMIVSANGLSENVYEIASKSLAD

SEQ ID NO: 46554 - DNA, 709 bp, Panicum virgatum
  misc_feature: Ceres CLONE 2031102
  misc_feature: Encodes the peptide sequence at SEQ ID NO. 46555
acagagcgccacgaggcgagcagttgagtgttccctagagtccccgtctctccgccgccgcctgcaaccgcttcacgtgccctaatccatctcagctcccctttccgaccccaaatggagcccaagaagacctccgcccagcaccagccgcacgccatggagcccaagaagtcctctccccgccgcaccggcgccgccaacgacgccgagtccccgttgagcagcttgttctatccgccggcgcctggggcaaatgggaaggatcaggacttgtacagcattctctacgaaggtcagagcggcagcgcacatcctggcatgacagatggtaaaacccaatgggctccatccagaagtcgttccacctgcaccaaggatagtaaacattcaccgccccaagattcagttgatacatcttgttttggatcatctgtgcattatggtggtcgagactatttctacggcagctctacaaccaagcaagggacagaatcctccactaattacaaggcggacaagaaggatccagcagcagattctcatggcgactggtggcaaggctcattctactactaggtgaatctggtggcctcccccttggagatcaaggaactaaaagggggaggcagtgaagctcggtttccttgacagttggtggtatcatctgttaccctgcgtcaatagtggacccgctttcgtccaatggtgg

SEQ ID NO: 46555 - protein, 139 aa, Panicum virgatum
  misc_feature: Ceres CLONE 2031102
  misc_feature: Functional homolog of the protein sequence given in SEQ ID NO 51264
  misc_feature: Useful for making plants with modulated biomass
  misc_feature: Useful for making plants with modulated flowering time
MEPKKSSPRRTGAANDAESPLSSLFYPPAPGANGKDQDLYSILYEGQSGSAHPGMTDGKTQWAPSRSRSTCTKDSKHSPPQDSVDTSCFGSSVHYGGRDYFYGSSTTKQGTESSTNYKADKKDPAADSHGDWWQGSFYY

SEQ ID NO: 46556 - DNA, 966 bp, Panicum virgatum
  misc_feature: Ceres CLONE 2031105
  misc_feature: Encodes the peptide sequence at SEQ ID NO. 46557
gacgccccaacccctctcaaatctcccactcgtcgcgggtctgccgcagccgtcttcccgaagccaacgcaaccgcttccttctccgcctccgctcctctagtcctctctccctcccccccgcctcctctccgctcccattccgccaccgacgctccacgcgactccacaagtaaagcggcgggcgcgagcagccaggagccgcggcgggttgcgaaaccgagcgccgcggccggccgccattccgggtccggcgagatgttgggggagctcctgtcgaggatcctgctgctgctcttcgggtacgccatgccggcgttcgagtgcttcaagacggtggagacgcgccccaacgacgcgcacatgctccgcttctggtgccagtactggattattgtggccatggttatagcctttgagagcgtgatctcttggatgccgatgtattcagaaatgaagctagctttctttgtctatctctggtaccccaaaacaaagggaagtgatgttgtatatgacacctttcttcggcccatagtgatgcaatatgaaccaaacatcgagcagaggctactgcatctcagggcgaaatctgggcaactgcttagcttctacttgaagaatttcgcagacaaagggacagccttcttcatggatgtccttcgctatgtcgtatcagagaaacctgaaggatccaatgcagagaggaacaagaagtccggctggagccccttcgccaccaagcgccggccgccgtcaccgccaccgcaggagtccatcttcgatagcaaccctgacgccgccgtggtggccgaggctctgcgcgctaccatcggcgctgccgcggggggtggcgccaagccccggcgagcgcccaacggcaagcattactaaagggaaatagagactcctacagaaactataggggatgattttatctgttgtacatagaatgaatgaacgaagc

SEQ ID NO: 46557 - protein, 211 aa, Panicum virgatum
  misc_feature: Ceres CLONE 2031105
  misc_feature (2)..(94): Pfam Name: TB2_DP1_HVA22 Pfam Description: TB2/DP1, HVA22 family
MLGELLSRILLLLFGYAMPAFECFKTVETRPNDAHMLRFWCQYWIIVAMVIAFESVISWMPMYSEMKLAFFVYLWYPKTKGSDVVYDTFLRPIVMQYEPNIEQRLLHLRAKSGQLLSFYLKNFADKGTAFFMDVLRYVVSEKPEGSNAERNKKSGWSPFATKRRPPSPPPQESIFDSNPDAAVVAEALRATIGAAAGGGAKPRRAPNGKHY

SEQ ID NO: 46558 - DNA, 737 bp, Panicum virgatum
  misc_feature: Ceres CLONE 2031122
  misc_feature: Encodes the peptide sequence at SEQ ID NO. 46559
gcatacttacacctatggttcccatgtgatgcaatacggttcactgaacctgaatgtgcaacatttatcttcgtacattggaacaaaccctgctaacgatggcaacaagtttgttgaaggcaattccttgccatcatccacaagagctgttaatcagcgtgatgctgatcttgtttacttctggcagaagtaccggaaattggctgagggctcacctgggaaaaatgatgcccggaaggaattgcttgaagtgatggcccaccgatctcatgttgacaacagtgttgagctgattggaagccttctctttggatcagaggacggtccaagggttctgaaggctgttcgtgcagctggtgaacctttggttgatgactggagctgcctcaagtccatggttcgtgcatttgaggtgcagtgtgggtcattggctcagtatggaatgaagcacatgaggtcctttgcaaacatctgcaatgccggcatccttcctgaagcagtgtcgaaggtcgctgctcaggcttgcaccagcattccttccaacccctggagctccatccacaagggttttagtgcctaaatgatgcacaggtgaagcgaaatatttcagctgctccaccaaaccgaactccattacaatcctcaggggtgttgtgcttgaaccataggtgaagcaaaatatttcagccgctccatcataccaaactacattatagtcctcaggggcgtttagtgct

SEQ ID NO: 46559 - protein, 192 aa, Panicum virgatum
  misc_feature: Ceres CLONE 2031122
  misc_feature: SWISSPROT Homolog: EC 3.4.22.34 Legumain
HTYTYGSHVMQYGSLNLNVQHLSSYIGTNPANDGNKFVEGNSLPSSTRAVNQRDADLVYFWQKYRKLAEGSPGKNDARKELLEVMAHRSHVDNSVELIGSLLFGSEDGPRVLKAVRAAGEPLVDDWSCLKSMVRAFEVQCGSLAQYGMKHMRSFANICNAGILPEAVSKVAAQACTSIPSNPWSSIHKGFSA

SEQ ID NO: 46560 - DNA, 980 bp, Panicum virgatum
  misc_feature: Ceres CLONE 2031127
  misc_feature: Encodes the peptide sequence at SEQ ID NO. 46561
gcacccgcctccgcgtgctccgcaccgacctttccatccatccgctccctccctcccctcctccatcctcctcctccgcccgttccgccgccgccccgccgctcggcggcaccgcgtgtgacatccgcgccgcgcatcggtgcgctcttcttccagtgcgcgttccagaggagagggtggggatggcgtaccgggcggacgacgactacgactacctcttcaaggtggtgctcatcggggactcgggcgtcggcaagtcgaaccttctctcgcgcttcacgcgcaacgagttcagcctcgagtccaagtccaccatcggcgtcgagttcgccacccgcagcatccacgtcgacgacaaggtcgtcaaggcccagatctgggacaccgccggccaggaaaggtacagagctataacgagtgcatattatcgtggggcggtaggggcacttgttgtctatgatgtcacccggcatgtcaccttcgagaacgtggagaggtggttgagggagctcaaggatcacacggacgccaacatcgtgatcatgcttgttggtaacaaggcggatctgcgccacctcagggcggtcccgaccgaagacgccaaagcctttgccgagaaagaaaacaccttcttcatggagacgtcggccctggaggcgatgaacgtcgaggatgccttcactgaagtgctcaccaatatctaccgtgtggtgagtaagaaagcacttgacatcggtgatgatcctgctgcgcctccgaaggggcagaccatcaacgttggtggcaaggatgatgtgtcagcggtgaagaaatctgcatgttgttcgtcttagattggagtgatagaacatgtacctgaggtggttgatactattgcagcagagggcacaggatgttattgcaatctgggtcctcatctgtattcatgtgttaccaagtgtcttgtgttcattttgcaattcaatacattaattcattcc

SEQ ID NO: 46561 - protein, 216 aa, Panicum virgatum
  misc_feature: Ceres CLONE 2031127
  misc_feature (14)..(175): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWLRELKDHTDANIVIMLVGNKADLRHLRAVPTEDAKAFAEKENTFFMETSALEAMNVEDAFTEVLTNIYRVVSKKALDIGDDPAAPPKGQTINVGGKDDVSAVKKSACCSS

SEQ ID NO: 46562 - DNA, 690 bp, Panicum virgatum
  misc_feature: Ceres CLONE 2031128
  misc_feature: Encodes the peptide sequence at SEQ ID NO. 46563
cccgtgctctctcagaggtgggttggcttctccccctcttaccaagtcctcggttctagggttttagttggaaggggagatggcggcggcggacgtggagtaccgctgcttcgtcggcggcctcgcctgggccaccgacaacgcgtcccgccgccgcggcggaggccgcggtgccgccgacgtgcgagcgcatcgagtgccccgcgtacgaggtgatggacagcgccaacgggttcgagatcaggcggtacacggacgccgtgtgggtgtccaccgcccccatcgaggacatctccttcgtcgccgccacgcgcaccggcttcctccagctgttcaagtacatccagggcaagaacgcgtacaacgagacgatcgagatgacggcgccggtgctgacggaggtgtcgcccagcgacgggcctttctgcgcctcctccttcgcggtcagcttctacgtgccggccaagaaccaggcggacccgccgccggcggagggcctgcgcgtgcggcgctgggccggggccaggtacgccgccgtgcgccggttcgggggcttcgtggcggacgcggacgtcggcgagcaggccgcgcggctcgacgccagcctgcagggcaccaggtgggccgccgccgtcaacgagggccgcggcgcgggccaggcggcctcctacgtcgtggcgcagtacaact

SEQ ID NO: 46563 - protein, 158 aa, Panicum virgatum
  misc_feature: Ceres CLONE 2031128
  misc_feature (1)..(158): Pfam Name: SOUL Pfam Description: SOUL heme-binding protein
MDSANGFEIRRYTDAVWVSTAPIEDISFVAATRTGFLQLFKYIQGKNAYNETIEMTAPVLTEVSPSDGPFCASSFAVSFYVPAKNQADPPPAEGLRVRRWAGARYAAVRRFGGFVADADVGEQAARLDASLQGTRWAAAVNEGRGAGQAASYVVAQYN

SEQ ID NO: 46564 - DNA, 623 bp, Panicum virgatum
  misc_feature: Ceres CLONE 2031129
  misc_feature: Encodes the peptide sequence at SEQ ID NO. 46565
ttagattggatgaggaaccttgaagttggaatccctgaactccttgagaatgacatcaaagtgttgatttacgctggagagtatgatctcatatgcaactggctcgggaactcgagatgggtaaactctatggaatggtctggaaaggaagcttttgtctcatcgtctgataagcccttcactgtcgatggaaaagaagccggcgttctaaagagccatggtcctttgagtttcttgaaggtgcatgattctggtcacatggtaccgatggatcaaccgaaggctgctctggagatgctgaagaggtggacttccggaaacctttcgggcacgtcttcagtctcccagaagcttaatttcgatatgtgaccaacaagatccttcgtggtgtgcaacttggtgctgcaatgctgcccagcactagtctcctcagactaccttatgtaattttctgtgtactccaggattatcctcagctctgacaagcttatcttgcgaccgtacagatgttatttgccttgtacgggcgccccgaatgctgatgagacgtggtcttacaactcgattagcatgtaataaaatttccagagaattgtggcaaggcatgtacggagacttgccct

SEQ ID NO: 46565 - protein, 122 aa, Panicum virgatum
  misc_feature: Ceres CLONE 2031129
  misc_feature: SWISSPROT Homolog: EC 3.4.16.5 Carboxypeptidase C
LDWMRNLEVGIPELLENDIKVLIYAGEYDLICNWLGNSRWVNSMEWSGKEAFVSSSDKPFTVDGKEAGVLKSHGPLSFLKVHDSGHMVPMDQPKAALEMLKRWTSGNLSGTSSVSQKLNFDM

SEQ ID NO: 46566 - DNA, 721 bp, Panicum virgatum
  misc_feature: Ceres CLONE 2031150
  misc_feature: Encodes the peptide sequence at SEQ ID NO. 46567
cactacaagaccacttggggctcaaggacctttaagaatcaagtccttgataccgaagcattcgtgtacaaaagattgaagtcagctggagcagtccttgtagctaagcttgttacaggttcacttgcctatgatgatatatggtttggtggaaggacacgaaatccctggaacattgaggaattttctaccggttcatcagcaggtccagcggctagcacctctgcaggaatggttccgtttgcaattggttcagaaactgcaggatccataacataccctgctgctagatgtggagtaactgcattgcgcccaacatttggaacagttgcacggaccaatgtcatgagcatctctgagagtttggataagcttggtcctttctgcagaagtgcagtagattgtgctattgtactagacgcaattcgcggaaaggatgccggtgatccatcatctcgtgaggttgctttgggcgatccatttcgtgtcgacatcacaaaactcaccgttggctttcttgatgatgctgaaatggaggttgttgacgttctttcctctaaaggtgtcaaaatggtccctttcaagttgaactacactgtggaatcagttcagtccatcctcaacataacaatggacgttgatatgcttgcgcatttcgacaactggcagcgggaaggacatgacgatgactatgaggcacaggaccaatggccagtggagc

SEQ ID NO: 46567 - protein, 240 aa, Panicum virgatum
  misc_feature: Ceres CLONE 2031150
  misc_feature (1)..(240): Pfam Name: Amidase Pfam Description: Amidase
  misc_feature: SWISSPROT Homolog: EC 3.5.1.4 Amidase
HYKTTWGSRTFKNQVLDTEAFVYKRLKSAGAVLVAKLVTGSLAYDDIWFGGRTRNPWNIEEFSTGSSAGPAASTSAGMVPFAIGSETAGSITYPAARCGVTALRPTFGTVARTNVMSISESLDKLGPFCRSAVDCAIVLDAIRGKDAGDPSSREVALGDPFRVDITKLTVGFLDDAEMEVVDVLSSKGVKMVPFKLNYTVESVQSILNITMDVDMLAHFDNWQREGHDDDYEAQDQWPVE

SEQ ID NO: 46568 - DNA, 733 bp, Panicum virgatum
  misc_feature: Ceres CLONE 2031151
  misc_feature: Encodes the peptide sequence at SEQ ID NO. 46569
aaaaaaaaaaaactcactgtgctgctgctgcttcgcataatctgctctgctctccgattcctccggagcagctgcggttggatctcggatcggtgatcacattaacaatggtgaaggctgttgctgtgcttggtagcagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagtgtcgtcgtccccgctgtcaccactggaccagcctgagcatcctctggatatgtgaaataagagcgcctgatctatgatcggcgtgtttgtgttctcgctcctgtagcacctaccgatgaactgaaacctgtgttggg

SEQ ID NO: 46569 - protein, 152 aa, Panicum virgatum; identical to SEQ ID NO: 11938
  misc_feature: Ceres CLONE 2031151
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 46570 - DNA, 729 bp, Panicum virgatum
  misc_feature: Ceres CLONE 2031155
  misc_feature: Encodes the peptide sequence at SEQ ID NO. 46571
agaagtccgccctactcctcctcctacccagcagcctccctcccctgtcgctctcacgcgcttcgtgctcgccgcctcccccacttccgcgtcgcgccccgccccccatggcctccatcgccggatccgctctctccttcgccgggcccgtcaaggccgtcaacactagctcgctctctttctctgctgcgagaaagggcaatgcatatctccgcctgcagccagtgcagaagagattcgctgtttgctatgctgccaaaaaggatacagtggacaaggtttgtgaaattgtgaagaagcagcttgctgttccagagggcactgaagtttgtggtgcctccaagttctctgatctcggtgcagattcacttgatacggttgagatcgtgatgggccttgaggaggagtttcaaatcagcgtcgaggaatcaagcgctcagtcaattgcgacagttgaggatgctgccgagctcatcgacaagcttgttgctgagaaatcgtcctgaagtcacaaggcgtgatgttggggacgaactcgtaaactagttctaccttgttcctgccctgcccactcacaccatatctagaggtttctatgctctgtaggcttggcgattttctcagcattgttgtccactgtgtctgtaataataccgatatgattttaagctgttgaaccttagggtggtgcgcattctgtcggttcattgttgtatgaatggttcttcc

SEQ ID NO: 46571 - protein, 132 aa, Panicum virgatum; identical to SEQ ID NO: 12638
  misc_feature: Ceres CLONE 2031155
  misc_feature (56)..(123): Pfam Name: PP-binding Pfam Description: Phosphopantetheine attachment site

SEQ ID NO: 46572 - DNA, 687 bp, Panicum virgatum
  misc_feature: Ceres CLONE 2031156
  misc_feature: Encodes the peptide sequence at SEQ ID NO. 46573
aaaccaagggagcagcacccgcgcatgtttacccgcttcgccgggcgcgccgcctccaccgcatcgagcatcgtcgccagcagcctcgccgcccccgcccccgcccccgcgccgtcgcccaagccccgcagccccgcctccgccgcccgccccaggctcatcatgagcaagcccggcctcgcctgggccaccgacaacgcgtccctccagcaggccttcgcctcctacggcgacgtcctcgactccaaggtcatcaccgaccgtgagacggggaggtcccgcgggttcggcttcgtcaccttctcctccgagcagtcgatgctcgacgccatcgaagccatgaacggcaaggatctcgacggccgcaacatcaccgtcaaccaggctcagtcccgcggcggcggcggcggcggctacggcggtggtcgtcagggtggctacggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgttcgtgtcactggttgatccgaggtacccctgagtttt

SEQ ID NO: 46573 - protein, 144 aa, Panicum virgatum
  misc_feature: Ceres CLONE 2031156
  misc_feature (5)..(72): Pfam Name: RRM_1 Pfam Description: RNA recognition motif. (a.k.a. RRM, RBD, or RNP domain)
  misc_feature (39)..(136): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MSKPGLAWATDNASLQQAFASYGDVLDSKVITDRETGRSRGFGFVTFSSEQSMLDAIEAMNGKDLDGRNITVNQAQSRGGGGGGYGGGRQGGYGGGGGYGGGGGYGGGRREGGYGGGGGGGRREGGYGDGGYGSRGDSGGNWRN

SEQ ID NO: 46574 - DNA, 685 bp, Panicum virgatum
  misc_feature: Ceres CLONE 2031159
  misc_feature: Encodes the peptide sequence at SEQ ID NO. 46575
atcacacccaaccacattctaagagagtcacagagcagagcgtcgcagcagcaagagcagtgatccgatcgacatggccgccgccgccaccatggccctgacctcccgcgcgctctccggcaagccggcggccagcgccagggacgtcttcggcgagggccgcatcacgatgcgcaagaccgcggcggcgtccggcagcccctggtacgggcccgaccgcgtgctgtacctgggcccgctctccggcgagcccccgagttatctgaccggcgagttccccggcgactacgggtgggacaccgcgggtctgtccgccgacccggagaccttcgccaagaaccgcgagctggaggtgatccactgccggtgggcgatgctgggtgcgctggggtgcgtgttcccggagctcctcgcccgcaacggcgtcaagttcggcgaggcggtttggttcaaggcggggtcgcagatcttcagcgagggcgggctggactacctgggcaacccgagcctggtgcacgcgcagagcatcctggccatctgggcgtgccaggtggtgctcatgggcgccgtcgaggtgtaccgcgtcgccggcagcccgctcggggaggtggtggacccgctgtacccgggcgggagcttcgacccgctggggcttgccgacgacccggaggcgttcgcggagctc

SEQ ID NO: 46575 - protein, 203 aa, Panicum virgatum
  misc_feature: Ceres CLONE 2031159
  misc_feature (59)..(203): Pfam Name: Chloroa_b-bind Pfam Description: Chlorophyll A-B binding protein
MAAAATMALTSRALSGKPAASARDVFGEGRITMRKTAAASGSPWYGPDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEVYRVAGSPLGEVVDPLYPGGSFDPLGLADDPEAFAE

SEQ ID NO: 46576 - DNA, 684 bp, Panicum virgatum
  misc_feature: Ceres CLONE 2031193
  misc_feature: Encodes the peptide sequence at SEQ ID NO. 46577
cgaagtgatactatggaatcaaatcgaagtcgagtagccccagcgaaagcaattgtcttctctcagtggactggcatgttggatttgctggagctttcactgaataccaatcttatacagtacaggagactagatggaacgatgtctctcaacttaagagataaagcagtgcaggattttaacactgacccagaggtcagagttatgattatgtcgctgaaagcaggtaatcttggtctcaacatggttgctgcttgccacgtaattctccttgatctctggtggaacccttatgccgaggaccaggcagtggatagggcacatagaattgggcagactcgtcctgttactgtatcccgcttgactgttaaagatacagtggaagatcgtattttagcgctacaggaggaaaagagagctatggtcagctctgcttttggcgaagacaaatccggtggtcacacaactcggctcactgtggaagacctgcggtacctatttaggatatgatttggagggacacccttcgatgcctctggtgacagacaacggcggcattctgtaccttgtaatcttaatttggcaaaagcgacgcttgggtcacctttgcgagtatcttggagctgaggcaccgtggcctgtgggtccatatccccttccccaccccctgccacagctccggtt

SEQ ID NO: 46577 - protein, 169 aa, Panicum virgatum
  misc_feature: Ceres CLONE 2031193
  misc_feature (33)..(111): Pfam Name: Helicase_C Pfam Description: Helicase conserved C-terminal domain
  misc_feature: The sequence is a functional homolog of SEQ ID NO 148 in the 10/666,642 US patent application
  misc_feature: The sequence is a functional homolog of SEQ ID NO 208 in the 10/412,699 US patent application
RSDTMESNRSRVAPAKAIVFSQWTGMLDLLELSLNTNLIQYRRLDGTMSLNLRDKAVQDFNTDPEVRVMIMSLKAGNLGLNMVAACHVILLDLWWNPYAEDQAVDRAHRIGQTRPVTVSRLTVKDTVEDRILALQEEKRAMVSSAFGEDKSGGHTTRLTVEDLRYLFRI

SEQ ID NO: 46578 - DNA, 713 bp, Panicum virgatum
  misc_feature: Ceres CLONE 2031205
  misc_feature: Encodes the peptide sequence at SEQ ID NO. 46579
aaggcaagaaggaattcacgaacatccccgcgagagagcaagcagatcaatccagcgaggaaggaagagggggagtgtcatgacttccactgtggcttccaagagggtcgtcccgctggtccgcgcgctggagaagctcctggccgcgtcgcccgcaccctgcgctgtctcctctctcaggcctgtggcagtcgccggcggcctccgcgggtacaacaccggcgctccgctccggcgttacgagggtacagagtcggaggacgacagcgtccgcgagtacgagggccgtcgcggcggccgggacttcgctgtgcccagcctgttctcaggtaatgttttgcgtgatccgttcagtgcgccgcagagcctcggccgcctgctgagcctgatggacgacatcgcgacggcggcgccgggccgcgccggtgcggtgcgccgtgggtggaacgcgagggaggacgaggaggcgctgcacctgcgggtggacatgccaggcctgggcaaggagcacgtcaaggtgtgggcggagcagaacagcctggtgatcaagggcgagggcgagaaggaggccggcgaggacgacgccaccccgccgccgaggtacaccggccgcatcgagctgtcgccggaggtttacaggatggacaagatcaaggccgagatgaagaacggcgtgctcagggtggtcgtgcccaaggtgaaggaggagcagc

SEQ ID NO: 46579 - protein, 211 aa, Panicum virgatum
  misc_feature: Ceres CLONE 2031205
  misc_feature (123)..(211): Pfam Name: HSP20 Pfam Description: Hsp20/alpha crystallin family
MTSTVASKRVVPLVRALEKLLAASPAPCAVSSLRPVAVAGGLRGYNTGAPLRRYEGTESEDDSVREYEGRRGGRDFAVPSLFSGNVLRDPFSAPQSLGRLLSLMDDIATAAPGRAGAVRRGWNAREDEEALHLRVDMPGLGKEHVKVWAEQNSLVIKGEGEKEAGEDDATPPPRYTGRIELSPEVYRMDKIKAEMKNGVLRVVVPKVKEEQ

SEQ ID NO: 46580 - DNA, 734 bp, Panicum virgatum
  misc_feature: Ceres CLONE 2031217
  misc_feature: Encodes the peptide sequence at SEQ ID NO. 46581
ttcttagccgcaacggaattgaatgcaatgaccttgaagacttattcatcaaggaccaatcactgagtaatgaaaatgtggacaagatcgttgggtatgcagtgagttatcaccttaagcacaataaagttgaaacctccaactccaaggatgctaaacttgtactcacaagtgaaagcctcaagcatgggctcagcatgctacagagcatgcaaagcgacaacaagagctccaaaaaatcactgaaggatgttgtcacagagaacgaatttgagaaaaggcttctggcggatgttataccacctaatgacattggagttacctttgatgatattggagccctggagaatgtaaaggacacattaaaggagctggtgatgctccctttacaaaggcctgaattattttgcaaagggcagttaacaaagccttgcaagggaatactgctttttggacctcctggcaccgggaaaactatgcttgcaaaagcagtggcaactgaagcaggcgctaatttcatcaatatatcaatgtcgagcattacatcaaagtggtttggtgaaggagagaagttcgtaaaggctgttttctcactagcaagtaaaatagctcccagtgttatatttattgatgaggttgatagtatgctaggaaggagagagaatccaggagagcatgaagcgatgcgcaagatgaaaaatgaatttatggtaaactgggatgggttacaaact

SEQ ID NO: 46581 - protein, 243 aa, Panicum virgatum
  misc_feature: Ceres CLONE 2031217
  misc_feature (146)..(243): Pfam Name: AAA Pfam Description: ATPase family associated with various cellular activities (AAA)
  misc_feature: SWISSPROT Homolog: EC 3.6.4.3 Microtubule-severing ATPase
LSRNGIECNDLEDLFIKDQSLSNENVDKIVGYAVSYHLKHNKVETSNSKDAKLVLTSESLKHGLSMLQSMQSDNKSSKKSLKDVVTENEFEKRLLADVIPPNDIGVTFDDIGALENVKDTLKELVMLPLQRPELFCKGQLTKPCKGILLFGPPGTGKTMLAKAVATEAGANFINISMSSITSKWFGEGEKFVKAVFSLASKIAPSVIFIDEVDSMLGRRENPGEHEAMRKMKNEFMVNWDGLQ

SEQ ID NO: 46582 - DNA, 689 bp, Panicum virgatum
  misc_feature: Ceres CLONE 2031226
  misc_feature: Encodes the peptide sequence at SEQ ID NO. 46583
agcttcccacgccaattaccctccccgactccgccgtcacccgcgccgccgcctcctctgctcgccgtctaagcggttaacacacctcatcagctagtagtagtgaaccaacccaaccagcaacaacccaagcgcaaccgatcgacatggctgactactacggcggcaggaccatgtactccaagaccgacgagtgctacgacaccggcaggcacggcggcagccagagggtgtactcccacaccgacgactgctacgacgacgtggaccgcaggaggccgggggcctacgccgacgactgctacaacggcgccggctacggcggcgccaggcaggccgccgtctactccgacgagtactcccgcagcggctatggcagcgagcaggagcacttcaagagggaggagagggaacacaagcataaggaacgcctcggcgagataggcgccctcgccggcggcgccttcgcactgtacgaggggcaccgtgcgaagaaggacccggagcacgcgcagaggcacaagatcgaggcgggcgtggcgacggcggcggcgctgggcgccggcggctacgcgtaccacgagcaccacgagcagaaggaggcccgctacgagggcaaggaccacagggtgccgcacggctactactgcaactaattactgagcgatcgatcgagtcatgcagcatcg

SEQ ID NO: 46583 - protein, 169 aa, Panicum virgatum
  misc_feature: Ceres CLONE 2031226
  misc_feature (81)..(160): Pfam Name: ABA_WDS Pfam Description: ABA/WDS induced protein
MADYYGGRTMYSKTDECYDTGRHGGSQRVYSHTDDCYDDVDRRRPGAYADDCYNGAGYGGARQAAVYSDEYSRSGYGSEQEHFKREEREHKHKERLGEIGALAGGAFALYEGHRAKKDPEHAQRHKIEAGVATAAALGAGGYAYHEHHEQKEARYEGKDHRVPHGYYCN

SEQ ID NO: 46584 - DNA, 655 bp, Panicum virgatum
  misc_feature: Ceres CLONE 2031243
  misc_feature: Encodes the peptide sequence at SEQ ID NO. 46585
cattgaggcaaccctctccagagccaaatttgaggaactatgttcagacctcatcgacaggcttaaaactcctgttaataatgcattgagagatgccaagttatcggtcagtgatcttgatgaagtgattcttgtgggtggatccacccgaatccctgcagtgcaagaacttgtgaggaagcttaccgacaaggatcctaatgttacagtaaaccctgatgaggttgtttctcttggggcagctgtgcagggtggggttttggcgggagatgtgaaagatgtcgttcttctggatgttactccattgtctcttggtttggagaccttgggtggcgtcatgacaaaaattatccccaggaataccacactgcccacctcaaaatcagaggtattctcaacagctgcagatggacagacaagtgttgagattaatgttctccagggagaaagagagtttgtcagagacaacaagtcccttggaagcttccggttggatggaatcccccctgcacctcgtggtgtcccacaaattgaagtgaagtttgatattgatgcaaatggtattctctctgttgctgccattgataagggcactgggaagaaacaggatatcaccatcactggtgctagtacgctaccgaaggatgaggttgag

SEQ ID NO: 46585 - protein, 217 aa, Panicum virgatum
  misc_feature: Ceres CLONE 2031243
  misc_feature (1)..(217): Pfam Name: HSP70 Pfam Description: Hsp70 protein
  misc_feature: Functional homolog of the protein sequence given in SEQ ID NO 50336
  misc_feature: Useful for making plants with modulated heat sensitivity
  misc_feature: Functional homolog of the protein sequence given in SEQ ID NO 50352
  misc_feature: Useful for making plants with modulated drought sensitivity
IEATLSRAKFEELCSDLIDRLKTPVNNALRDAKLSVSDLDEVILVGGSTRIPAVQELVRKLTDKDPNVTVNPDEVVSLGAAVQGGVLAGDVKDVVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPKDEV

SEQ ID NO: 46586 - DNA, 695 bp, Panicum virgatum
  misc_feature: Ceres CLONE 2031246
  misc_feature: Encodes the peptide sequence at SEQ ID NO. 46587
tgtgctgaatatgggcagaggttactcgtgtacaatcactttagcagaacaacactagatgatgcacttcatgatagagaggactctgaaagtgcattgtcatggaatgctcgccttcaggttgctcttggttcaggaaaagccttagagtatctccatgaaagcttccaacctccaattgtgcaccaaaattttgaaccagctaatgtgctccttgataaaaagttctccgtgtgtgttgctgaatgtggactggcagaactgatgccatcaggttctgtcactcagctttcgggtcggatgcgtgcattaatgaactacgaagcacctgagttccaggattctggggacatttcagaacggggtgatgtgtacagctttggtgtagtgatgctagaacttcttactggccgtaaaccgtatgatagttcacgcccacgtcatgagcaacatcttgttagatgggccagttctcagcttcatgacattgaatccctgtccaagatggtggacccatctatacgtggacaatgttctgagaaagcattgtcacgatttgctgacataatcagtcgctgtatccagcgggagccagagttcaggccaccaatgtctgaaattgtccaagacctagctagacttgtaaatgctactggtgaggaatcagagtaacaaacaaatcctggaggacatac

SEQ ID NO: 46587 - protein, 223 aa, Panicum virgatum
  misc_feature: Ceres CLONE 2031246
  misc_feature (1)..(211): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
CAEYGQRLLVYNHFSRTTLDDALHDREDSESALSWNARLQVALGSGKALEYLHESFQPPIVHQNFEPANVLLDKKFSVCVAECGLAELMPSGSVTQLSGRMRALMNYEAPEFQDSGDISERGDVYSFGVVMLELLTGRKPYDSSRPRHEQHLVRWASSQLHDIESLSKMVDPSIRGQCSEKALSRFADIISRCIQREPEFRPPMSEIVQDLARLVNATGEESE

SEQ ID NO: 46588 - DNA, 688 bp, Panicum virgatum
  misc_feature: Ceres CLONE 2031286
  misc_feature: Encodes the peptide sequence at SEQ ID NO. 46589
ctgacgctgaggtcgctcacagccgcaatgtcgtggctcctggtcgtcgccgtgctcaccggcttcgcggtcgatccgtcggcggcgacggaccacatcgtgggcgccaaccacgggtggaaccccaacatcaactactccctctggtccggcaaccagaccttctacgtcggcgacctcatctcgttccggtaccagaaggggacgcacaacgtgttcgaggtgaacgagacggggtacgacaactgcaccatggacggggtcgccggcaactggacctccggcaaggacttcatcccgctccccgaggcccgccgctactacttcatctgcggcaacggcttctgccagcaaggcatgaaggtcgccatcaccgtccacccgctccggcacaacgcctcctccgatggctccaggggcagcaccgcggcgcagggagaggcctccacggcggcgctcaggacgaggggcgccgcgtggctggcagcaatcgctgtcgtcgcagctgccgctggtaccttctgttaggagctttgattccgagatttctctgaatatttttttgttctatttgtttgctttgctccatttgctcccatttcatgggtcttcatcaacttctctgcaagcgaaactgcccgtctcgaggaacgttgagcagaacgagaacagctacagtgtattcagc

SEQ ID NO: 46589 - protein, 166 aa, Panicum virgatum
  misc_feature: Ceres CLONE 2031286
  misc_feature (31)..(111): Pfam Name: Cu_bind_like Pfam Description: Plastocyanin-like domain
MSWLLVVAVLTGFAVDPSAATDHIVGANHGWNPNINYSLWSGNQTFYVGDLISFRYQKGTHNVFEVNETGYDNCTMDGVAGNWTSGKDFIPLPEARRYYFICGNGFCQQGMKVAITVHPLRHNASSDGSRGSTAAQGEASTAALRTRGAAWLAAIAVVAAAAGTFC

SEQ ID NO: 46590 - DNA, 664 bp, Panicum virgatum
  misc_feature: Ceres CLONE 2031295
  misc_feature: Encodes the peptide sequence at SEQ ID NO. 46591
tcgcgcagtcgctgccacatctctcctcgtccaacctcgtgtgtggcttgcttctgttgcgctgccgcatcctcgtccacatctctccccgccgccagggccgccgtccgccgcggccgcagcgctgggaggggatcgccgggcagcggcgcgaggcgggggaggaggagccgcgggttcgtcgcccggatggcggcggggcgatgacgcgggcggcgggagcagggtgttgagatgcggacgatctgcgatgtgtgcgagagcgcgccggcggtgctcttctgcgcggccgacgaggccgcgctctgccgggcctgcgacgagaaggtgatctccgctccccccttatccgttggtgagctcttcgtctctctcgaagatcgggcgagagcgctgctccattggagtggcgcacggcgcgatggttcgtgttatcggtcggctgggcactgagatctcggggatttgctacttgactgcgagctcgcgtggtggatgactggatgtcaggggtgggatggcccagctgtgtgacgatcctacttttatttcggtcccattttggtagcagagaaatcacagggcatggcatgaggatggcactagccctgtagtcctaatagactaagtttctgactgaggaatacaacggaaacgttctagc

SEQ ID NO: 46591 - protein, 72 aa, Panicum virgatum
  misc_feature: Ceres CLONE 2031295
  misc_feature: Functional homolog of the protein sequence given in SEQ ID NO 51357
  misc_feature: Useful for making plants with altered alkaloid content
  misc_feature: Useful for making plants with altered lignin content
  misc_feature: Useful for making plants with modulated flowering time
  misc_feature: The sequence is a functional homolog of SEQ ID NO 1300 in the 11/479,226 US patent application
  misc_feature: The sequence is a functional homolog of SEQ ID NO 602 in the 10/412,699 US patent application
  misc_feature: The sequence is a functional homolog of SEQ ID NO 1961 in the 11/479,226 US patent application
  misc_feature: The sequence is a functional homolog of SEQ ID NO 465 in the 11/479,226 US patent application
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 1704 in the 11/479,226 US patent application
  misc_feature: The sequence is a functional homolog of SEQ ID NO 2586 in the 10/374,780 US patent application
  misc_feature: The sequence is a functional homolog of SEQ ID NO 652 in the 11/435,388 US patent application
  misc_feature: The sequence is a functional homolog of SEQ ID NO 72 in the 11/375,241 US patent application
  misc_feature: The sequence is a functional homolog of SEQ ID NO 766 in the 10/225,066 US patent application
  misc_feature: The sequence is a functional homolog of SEQ ID NO 862 in the 10/412,699 US patent application
MRTICDVCESAPAVLFCAADEAALCRACDEKVISAPPLSVGELFVSLEDRARALLHWSGARRDGSCYRSAGH

SEQ ID NO: 46592 - DNA, 505 bp, Panicum virgatum
  misc_feature: Ceres CLONE 2031298
  misc_feature: Encodes the peptide sequence at SEQ ID NO. 46593
gtgagtttcaacaacaacggtgtctatggtggtgaccggagaagccctgatgagataactggacccttcaaagatgacccggccccaacttcttttgtcccagcagcaggctaccataaaatgatggaagcgtttggaggaaaaggttatcttgtggagacaccagacgagcttaaatctgccctttcggaatcattccgtgccaggaaaccagcagtcatcaactgtatcattgatccttacgccggttcagagagcggccggatgcagcacaagaactgagggtgtttgtaccataccatagcacgatgcagatgtgactttataagcaatgtcctccagcgtccagcccgtttttgacgaccggttctttgttctgcgtaccgatcgatgtgaggtgctctgtaaacttagctggaaggttgaaactgaagcaggtattcacagaatttagcttcactgccccggtaaatatggatgctctcgtggatagtgttccattttt

SEQ ID NO: 46593 - protein, 93 aa, Panicum virgatum
  misc_feature: Ceres CLONE 2031298
  misc_feature: SWISSPROT Homolog: EC 4.1.1.8 Oxalyl-CoA decarboxylase
VSFNNNGVYGGDRRSPDEITGPFKDDPAPTSFVPAAGYHKMMEAFGGKGYLVETPDELKSALSESFRARKPAVINCIIDPYAGSESGRMQHKN

SEQ ID NO: 46594 - DNA, 713 bp, Panicum virgatum
  misc_feature: Ceres CLONE 2031307
  misc_feature: Encodes the peptide sequence at SEQ ID NO. 46595
catcagcagaacaaaagacaaccagacatctgatccacaacaccacactcgctaggtagcgagacctgtcgagaggaaccaccgaccggtgcaacatggagtacggccagcaggggcagcacggccacggaaccactggccgcgtcgaccagtacggcaacccggtgggcggcgttgggcacggcaccgggaccgggaccggcggcatggggtacggtggtaccaccggaaccggcggcatgggccagctgggggagcacggcggcgccggcatgggtggcggccagttccagcctgcgagggaggagcacaagaccggcggcgtcctgcaccgctccgacagctccagctccagctcgtccgaggacgacggcatgggcgggaggaggaagaagggcattaaggagaagatcaaggagaaattgcccggaggccacaaggacgaccagcacaccacggccaccggcggtgcctacgggcagcagggacacaccggcatgactggcacgggaaccggcggcgccgcctacaccgagggcaccggcgagaagaagggcatcatggacaagatcaaggagaagctgcccggacagcactaagcccggctgcgtagtacgcgcgagaagccgtgtgcttgtctgtcacggcgttccgagataataagatgaacccatcagaagtgaagtgtcccttgaacgcgtccgctcgcgtgg

SEQ ID NO: 46595 - protein, 167 aa, Panicum virgatum
  misc_feature: Ceres CLONE 2031307
  misc_feature (14)..(167): Pfam Name: Dehydrin Pfam Description: Dehydrin
MEYGQQGQHGHGTTGRVDQYGNPVGGVGHGTGTGTGGMGYGGTTGTGGMGQLGEHGGAGMGGGQFQPAREEHKTGGVLHRSDSSSSSSSEDDGMGGRRKKGIKEKIKEKLPGGHKDDQHTTATGGAYGQQGHTGMTGTGTGGAAYTEGTGEKKGIMDKIKEKLPGQH

SEQ ID NO: 46596 - DNA, 530 bp, Panicum virgatum
  misc_feature: Ceres CLONE 2031324
  misc_feature: Encodes the peptide sequence at SEQ ID NO. 46597
aagcaaacctcatctactatttttgcaggaaggaagagctagctccttgtgtgtgtgtgtgtgtgacaggaggtggatcgagaagagggtggtgacgcagctgtcgaggatgctgatccaggaggagatcgacgagaactgcacggtgtacatcgacgccgcgccggccaaggacgagctggcctacaaggtggaccggagcggcgggctggtgaacgcagagacgggccagaagtcggacatcctgatccaggtcccgagcgccgccggcaggagcgacgccgcgcaggacgcgaagaagatgcggatcatggatgaggacgacgaggacggcatggacgaggagtagagcccccccccccccaccccccccgggcgtgccgaggagcttgccgacctgctccggcggcgccctcgggtgttcgccaaataagtgtgtagatacgtcgtgttgcgaaggcacaatgtgacgcttgtgaagatgatgtttttctgaacttctcatgcttttgtagcaggttgtgtttgtc

SEQ ID NO: 46597 - protein, 115 aa, Panicum virgatum
  misc_feature: Ceres CLONE 2031324
  misc_feature: Functional homolog of the protein sequence given in SEQ ID NO 50876
  misc_feature: Useful for making plants with modulated heat sensitivity
SKPHLLFLQEGRASSLCVCVCDRRWIEKRVVTQLSRMLIQEEIDENCTVYIDAAPAKDELAYKVDRSGGLVNAETGQKSDILIQVPSAAGRSDAAQDAKKMRIMDEDDEDGMDEE

SEQ ID NO: 46598 - DNA, 701 bp, Panicum virgatum
  misc_feature: Ceres CLONE 2031329
  misc_feature: Encodes the peptide sequence at SEQ ID NO. 46599
aaaaaaaaaaaaaggcaagaaagacagaacaagttcagaaatcagaactcacagaagccactcgatctcaagcaccgttccgaccttcagttgaatccccaactcgcatcgccatccgtccgacaatgtcgctgatcccccgtggcaacgctttcgaccccttctccctcgacctctgggacccttttcagggcttcccgttcggtccgagcagcggcagcctcttccgtcgcttcccctccgactccgagaccgcggcgttcgccggcgcgcgcgtcgactggaaggagacgccggaggcccatgtcttcacggcggacgtgccggggctgaagaaggaggaggtcaaggtggaggtcgaggacggcaacgtcctccagatcagtggcgagcgcagcaaggagcaggaagagaagaacgaccggtggcaccaggtggagcgcagcagcggcaggttccttcgcaggttcaggctgccggagaacgccaaggcagagcagatcaaggcttccatggagaacggcgtgctcaccgtcaccgtgcccaaggaggaggctaagaagcccgatgtcaagcccgtccagatcaccggctaggaaggaaggagcacgcgtggcctgtggagctccaagtacctgttctggaaacgaatgccttctgtattttgtgggatggtgtcaggtgtggtgtggccgtgtttg

SEQ ID NO: 46599 - protein, 156 aa, Panicum virgatum
  misc_feature: Ceres CLONE 2031329
  misc_feature (52)..(155): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIPRGNAFDPFSLDLWDPFQGFPFGPSSGSLFRRFPSDSETAAFAGARVDWKETPEAHVFTADVPGLKKEEVKVEVEDGNVLQISGERSKEQEEKNDRWHQVERSSGRFLRRFRLPENAKAEQIKASMENGVLTVTVPKEEAKKPDVKPVQITG

SEQ ID NO: 46600 - DNA, 672 bp, Panicum virgatum
  misc_feature: Ceres CLONE 2031346
  misc_feature: Encodes the peptide sequence at SEQ ID NO. 46601
cccgccgccgccgcaccccctcttcgtcgctctcctcgccttgctcgcgtcgccgccacctcctccgccatggccccgaagaaggacaaggccccgccgccgtcgtccaagccggccaagtccggaggcgggaagcagaagaagaagaagtggagcaaggggaagcagaaggagaaggtcaacaacgcggtgctcttcgaccaggccacctacgacaagctgctctccgaggttcccaagtacaagcatccccggccttccctgcgccccgactcagactcgcctcccccagcgctaaccctagcgccgccgccagtcagccaccgtgccgccgagagggtggatccgcgccaccgccggcaaaaatggctggccgaggaggtcctccgcgtcgggcgctcgcggatttggttgctgaagcccacgccgcacagatcgctttgtcccaacgtggtgccagccggggaggatcggagttcaggggcggcgacggcggggaagacctggagggcgtcggtgtgaggcgcggcggcgttcaggcaagtggctccatcgaccctcttgctggccatgtggagagcggtgtcaccgaggagggccaggcgctcggcggcgtggggcgtggtggccatgccgccagcacccagaaccggggtggcgcaagccaacctt

SEQ ID NO: 46601 - protein, 150 aa, Panicum virgatum
  misc_feature: Ceres CLONE 2031346
  misc_feature (1)..(96): Pfam Name: Ribosomal_S25 Pfam Description: S25 ribosomal protein
MAPKKDKAPPPSSKPAKSGGGKQKKKKWSKGKQKEKVNNAVLFDQATYDKLLSEVPKYKHPRPSLRPDSDSPPPALTLAPPPVSHRAAERVDPRHRRQKWLAEEVLRVGRSRIWLLKPTPHRSLCPNVVPAGEDRSSGAATAGKTWRASV

SEQ ID NO: 46602 - DNA, 635 bp, Panicum virgatum
  misc_feature: Ceres CLONE 2031372
  misc_feature: Encodes the peptide sequence at SEQ ID NO. 46603
cgcataatacatcccttgcagtctatggtttctcatggattgttctccttgttatggttctccttttcaagctcttcactgcaactccaaagaaatcaactgccttgccgacttttgttcggtttctgcagggcctccttgctcttggaattattgcaggaattgcgctacttattgtattcacccgcttcactattgctgatttatttgcgagtgcacttgcttttatagcaactggttggtgtgttttatgtttggccatcacatggaagagggtagtacaaactcttgggctctgggactctgtacgcgagattgcacggatgtatgatgcaggaatgggtgccgtcatctttgtgcccatcgttttcttctcatggttcccctttgtgtcaacattccagtcacgcatcctcttcaaccaagcatttagtcgtggcctggagatctccctcatactggcaggaaacaaggcgaatcagcagacataaaaggcctcgtatgtttctgttgtacattcttggaattagcgagggctgcgtagttagttgactcgaacaatttagtgagggttattactcgatttggaaacccagcctctgtacataattgcctcggttattttgatgctaatt

SEQ ID NO: 46603 - protein, 162 aa, Panicum virgatum
  misc_feature: Ceres CLONE 2031372
  misc_feature: Functional homolog of the protein sequence given in SEQ ID NO 51248
  misc_feature: Useful for making plants with altered cell wall content and/or composition
HNTSLAVYGFSWIVLLVMVLLFKLFTATPKKSTALPTFVRFLQGLLALGIIAGIALLIVFTRFTIADLFASALAFIATGWCVLCLAITWKRVVQTLGLWDSVREIARMYDAGMGAVIFVPIVFFSWFPFVSTFQSRILFNQAFSRGLEISLILAGNKANQQT

SEQ ID NO: 46604 - DNA, 619 bp, Panicum virgatum
  misc_feature: Ceres CLONE 2031386
  misc_feature: Encodes the peptide sequence at SEQ ID NO. 46605
caggagcccgcgcagagatcgatagcaagtaactcgagaagatggccgatgtttggatcatcttcactgctaaagatttggaaagggaagtgagtaaatccgacaagctgattgtgctggagttcatggcaccctggaacgagccaagcacggccatgaacgaaccgtatgggcaaatctccagagcctgtaaagactacgtcaacttctacgccctcaacgtcgactactacacagatttggcggacgaagctggagtggaggcgctggcgacgtacgttctgctgaacaataacgatgagatggacatgatcgttggcgtcgagaggcaggagctcgagaatgacataaaaaccaatatataacaactgatccgatcgtccatgcatgaagaacaggaaatgaatgatccatacataaatccactactgtcccatgtgttgaatcacgtatatcggaactagagtgcatttgacgtatggatcgatgaccgtatgatagattttcctaaacttctgtggaactacatccccttgtggatgccctgaagaaacgcagcatatgtatactggtttgaaacagtttttgcgatgggtcaatgtctggatctactactatg

SEQ ID NO: 46605 - protein, 107 aa, Panicum virgatum
  misc_feature: Ceres CLONE 2031386
  misc_feature (4)..(106): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MADVWIIFTAKDLEREVSKSDKLIVLEFMAPWNEPSTAMNEPYGQISRACKDYVNFYALNVDYYTDLADEAGVEALATYVLLNNNDEMDMIVGVERQELENDIKTNI

SEQ ID NO: 46606 - DNA, 717 bp, Panicum virgatum
  misc_feature: Ceres CLONE 2031437
  misc_feature: Encodes the peptide sequence at SEQ ID NO. 46607
tggaagagactttgcacagacgtgtcattggccaagatgaggctgttgtagcaattagtcgctccatccgccgtgctcgtgttggcctcaagaaccccaacaggccaattgcaagctttattttcgcaggtcccactggtgttgggaagtcagagctcgcaaaggcccttgctgcctattactttggctctgaggaggctatgatccggttggatatgagtgaatttatggagaggcacacagtgtccaagctgatcggttcgcctccaggatatgttggatacactgagggtggccaactgacagaggcagttcgacggcggccatacacagttgtgctctttgatgagattgagaaggcacaccctgatgtcttcaacatgatgctccagattttggaagatgggaggttgactgacagcaagggaaggacggtggacttcaagaacaccctcctgatcatgacctcaaacgttgggagcagtgtcatcgagaagggtgggcgcaagattggttttgacctcgactctgatgagaaggacagcagttacggcaggatcaagagcctcgtcatcgaggagatgaagcagtacttccgccctgagttcctcaaccgtcttgatgagatgatcgtcttcaggcagctcaccaagctcgaggtcaaggagattgcggacatcatgctccaggaagtcttcgaccgactcaaggccaagg

SEQ ID NO: 46607 - protein, 238 aa, Panicum virgatum
  misc_feature: Ceres CLONE 2031437
  misc_feature (34)..(209): Pfam Name: AAA_2 Pfam Description: ATPase family associated with various cellular activities (AAA)
  misc_feature: Functional homolog of the protein sequence given in SEQ ID NO 50876
  misc_feature: Useful for making plants with modulated heat sensitivity
EETLHRRVIGQDEAVVAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFDRLKAK

SEQ ID NO: 46608 - DNA, 1059 bp, Panicum virgatum
  misc_feature: Ceres CLONE 2031441
  misc_feature: Encodes the peptide sequence at SEQ ID NO. 46609
cacatttgtccaaaacatgatacaaatatattttttgttccggaacaaattttttttgttcctgaacaaatttttcgtattgctggaacaattaaaaaattgtttcggaacaaaaaaaattgttctgaaacaaatttgactagattacacatgtgggccgaggcccaaaacattgcatatttaggacttcaccagtttcccagattccaagtttattttggaaattcaattcttcacataagatttatttcaaggaaaatgaattttagttactaattcattaaggaataaatagagtaagttatgccacactatatcaaacgtgaactttttcatattcacaaagaactcattttttatttctcttttataacagtagttaagattaaacagaatctacatgtgtggctggcctgattgaatcttaaaatagcacgggcatttattattctggtatcttaccataggttactgttatgtaaagagaaaataagtaacttttgaagaaaaaaccacaaagaataagtttcttaccattcttttgaattaaatggcaggccgagaggttataacatatgagagcccgagccccacaatgggcatccaccgtatcgtcttggtgttgtaccaacaattggggcggggcacggtgtttgcaccgcaagtgcgtcaaaacttcaacctgcgcaattttgcacaccgtttcaacctcggcaaacctgtggctgcgatgtactttaactgtcagcgtcaaacaggcacaggtgggagaaggttcacctgattattttacccctcatgttgaagttgaaggcaagcttgagcctactagttatatatgcgtgcttacctacatatggccgcattgtcataaagtttctggcacaaaatctagaaataagatgtatttattgtgcatgtaggctagtgtgcctccatgagggtaatgatgtatactttttaataatcacatgataaaagaggttagtactgggtgtactgatgatgtgacatttttgtcacatcttggtaataaatatatatatatggttctccttt

SEQ ID NO: 46609 - protein, 77 aa, Panicum virgatum
  misc_feature: Ceres CLONE 2031441
  misc_feature: The sequence is a functional homolog of SEQ ID NO 2 in US patent 7196246
  misc_feature: Functional homolog of the protein sequence given in SEQ ID NO 51722
  misc_feature: Useful for making plants with modulated flowering time
  misc_feature: The sequence is a functional homolog of SEQ ID NO 2 in US patent 7208653
MAGREVITYESPSPTMGIHRIVLVLYQQLGRGTVFAPQVRQNFNLRNFAHRFNLGKPVAAMYFNCQRQTGTGGRRFT

SEQ ID NO: 46610 - DNA, 720 bp, Panicum virgatum
  misc_feature: Ceres CLONE 2031448
  misc_feature: Encodes the peptide sequence at SEQ ID NO. 46611
cagatccttactcctctgcgagctgcttgcttgctgtgatcgttcaatccccactccatctgaatcgtatcgagtcccgtcaggtcagcctgcaggccgggctccgatcagccatggcgaacgcggcgtccggggtggcggtggcggaggagtgcacggcgcggttccaggagctgcgcacggcgcgcgcgcaccgcttcgtggtgttcaagatcgacgactccctggagcgggtggtggtcgacaaggtgggcgcccgggacgccggcttcggcgacctcaccgccagcctccccggcgacggctgccgctacgccgtgtacgaccacgacttcaccgtcggggacgccaccgcgcagggcgccccggccgaggcgccccgcagcaagatcgtcttcgtgtcgtggtccccggcgacggcggacgtgaagagcaagatggtgtacgcgagctcctgcgaggggttcaagaaggagctggacggcgtgcagatcgacctgcaggccacggagcccagcgagctcaccctcgacgtcctcaacgaccacgtcgcctgaacgactggtggtggtagtccgaaataatgtacacgtacgcacgcctgtgcgcggcgtacgatacaagatgtgtgtatccatgtacgtacgggtgtcgttgtcgtgtttggatatattgttttctgtggattggatgtgcccctgctaaatgtattgctgtttt

SEQ ID NO: 46611 - protein, 147 aa, Panicum virgatum
  misc_feature: Ceres CLONE 2031448
  misc_feature (12)..(147): Pfam Name: Cofilin_ADF Pfam Description: Cofilin/tropomyosin-type actin-binding protein
MANAASGVAVAEECTARFQELRTARAHRFVVFKIDDSLERVVVDKVGARDAGFGDLTASLPGDGCRYAVYDHDFTVGDATAQGAPAEAPRSKIVFVSWSPATADVKSKMVYASSCEGFKKELDGVQIDLQATEPSELTLDVLNDHVA

SEQ ID NO: 46612 - DNA, 581 bp, Panicum virgatum
  misc_feature: Ceres CLONE 2031453
  misc_feature: Encodes the peptide sequence at SEQ ID NO. 46613
aggcaacccacacacgcgcagcacagagcacgggcaaacagcagcaatggcggcttcatccatgatctcctcctctgctcttgcggcgccgaagggcctgccatccctcggccgcgccggctcctcctccttcgtcgtctgcggcaccggcaagaagatcaagaccgacaagcctttcggaattgggggtggcctgaccgtcgacgtcgatgcctccggcaggaaggtcaagggcaagggcgtgtaccagttcgtcgacaagtacggtgccaacgtcgatggatacagcccaatctacaaagaggaggactggtctcccagtggtgacgtctacgtcggtggaaccaccgggcttctgatctgggccgtcaccctcgccgggctcctcggcggcggcgccctcctcgtctacaacaccagcgccctcgccagctaagaacatacatatatccatgtaaattcaggccgggtgtctgtttgtaacctagtctccttcgatgcccactattaatgcacggtttatgtaacacggctactgcccttcatacttttggataatttttatgctaaatatttagact

SEQ ID NO: 46613 - protein, 129 aa, Panicum virgatum
  misc_feature: Ceres CLONE 2031453
  misc_feature (33)..(129): Pfam Name: PsbR Pfam Description: Photosystem II 10 kDa polypeptide PsbR
MAASSMISSSALAAPKGLPSLGRAGSSSFVVCGTGKKIKTDKPFGIGGGLTVDVDASGRKVKGKGVYQFVDKYGANVDGYSPIYKEEDWSPSGDVYVGGTTGLLIWAVTLAGLLGGGALLVYNTSALAS

SEQ ID NO: 46614 - DNA, 699 bp, Panicum virgatum
  misc_feature: Ceres CLONE 2031467
  misc_feature: Encodes the peptide sequence at SEQ ID NO. 46615
ccagcgcgcgtcgacgctgatggcaggctcaggatctcgccgttccacgatactgcggccgcgccccacgggtgcagcctctgccctgagaacatgtgcaagggcaagataattgagaggatccaggcaacagctggcaccaagaaccagcatttcatctacataggtgacgggaagggagattactgcccatcccttaagctgggtgaaggggactatgtcatgccaaaggagaactactccctgtggaaactcatctgcagcaacaagcagcttctcaaggctgaagttcatccatggaatagtggcgaggaactggaaaagactctacttaagttggtcgacaagataatcacccccacctgcacaggtgtcccaatttgattgcagcaaatgcgagatgagcaaaccagcatccactgaagtaggccaccatcaggctctccgtgtgccacactgaccagtgatcaattcttagtttacaagtacaggcatgagtgactgaggacttctatcaataatccatcaaactagggcaacaactcaaaatgcctaaataattgtatctgtgagctgaaaaaaggcttcagaaattacctgcttggaagtcttttttaggggtctgcttgaaagtcttcaaaccttgctcacagttcctttccaagtccaacatatacaatccagagataagtgtgctcc

SEQ ID NO: 46615 - protein, 127 aa, Panicum virgatum
  misc_feature: Ceres CLONE 2031467
  misc_feature (1)..(114): Pfam Name: Put_Phosphatase Pfam Description: Putative Phosphatase
  misc_feature: SWISSPROT Homolog: EC 3.1.3.74 Pyridoxal phosphatase
PARVDADGRLRISPFHDTAAAPHGCSLCPENMCKGKIIERIQATAGTKNQHFIYIGDGKGDYCPSLKLGEGDYVMPKENYSLWKLICSNKQLLKAEVHPWNSGEELEKTLLKLVDKIITPTCTGVPI

SEQ ID NO: 46616 - DNA, 482 bp, Panicum virgatum
  misc_feature: Ceres CLONE 2031472
  misc_feature: Encodes the peptide sequence at SEQ ID NO. 46617
acctcatcgatcgatccagccagtcgcctatcctcgcctgctgcgcgcgtctatctgctctcctagggagatctcgcgcagcgcggtaacccaccttcccacctcgtcgccgtcgcagatggccggcctcaggatgaagctcgtcgccgccgccgccacagaggcccccgccccggcgcccgcctccgacgccgccgccgcggtgcccctcgccgcggcgtccctcgccgccgccgccttcggctatctcttctgctagatccgccgcccgttccccgtgggtcctgctgatatgatgattcgttctggcgtggcgtgagtcgagtccgtgtggggaggatgtcggtgggcgtgtgtatgtacgagttcggctgcggtgtgcgagcggtggttgcgtgcgtcgacgcgccgttctctatggcgccgatcatgtactcactccgtttctggttattgatgagatcatttatttgattctttcc

SEQ ID NO: 46617 - protein, 46 aa, Panicum virgatum
  misc_feature: Ceres CLONE 2031472
  misc_feature: Functional homolog of the protein sequence given in SEQ ID NO 50452
  misc_feature: Useful for making plants with altered carbohydrate content
  misc_feature: Functional homolog of the protein sequence given in SEQ ID NO 50546
  misc_feature: Useful for making plants with altered cell wall content and/or composition
  misc_feature: Functional homolog of the protein sequence given in SEQ ID NO 50579
  misc_feature: Useful for making plants with altered lignin content
MAGLRMKLVAAAATEAPAPAPASDAAAAVPLAAASLAAAAFGYLFC

SEQ ID NO: 46618 - DNA, 715 bp, Panicum virgatum
  misc_feature: Ceres CLONE 2031473
  misc_feature: Encodes the peptide sequence at SEQ ID NO. 46619
caagcacggcctcgggagctaccatttcagaaatggcgatcgatacgccggtgagtactttggggacaagatccacgggttcggtgtctacagcttcgccaatggccattgctacgaaggctcctggcacgaaggcaagaagcagggattcgggatgtacacgttccggaatggcgacaagcgatcgggggactgggattctgggactctcaagactcccttgcccccgtctgaccctgctgttcagcgtgcagtacaggctgctcagcgggccgccgagaacgcctttcgcctgcccagagtcgacgagcaagtccataaggcggtcatggccgcgaacagggccgccacggctgctcgtgtggcggcgatcaaggctgtccagaacaggatggatggcaaattttgcgatacctatgtgtgaattgttgtgcggaagaccatggatggttttttctttcggtttttccttctaactgtacattagggtagcgaaggacaataactaatcagtgaggtccagacgaccggggcagcacaaccgctagctccgagtcagggttcagcaacgggagctgacgaagagcggagctggcgaatgggggcgaatcccatttgcgagaaacggctcggattctgcgacgccatcggcggtccccttcctcctctccctccttgcagctgtaactgtacatagatccaagtgtatcaatgg

SEQ ID NO: 46619 - protein, 140 aa, Panicum virgatum
  misc_feature: Ceres CLONE 2031473
  misc_feature (38)..(60): Pfam Name: MORN Pfam Description: MORN repeat
  misc_feature (15)..(37): Pfam Name: MORN Pfam Description: MORN repeat
  misc_feature: SWISSPROT Homolog: EC 2.7.1.68 1-phosphatidylinositol-4-phosphate 5-kinase
KHGLGSYHFRNGDRYAGEYFGDKIHGFGVYSFANGHCYEGSWHEGKKQGFGMYTFRNGDKRSGDWDSGTLKTPLPPSDPAVQRAVQAAQRAAENAFRLPRVDEQVHKAVMAANRAATAARVAAIKAVQNRMDGKFCDTYV

SEQ ID NO: 46620 - DNA, 331 bp, Panicum virgatum
  misc_feature: Ceres CLONE 2031479
  misc_feature: Encodes the peptide sequence at SEQ ID NO. 46621
gaaaatacagggaaatctgaagtgaatgttatagacgcgaagacaatgtctgctgatccagttgcagtggttgagcttcctaacagggttccgtatggattccatgccttcttcgtaaccgaggaacaactggcgcaacaagcagaggggtggtaacatatatgtagcacctgcagcagattctgcacacgccggccggtactactagacatggtgatacacagctttaccaagtcctgttattgttatagcatgatacatacaacattaattatatgtattattgcaagattacaatgcaaggtggtataaatacataatatactagtcc

SEQ ID NO: 46621 - protein, 51 aa, Panicum virgatum
  misc_feature: Ceres CLONE 2031479
  misc_feature: SWISSPROT Homolog: EC 1.13.11.51 9-cis-epoxycarotenoid dioxygenase
  misc_feature: Functional homolog of the protein sequence given in SEQ ID NO 51723
  misc_feature: Useful for making plants with modulated water use efficiency
ENTGKSEVNVIDAKTMSADPVAVVELPNRVPYGFHAFFVTEEQLAQQAEGW

SEQ ID NO: 46622 - DNA, 669 bp, Panicum virgatum
  misc_feature: Ceres CLONE 2031481
  misc_feature: Encodes the peptide sequence at SEQ ID NO. 46623
accaaacctcaagtcttgccggttgccgccgctgcggtttcgtacaggcagcttacacaccggccggccggaggcgtgcaaatcaggatcggagcttggaggatgggagactacaacaggatccacccggtgacggtgggctcgccgccgccgccgtccgcgccgccggagcatgccaggggcaagaaacccagccacgaccagctgcagctgccggtcacggcgccgctgcccccgccgccgcgtcgcagcaggcggcgctgctgccggtgcgtgtgctggaccctgctcgccgtcgtcatcctcgccgtcgcgctcgccgccacggcgggcatcctctacctcgtgttccggcccaagatccccagcttccgcgtggaccggctcaccgtcacccggttcgacgtcaacgccacgacgatgacggtgaccgacgcgttcgacgtcgacgtgaccgccaccaaccccaacaagcgcatcggcatctactacgacgggggcgacgtcgcggccttcttcaacggcacgcagctgtgccgcggctacttccccacgctgtaccaggggcaccggaccaccgtgcagccgcgcatcacgctcaccggagagacgcggctggacagcgccgtcgctgcgcagctgctgcggcaacggcaagacgggtttgtg

SEQ ID NO: 46623 - protein, 188 aa, Panicum virgatum
  misc_feature: Ceres CLONE 2031481
  misc_feature (80)..(188): Pfam Name: Hin1 Pfam Description: Harpin-induced protein 1 (Hin1)
MGDYNRIHPVTVGSPPPPSAPPEHARGKKPSHDQLQLPVTAPLPPPPRRSRRRCCRCVCWTLLAVVILAVALAATAGILYLVFRPKIPSFRVDRLTVTRFDVNATTMTVTDAFDVDVTATNPNKRIGIYYDGGDVAAFFNGTQLCRGYFPTLYQGHRTTVQPRITLTGETRLDSAVAAQLLRQRQDGF

SEQ ID NO: 46624 - DNA, 469 bp, Panicum virgatum
  misc_feature: Ceres CLONE 2031493
  misc_feature: Encodes the peptide sequence at SEQ ID NO. 46625
caatcatggaaaactggtgtctgatgagatcatcataaatcttctgtcaagacgcctggaagagggagaagaaaagggtgaattgggattcatccttgatggctttcctcggaccataagacaagcggaaatacttgaaggagtcacagatattgatttggtgatcaatctcaagctccgagaggaagccctgcttgcaaaatgccttggtagaagaatgtgcagccagtgtggaggaaacttcaatgtggcctccattgatattgagggtgagaatggtggacctcgaatgtacatgcctccgctgctgcctcctccacagtgtgaatcgaagctaattactagaccagatgatactgaagaggtggtaaaggagcgattacgggtgtaccaagacttggtatattcaactggactgagattgctttttcagagttgtatcttgctcagtattttataccgtttatgc

SEQ ID NO: 46625 - protein, 155 aa, Panicum virgatum
  misc_feature: Ceres CLONE 2031493
  misc_feature (1)..(139): Pfam Name: ADK Pfam Description: Adenylate kinase
  misc_feature: SWISSPROT Homolog: EC 2.7.4.3 Adenylate kinase
NHGKLVSDEIIINLLSRRLEEGEEKGELGFILDGFPRTIRQAEILEGVTDIDLVINLKLREEALLAKCLGRRMCSQCGGNFNVASIDIEGENGGPRMYMPPLLPPPQCESKLITRPDDTEEVVKERLRVYQDLVYSTGLRLLFQSCILLSILYRL

SEQ ID NO: 46626 - DNA, 662 bp, Panicum virgatum
  misc_feature: Ceres CLONE 2031505
  misc_feature: Encodes the peptide sequence at SEQ ID NO. 46627
tttatgcaaaagtatttccacaaaggtgccttcttccaggaaagtgctgatgatgttatccagtcagctggtaaagaggatatctacacccgtgatttctctgaacctactggggaagataagatggataagagcatcctgcccaaggtcatgcaagttaaacactttgggcgcagtggcagaacaaaatggacacatcttgttaatgaggatactacagattggaatgcaccatgggctacaaatgggcctctccgagcaaaatataatgcaaaaatggcaggcatgaatgcacctattgctaaaccaaaggggagtaagaagctgaaggactgggatgcaaaatgagatgctggcttgacctggtaggctggtactactctcagccttactgccatacaggcactacctagccaagaagtgcaaacaatgcttatgtagatacttttctttttcattttgactgcataaatcctttgataatgtgctctcatttgttagagttgaaatgtcccataatgatccactaatggtcattaggattgtactttctggtgacgtttgcatatttattgccttatgcctgtgggaatcttcaatttcacctttcattaaccattttctttgtttgctgaaccttggttttcttattccaaccaaac

SEQ ID NO: 46627 - protein, 115 aa, Panicum virgatum
  misc_feature: Ceres CLONE 2031505
  misc_feature (1)..(108): Pfam Name: MFAP1_C Pfam Description: Micro-fibrillar-associated protein 1 C-terminus
FMQKYFHKGAFFQESADDVIQSAGKEDIYTRDFSEPTGEDKMDKSILPKVMQVKHFGRSGRTKWTHLVNEDTTDWNAPWATNGPLRAKYNAKMAGMNAPIAKPKGSKKLKDWDAK

SEQ ID NO: 46628 - DNA, 732 bp, Panicum virgatum
  misc_feature: Ceres CLONE 2031509
  misc_feature: Encodes the peptide sequence at SEQ ID NO. 46629
agccatcgagaagagcacacagccagagcaacgcatacaaccttcagcaatccactcgcacccgaccgcgctcagtgacccaaccgacgacgatgtcgctggtgaggcgcagcaacgtgttcgaccccttcgccgacttctgggaccccttcgacgtcttccgctccgtggtgcccgcggcatcgaacgaccgcgacaccgtcgccttcgccggcgcgcgcatcgactggaaggagacccccgaggcgcacgtgttcaaggctgacctccccggcgtcaagaaggaggaggtcaaggtggaggtggaggacggcaacgtcctggtgatcagcggcgagcgcagcagggagaaggaggacaagaatgacaagtggcaccgcgtcgagcgcagcagcagcaagttcctccgccggttccgcttgccggagaacgccaagacggaggaggtgaaggccggcttggagaacggcgtgctcacgatcaccgtgcccaaagcagaggtcaagaagcccgaggtgaaggccatcgagatctctggctgagagttcaatctttacggtcgcgcaagctgctacgtcgtgctgtggtcgaagtatggtcgtcgtgttcctcaatcctgtgtcggtcatgtcgtggtcaatggtgtgcttgccggctggccgcgtcgacccgggagcggtattggtatttgtgtgtttcccagtggagtcgtctttgggtgttgaataaatg

SEQ ID NO: 46629 - protein, 149 aa, Panicum virgatum
  misc_feature: Ceres CLONE 2031509
  misc_feature (45)..(148): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFADFWDPFDVFRSVVPAASNDRDTVAFAGARIDWKETPEAHVFKADLPGVKKEEVKVEVEDGNVLVISGERSREKEDKNDKWHRVERSSSKFLRRFRLPENAKTEEVKAGLENGVLTITVPKAEVKKPEVKAIEISG

SEQ ID NO: 46630 - DNA, 729 bp, Panicum virgatum
  misc_feature: Ceres CLONE 2031555
  misc_feature: Encodes the peptide sequence at SEQ ID NO. 46631
acacaggagcccgcggagtgatcaaaaaagcaagtaacaagagaagatgaccgacgttgtgatgaccatcagtactaccacggatttggaaagagaactgaataaacccgacaagctgattgtgctggagttcatggcgccgtggagcgagccatgcaaggtcatgaaggaaccttataggcgaatcgccagagcaagaaaagacacagtcaacttctacacgctcaacgtcgacaagttcaaagatttggcggaggaagctggcgtggaggcgctaccgacgtacgttctactgaagaatgacgatgtgatggacatggtcgttggcgtcaggaggcacgagctcgagaacgccataaaaaacaatatctaacgactgatccgatcagatcattcatgcgtcgagaacgaacgggaaatgaatgattcatagttaaataagcccactactgtacgtcccatgtgttgtatcacggatactgaaactcgtgtgtgcatgtacacatcctagctagctcagccgccgtagcagctagctacgatgcattgtacgtatggatctcgattatcgattgtcccatgtttgatttcctaaacttctgtggaactagatccccatgttatgtatactctggtttgaaacagtttgcaataaatcaatgtctggctagtatatttcttatttttgtttaaatagaataatattggtttgagaatattgtatctgtt

SEQ ID NO: 46631 - protein, 108 aa, Panicum virgatum
  misc_feature: Ceres CLONE 2031555
  misc_feature (4)..(107): Pfam Name: Thioredoxin Pfam Description: Thioredoxin
  misc_feature: SWISSPROT Homolog: EC 1.8.1.8 Protein-disulfide reductase
MTDVVMTISTTTDLERELNKPDKLIVLEFMAPWSEPCKVMKEPYRRIARARKDTVNFYTLNVDKFKDLAEEAGVEALPTYVLLKNDDVMDMVVGVRRHELENAIKNNI

SEQ ID NO: 46632 - DNA, 440 bp, Panicum virgatum
  misc_feature: Ceres CLONE 2031579
  misc_feature: Encodes the peptide sequence at SEQ ID NO. 46633
ctctttgtttctttcctttttttttcttttttttcttttttcttttcagttttttttggttcctcctcccgttggggttttcggccccgacgaaaccctaataaccggcggggggcgatcgccggcggcatgcaccagcagcggatgaagcaggccgcggcggcggcggcggcgcagcagcagcagcagctgatgcagcaggcgctgctcctgcagcagcagcagcagcagccgcccttgttccccgggcaccacccgcaccccggcctcctcgccgcgccgcagatagagcccatagttagtggaaaccttcctcctgggtttgattcaagtacatgccgcagcgtgtatattggcaatatccatcttcaagtgacggacacgttactgcaggaagtcttccaaagtattggtccagtagaaggttgcaagctcatcag

SEQ ID NO: 46633 - protein, 103 aa, Panicum virgatum
  misc_feature: Ceres CLONE 2031579
  misc_feature: Functional homolog of the protein sequence given in SEQ ID NO 50307
  misc_feature: Useful for making plants with altered lignin content
MHQQRMKQAAAAAAAQQQQQLMQQALLLQQQQQQPPLFPGHHPHPGLLAAPQIEPIVSGNLPPGFDSSTCRSVYIGNIHLQVTDTLLQEVFQSIGPVEGCKLI

SEQ ID NO: 46634 - DNA, 711 bp, Panicum virgatum
  misc_feature: Ceres CLONE 2031583
  misc_feature: Encodes the peptide sequence at SEQ ID NO. 46635
atacccacccccttcacgtgacatccccttcagcgcgcggccggcccgacttcccacccccttcccgccgttaaacacctccccgtcaccgccgtccgccgtcgccggcgaagatgatgtccggcggtgggtactcctccctcgacgaccccaaggcctcaggatccgtcccggcggcgacggggccagatccgccggccatcaggttcgcggaatccaacctccagaccttcccgccgcccgacgccaggggcaagatctccggcgcctaccgcccgcccaccgacgccgacgataccttctcgtccaaggctggaggaggcggtgccggtggcggcggcagaggaggcggcgccggatcggacgacgccgcgcagggcggatggttccggatattctccgtggcggcgtacaagccctacttcgatgtcgacacctccgacgtcgtcgagaggatctgggagtccgtcttccccttccgcggcacattcaccgagaagacctccgagaaccccgacctgtatgggccgttctggacatgcaccaccctgattttcgttgctgcatctattgccacctttgtcacctacctatcacacaaatggcacgagaaggagtggaattatgacattaatttggttacctggtctgctggcttattctatggctatgtgacgtttgttccccttctgttatatgttattcttaagt

SEQ ID NO: 46635 - protein, 199 aa, Panicum virgatum
  misc_feature: Ceres CLONE 2031583
  misc_feature (104)..(199): Pfam Name: Yip1 Pfam Description: Yip1 domain
MMSGGGYSSLDDPKASGSVPAATGPDPPAIRFAESNLQTFPPPDARGKISGAYRPPTDADDTFSSKAGGGGAGGGGRGGGAGSDDAAQGGWFRIFSVAAYKPYFDVDTSDVVERIWESVFPFRGTFTEKTSENPDLYGPFWTCTTLIFVAASIATFVTYLSHKWHEKEWNYDINLVTWSAGLFYGYVTFVPLLLYVILK

SEQ ID NO: 46636 - DNA, 763 bp, Panicum virgatum
  misc_feature: Ceres CLONE 2031588
  misc_feature: Encodes the peptide sequence at SEQ ID NO. 46637
  misc_feature (678)..(678): n is a, c, t, g, unknown, or other
catctgatcacaagaatgtgctgccccaaagagcaaaggaaatatcaaccaaggagataaatgatattcatggaagcagatatagaaaacctgtgaagccatcaccagcagatcaattgatcaaacgagaggaaagagaaatgggagatacaggtgtcaagccttatatgatctacctgtcccagaaaaaaggcttcttatatgcctttctttgtgttacttcccacatgattttcttagctgcacaaatatcgcagaattcatggatggctgctaatgtccaaaatcccagtgttagcacattgaagttgatttctgtttacatatttattggagtttgctcagtgttcttcatactttcaagaactttatcagccattgttcttgggctgcagacatcaagatccctattttcccagttactaaactcattattccgtgcacccatgtcattttttgattctactcctcttggaagggttcttagccgggtttcttctgatctgagtattattgaccttgatgttccaatggtcttcatgtttaccagtagtgccagcttaaatgcatatagtaatctaggggtattagctgttgttacatggcaagttctgtttgtttctgtgccaatgatagttttagcaatcacattgcaggtaatttggataggttttgtangttagatcatattttgtgggttatctttagttaccaatcaaatccacagttccctcttgaatgaaatatgctgtatttgattgtg

SEQ ID NO: 46637 - protein, 226 aa, Panicum virgatum
  misc_feature: Ceres CLONE 2031588
  misc_feature: SWISSPROT Homolog: EC 3.6.3.44 Xenobiotic-transporting ATPase
  misc_feature (226)..(226): Xaa is any aa, unknown, or other
SDHKNVLPQRAKEISTKEINDIHGSRYRKPVKPSPADQLIKREEREMGDTGVKPYMIYLSQKKGFLYAFLCVTSHMIFLAAQISQNSWMAANVQNPSVSTLKLISVYIFIGVCSVFFILSRTLSAIVLGLQTSRSLFSQLLNSLFRAPMSFFDSTPLGRVLSRVSSDLSIIDLDVPMVFMFTSSASLNAYSNLGVLAVVTWQVLFVSVPMIVLAITLQVIWIGFVX

SEQ ID NO: 46638 - DNA, 307 bp, Panicum virgatum
  misc_feature: Ceres CLONE 2031607
  misc_feature: Encodes the peptide sequence at SEQ ID NO. 46639
tgtgaggtctttgctggatgctgtgcgttccgaactaatggcttcaaaagaggctttcaccttctctcgcaggcaaattgaagaccaagcagcgcagttgagtaagcaagtgcaggaactcacagaccaaaaagcattgcttatttcttatactcagaatctggaagctgctcaactggagattcaagaaaagacaaatgagctcagtgctgtacaatctcgttgtagtgaacttgaatcgcagttaattgaggagatgaagaaggttgagtccctagaggctatgttaactaaagaaagggagagc

SEQ ID NO: 46639 - protein, 101 aa, Panicum virgatum
  misc_feature: Ceres CLONE 2031607
  misc_feature: SWISSPROT Homolog: EC 3.6.3.14 H(+)-transporting two-sector ATPase
VRSLLDAVRSELMASKEAFTFSRRQIEDQAAQLSKQVQELTDQKALLISYTQNLEAAQLEIQEKTNELSAVQSRCSELESQLIEEMKKVESLEAMLTKERE

SEQ ID NO: 46640 - DNA, 585 bp, Panicum virgatum
  misc_feature: Ceres CLONE 2031611
  misc_feature: Encodes the peptide sequence at SEQ ID NO. 46641
tgaaggtcacgacgggggaggcgtggtgcgtggcgaacgcgatggtcggggagcagcggctgcaggcggcgctcaactacgcgtgcggcgagggcggcgcggactgcaaggccatccagcccggcgcggcgtgcttcgagcccaacaccatggtggcgcacgcctcctacgccttcaacgactactaccagcgcaagggccggtccatcggcacctgcgacttcgctggcgccgcctacgtcgtcaaccaggcaccgaagatgggcaagtgcgacctcccatcgacggtctgaactctgaagaactgaaacaacagtggcgaggattccaggccggccatcagccatcagcggatgtaggaatctttgcgccctttcaccctttctttactctgctgcagccttgactagtagaaaaccaacaccgctgtagctgtacgcctttcttttttgcagccttggctgatggggggtacctttgtttagtctactatgtaactatgctactgttataagctgattagtataggttaattaatggcttagcctttgctcccatgttatgtgacccactagggtttgtctc

SEQ ID NO: 46641 - protein, 96 aa, Panicum virgatum
  misc_feature: Ceres CLONE 2031611
  misc_feature (7)..(92): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50689
  misc_feature: Useful for making plants with altered carbohydrate content
  misc_feature: Functional homolog of the protein sequence given in SEQ ID NO 51724
  misc_feature: Useful for making plants with altered cell wall content and/or composition
KVTTGEAWCVANAMVGEQRLQAALNYACGEGGADCKAIQPGAACFEPNTMVAHASYAFNDYYQRKGRSIGTCDFAGAAYVVNQAPKMGKCDLPSTV

SEQ ID NO: 46642 - DNA, 712 bp, Panicum virgatum
  misc_feature: Ceres CLONE 2031616
  misc_feature: Encodes the peptide sequence at SEQ ID NO. 46643
atgggcacattcgggtatttggcacctgagtatgcgtcttccggcaagctcacagaaaaatcagatgtattttctttcggagtcatgctccttgagctaataactggtcggcgaccagttgacacaacccaaacatatatggatgacagcttggttgactgggcaaggcctttactgatgcgagcacttgaggatggtgaatatgattctttggtggaccctcggctaggcaaggacttcaatcctaatgagatggcaagaatgatagcttgtgctgctgcatgtgtacgccattctgcacgtcggcgtccacgcatgagccaggttgttcgggcattggaaggtgatgtgtcgctggaggatctcaacgaaggtgtccgacctggtcacagccgcttattcgggtcgtacagcagttccgactatgactcaggccaatacaacgaagacatgaagaagttcaggaagatggctttcaacaccaacaactacaccagcagccagtacagcgccccgaccagcgaatacgggcagataccgtccgcctcgagcagcgagggccaccaaacccaggagatggagtcgggcgcgatgaagaaaagcgcctacagcggctacagctcaggatacagcggagcctcgtgagggagttccattttttcctctttttcccctctttttttctttgtccttatgacgtctattgcaattt

SEQ ID NO: 46643 - protein, 214 aa, Panicum virgatum
  misc_feature: Ceres CLONE 2031616
  misc_feature: SWISSPROT Homolog: EC 2.7.11.1 Non-specific serine/threonine protein kinase
  misc_feature: Functional homolog of the protein sequence given in SEQ ID NO 50776
  misc_feature: Useful for making plants with altered carbohydrate content
MGTFGYLAPEYASSGKLTEKSDVFSFGVMLLELITGRRPVDTTQTYMDDSLVDWARPLLMRALEDGEYDSLVDPRLGKDFNPNEMARMIACAAACVRHSARRRPRMSQVVRALEGDVSLEDLNEGVRPGHSRLFGSYSSSDYDSGQYNEDMKKFRKMAFNTNNYTSSQYSAPTSEYGQIPSASSSEGHQTQEMESGAMKKSAYSGYSSGYSGAS

SEQ ID NO: 46644 - DNA, 834 bp, Panicum virgatum
  misc_feature: Ceres CLONE 2031621
  misc_feature: Encodes the peptide sequence at SEQ ID NO. 46645
tttaacccaagaacacgtaagagacctcaagcttaagcccagctcgaaggacgacagcatcagcagcatacagcatccatggcttccgtcctcctcctccacgcaaagcttggagctttcgtcttctccctgaccctcctcctctcctccgcgctcggggcgagggtggtgtgcgagcagctgacggcggagctgtgcgcgttcgccgtgtcgtccacgtcgcggcggtgcgtgctggagaacacgcactgcgccgggcggccgacggcgtaccagtgccggacgtcggaggtggtggtcgaggacgcgcggctggcggggctggtggagacggaccgctgcgtgcgcgcgtgcggcgtcgaccgcgccaccgtcggcatctcctccgactccctcctcgacccgcgcgtcgccggcgccgtctgctcaccggcgtgcctccaggggtgccccaacatcgtcgacctatactccaacctcgccgccggagagggcgtagctttctcagaaatgtgtgaggtacaccgcgccaaccctcgccgtgccatggcacagctccagagctccggtgaggcaggcgtgcggttggatgctgctgctccttcaccagctgcgcctccttcagagtcagcttaatctctagatacacgtatgatattaattcatagataaatttattacaccacagctcgctgattggagagctgtatcatttttacgtgaacatgtattattaattattgtaataactttaaaattactttctcgcctctcagattacaccatagctcttgttttcttttctttttaatgaaggtcattgggctgcgaacc

SEQ ID NO: 46645 - protein, 185 aa, Panicum virgatum
  misc_feature: Ceres CLONE 2031621
  misc_feature (5)..(182): Pfam Name: PAR1 Pfam Description: PAR1 protein
MASVLLLHAKLGAFVFSLTLLLSSALGARVVCEQLTAELCAFAVSSTSRRCVLENTHCAGRPTAYQCRTSEVVVEDARLAGLVETDRCVRACGVDRATVGISSDSLLDPRVAGAVCSPACLQGCPNIVDLYSNLAAGEGVAFSEMCEVHRANPRRAMAQLQSSGEAGVRLDAAAPSPAAPPSESA

SEQ ID NO: 46646 - DNA, 322 bp, Panicum virgatum
  misc_feature: Ceres CLONE 2031623
  misc_feature: Encodes the peptide sequence at SEQ ID NO. 46647
tggatttggccatggcctctgcatctggagtcggcttcaaatgtcccatgggctctgaggcacttgaaatttaccgaaagctctgcggggatggctgcgaactcaaggacttctcatgtgtattccgccattactatgctggcaaggatgaagagtgacctgctagttactctagcaaacttgccgcttgttcaaatgaacaaaacaaaaataaagtttctggaatggttccagtgtaaatctgtagagttgtactgagatatggtggctttgtaaactgtttgttggtttgcttctcggcaatggcaatagactgttcgag

SEQ ID NO: 46647 - protein, 51 aa, Panicum virgatum
  misc_feature: Ceres CLONE 2031623
  misc_feature: SWISSPROT Homolog: EC 1.1.1.31 3-hydroxyisobutyrate dehydrogenase
DLAMASASGVGFKCPMGSEALEIYRKLCGDGCELKDFSCVFRHYYAGKDEE

SEQ ID NO: 46648 - DNA, 561 bp, Panicum virgatum
  misc_feature: Ceres CLONE 2031630
  misc_feature: Encodes the peptide sequence at SEQ ID NO. 46649
gagagcagttggacacaccctgcaggagggctcacccgtagagagctcgccacaccaccaccaagtattaagaggcgagaggttgacgtacaagcagctagctagcctacaggtcgtttcaggggaaaaggagaagagaagagaagatgcaggactgggcgccggtgttcatctcgctggtgctcttcatcctgctgtcgccgggcctgctgttccagatccccggcaagtgccggatcatcgagttcggcaacttccacaccagcgcgctctccatcctcgtccactccatcctcttcttcgccctcatcgccatcttcctcatcgccatcggcgtgcacatgtacctcgggtcctagctagctggtagtagcttttgttagcctgatgcctacctcggtgtttgtcgatcagcttgcagctcgatcgtgttcttctctgctagtcgcccatctctaattaagagttctttctctatacacgtgttgaataacaatgtatgtatcatccatgttcatttctttcttcttctaataataataataacaaagttcaatcttc

SEQ ID NO: 46649 - protein, 70 aa, Panicum virgatum; identical to SEQ ID NO: 14710
  misc_feature: Ceres CLONE 2031630
  misc_feature: Functional homolog of the protein sequence given in SEQ ID NO 50117
  misc_feature: Useful for making plants with altered cell wall content and/or composition

SEQ ID NO: 46650 - DNA, 518 bp, Panicum virgatum
  misc_feature: Ceres CLONE 2031632
  misc_feature: Encodes the peptide sequence at SEQ ID NO. 46651
acctcatcgaccgagccagccatccagccagtcgcctatcctcgcctgctgcgcgcctctctgctctcctaggcagatctcgcgcagcgcggtaacccaccttcccacctcgtcgccgtcgcagatggccggcctcaggatgaagctcgtcgccgccgccgccgtggccgccgcgctcgtggcgtccgccgccgccgccaccgaggcccccgccccggcgcccggctccgacgccaccgccgcggtgcccctcgtcgcggcgtccctcctcgccgtcgccttccgctacctcttctgctacatccgccgcgcgttctccgtgggctccgtcgatatgatgatgcaccccggggcgtcgcgagtcgggtccagctggggaggatgtcaatgggagcgtgtaggtacgagatcagctgcggtggcggtggtgtgctaccgggggatgcgcgcgtcgacactccgtactccatggtccctatcatggacgcacaccgatgctggtaacagccgagatcatt

SEQ ID NO: 46651 - protein, 131 aa, Panicum virgatum
  misc_feature: Ceres CLONE 2031632
  misc_feature: Functional homolog of the protein sequence given in SEQ ID NO 50390
  misc_feature: Useful for making plants with altered carbohydrate content
MAGLRMKLVAAAAVAAALVASAAAATEAPAPAPGSDATAAVPLVAASLLAVAFRYLFCYIRRAFSVGSVDMMMHPGASRVGSSWGGCQWERVGTRSAAVAVVCYRGMRASTLRTPWSLSWTHTDAGNSRDH

SEQ ID NO: 46652 - DNA, 530 bp, Panicum virgatum
  misc_feature: Ceres CLONE 2031644
  misc_feature: Encodes the peptide sequence at SEQ ID NO. 46653
tgatcgtaaagttgtccgaaacttccgtaaagatggccataattggaagaaaaagaaggatggcaagactgtccaagaagcccatgaaaaattaaagattggtaatgaagaaaaggttcatgtgtattatgctcgaggagaggaagatccaaatttctttcgtagatgctactggctgcttgacaaagagttggagcgcatagttcttgtgcattatcgtcaaacatctgaggaaaatgtcataccaccaccacatatagaagctgaagttgcagaagtgcctccaatcaatattattcattatacctctcctctaacatcaacagattctgcctctgctcgtactgagctatcttcttgtgcagctgctgcaccagaagaaattaactcacatggtggcagagcgatttcttgtgaaacagatgatcatgattctagaaatttctgtacacaagaaacaagcatcagttattgtgagttcgaataatctgagggtcaggccaatagaataatttggatcttttgtttgg

SEQ ID NO: 46653 - protein, 161 aa, Panicum virgatum
  misc_feature: Ceres CLONE 2031644
  misc_feature (1)..(76): Pfam Name: CG-1 Pfam Description: CG-1 domain
DRKVVRNFRKDGHNWKKKKDGKTVQEAHEKLKIGNEEKVHVYYARGEEDPNFFRRCYWLLDKELERIVLVHYRQTSEENVIPPPHIEAEVAEVPPINIIHYTSPLTSTDSASARTELSSCAAAAPEEINSHGGRAISCETDDHDSRNFCTQETSISYCEFE

SEQ ID NO: 46654 - DNA, 447 bp, Panicum virgatum
  misc_feature: Ceres CLONE 2031657
  misc_feature: Encodes the peptide sequence at SEQ ID NO. 46655
agcaagcccagcaaacaaactccgaagcgactgacgatcagaggcgtctttcagagcgcagcagttcgccgacaaatccccactccgaccttcaatcccgatcatcattcaacgacaatgtcgctgatccgctgcagcaacgtgttcgaccccttctccctcgacctctgggaccccttccagggattccccttcggctccggcagcggcagcctcttcccgcgcatctcctccgactccgacgccgcggcgttcgctggtgcgcgcatcgactggaaggagacccccgaggcccacgtgttcaaggcggacgtgccggggctgaagaaggaggaggtgaaggtggaggtcgaggacggcaacgtgctccagatcagcggcgagcggagcaaggagagaagaacgacaggtggccgcaatagaggaagatgttgatgtccttccttc

SEQ ID NO: 46655 - protein, 105 aa, Panicum virgatum
  misc_feature: Ceres CLONE 2031657
  misc_feature (52)..(105): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRCSNVFDPFSLDLWDPFQGFPFGSGSGSLFPRISSDSDAAAFAGARIDWKETPEAHVFKADVPGLKKEEVKVEVEDGNVLQISGERSKERRTTGGRNRGRC

SEQ ID NO: 46656 - DNA, 701 bp, Panicum virgatum
  misc_feature: Ceres CLONE 2031719
  misc_feature: Encodes the peptide sequence at SEQ ID NO. 46657
aaggcttttggtgctgaactggtccttactgaccctctcctgggaatgaaaggagctgtcaaaaaggcggaggagattcaagcaaagacacccaactcgtacatccttcaacaatttgaaaatcctgctaacccaaagattcattatgagactacggggcctgaaatctggaaagctacatcaggaaagattgatggccttgtatctggtattgggacaggaggtaccataactggaactggtcgatacctcagagaacaaaatcctaatgtcaagctctatggtgtggagccagtagagagtgctgttttaaatggtggaaaacccgggccacacaagattcaaggaattggagctggttttattcctggggtcttggatgttgacctcattaatgaaactctacaagtttcaagcgatgaagctattgagactgcaaaggcacttgctttgaaagaaggattgttggttggaatctcttctggtgctgctgcggctgcagccgttagattggctaagaggcctgaaaatgctggaaagctatttgttgtcgtcttcccaagctttggtgagcgctacctgtcgtctgtgcttttccagtccatcaagaaggaagcggagagcatggtggtcgagccctagagtacacaattcgagcagatattttgggggaaggtctccatttccacagaaataaagct

SEQ ID NO: 46657 - protein, 213 aa, Panicum virgatum
  misc_feature: Ceres CLONE 2031719
  misc_feature (1)..(188): Pfam Name: PALP Pfam Description: Pyridoxal-phosphate dependent enzyme
  misc_feature: SWISSPROT Homolog: EC 2.5.1.47 Cysteine synthase
  misc_feature: Functional homolog of the protein sequence given in SEQ ID NO 51108
  misc_feature: Useful for making plants with modulated cold sensitivity
KAFGAELVLTDPLLGMKGAVKKAEEIQAKTPNSYILQQFENPANPKIHYETTGPEIWKATSGKIDGLVSGIGTGGTITGTGRYLREQNPNVKLYGVEPVESAVLNGGKPGPHKIQGIGAGFIPGVLDVDLINETLQVSSDEAIETAKALALKEGLLVGISSGAAAAAAVRLAKRPENAGKLFVVVFPSFGERYLSSVLFQSIKKEAESMVVEP

SEQ ID NO: 46658 - DNA, 683 bp, Panicum virgatum
  misc_feature: Ceres CLONE 2031722
  misc_feature: Encodes the peptide sequence at SEQ ID NO. 46659
cggccacgacatgatgatggcagccgcctactacaagcaggtgtcctcccgcgccgtcgccgctgcgctactctgcctgctcctggctcatggcaccagctgcggcggctccaagcacaagaccggacggcccaaggcccacgccgccgccgccgcaccgacgacgacaccaccacctgctacgtcgacaccaccgaattccagcgccggcgacgggtcgtggctcaacgcccgggcgacgtggtacggcgcccccaacggcgccggcccggacgacaacggcggcgcctgcggcttcaagggcgtgaacctgccgcccttctcggccatgacgtcctgcgggaacgagccgctcttcaaggacggcaaaggatgcggctcctgctaccagatccgctgcgttgcccaccctgcttgctccggcatcccggagacggtcatcatcacggacatgaactactacccggtggcgccctaccacttggacctcagcggaacagccttcggcgccatggccaaggacgaccgcaacgacgagctcaggcacgccggcatcatcgacatacagttcaagagggttgcttgccagtaccctggtctgacggtgaccttccacatcgagcgcggctccaaccccaactacctggcggtgcttgtggagtactccgacggcgacggcgacg

SEQ ID NO: 46659 - protein, 224 aa, Panicum virgatum
  misc_feature: Ceres CLONE 2031722
  misc_feature (108)..(187): Pfam Name: DPBB_1 Pfam Description: Rare lipoprotein A (RlpA)-like double-psi beta-barrel
  misc_feature: Functional homolog of the protein sequence given in SEQ ID NO 51060
  misc_feature: Useful for making plants with altered carbohydrate content
  misc_feature: Functional homolog of the protein sequence given in SEQ ID NO 50375
  misc_feature: Useful for making plants with altered cell wall content and/or composition
MMMAAAYYKQVSSRAVAAALLCLLLAHGTSCGGSKHKTGRPKAHAAAAAPTTTPPPATSTPPNSSAGDGSWLNARATWYGAPNGAGPDDNGGACGFKGVNLPPFSAMTSCGNEPLFKDGKGCGSCYQIRCVAHPACSGIPETVIITDMNYYPVAPYHLDLSGTAFGAMAKDDRNDELRHAGIIDIQFKRVACQYPGLTVTFHIERGSNPNYLAVLVEYSDGDGD

SEQ ID NO: 46660 - DNA, 489 bp, Panicum virgatum
  misc_feature: Ceres CLONE 2031731
  misc_feature: Encodes the peptide sequence at SEQ ID NO. 46661
atctcatcgatcgagccatccatccatccatccatccagccgcctctcctcgcctgctgcgcgcgtctctctgctctccgagggagatctcgcgcagcccggaaacccgtcgacccagctcgtcctcgtggcgtcggccgccgccgccactgaggcccccgccccggcgcccgcctccggcgccgccgccgcggtgcccctcgcggcggcgtccctcgccgccgccgccttcggctacctcttctgctagatccgtcggccgttctccgcgggtggtcctgctgatgatatgatgattcgttttggcgtgagtcgagtccgtgtccgtggcgtgtggggatgatgtcggtgggcgtgtgtatgtacgagttcggcggcggtgggggtggtgtgcgagcggtgggggcgtgcgtcgacgcgccgttctctgtggcgtcgatcatgtactcactccgtttctggttattgatgagatcatttatttgattc

SEQ ID NO: 46661 - protein, 82 aa, Panicum virgatum
  misc_feature: Ceres CLONE 2031731
  misc_feature: Functional homolog of the protein sequence given in SEQ ID NO 50452
  misc_feature: Useful for making plants with altered carbohydrate content
  misc_feature: Functional homolog of the protein sequence given in SEQ ID NO 50546
  misc_feature: Useful for making plants with altered cell wall content and/or composition
  misc_feature: Functional homolog of the protein sequence given in SEQ ID NO 50579
  misc_feature: Useful for making plants with altered lignin content
SHRSSHPSIHPSSRLSSPAARVSLLSEGDLAQPGNPSTQLVLVASAAAATEAPAPAPASGAAAAVPLAAASLAAAAFGYLFC

SEQ ID NO: 46662 - DNA, 660 bp, Panicum virgatum
  misc_feature: Ceres CLONE 2031757
  misc_feature: Encodes the peptide sequence at SEQ ID NO. 46663
acctcccaccgacatcttgcggagttgcagtcctacctcttccgatccgtcccgcccgccgcctcagcttgggattagttcttctccgcgcggagatccgtgagccatggctgctgagatgtgcaagggcattggacccctgatttcctttattgctggcgctatattggagagcttaattatatgatgttttcttggtctgattatcttcagttgaccatgcagactgttgtcctcaaggtggctatgtcatgccagggttgcgccggggcggtcaggagagtgctctcaaagatggaaggagttgagacctttgacatagacctcaaggaacagaaggtgacagtcaaaggcaatgtcaagcctgaggatgtcttccagacggtttccaagtccgggaagaagacctcctactgggaaggcgaagccacagcccaggctgctccggctccagctgcagaagcagctcccagcactgaggcagaagcgcctgccgcggaggctgcaccagagagcactccagccgaagctgctgcaccagagatcaccccagtcaaatctgacgcttgatcgtcacatgagatgatgtgaccccaaaaccttactctagaactagctgggaaaccgagtcttgtgtggtttgcatcatgttgttgccac

SEQ ID NO: 46663 - protein, 128 aa, Panicum virgatum
  misc_feature: Ceres CLONE 2031757
  misc_feature (16)..(77): Pfam Name: HMA Pfam Description: Heavy-metal-associated domain
  misc_feature: SWISSPROT Homolog: EC 3.6.3.4 Copper-exporting ATPase
MMFSWSDYLQLTMQTVVLKVAMSCQGCAGAVRRVLSKMEGVETFDIDLKEQKVTVKGNVKPEDVFQTVSKSGKKTSYWEGEATAQAAPAPAAEAAPSTEAEAPAAEAAPESTPAEAAAPEITPVKSDA

SEQ ID NO: 46664 - DNA, 562 bp, Panicum virgatum
  misc_feature: Ceres CLONE 2031764
  misc_feature: Encodes the peptide sequence at SEQ ID NO. 46665
cgcctcatgttgcttcaaccatcaaaagctacatgaaagagcacaatgtctcaattcagattgcacgcaagaagatagaggaacttaaagaggatacatggaaagattttaaccatgagtggttgaaccctgataatggagtgcccaggcagctactggagagcatattcaacatgaccaggacgatggaattcatgtacaaccaggatgataatttcactaacagtcagaacctcaaggataccatccatttgttgtttgtggagccctttgctatctccttctagtacagacaattccaacaaataaagtgtgttgtctaatgccgaggaaaggaagcccatatcaaccggcacaatataaatatgggcactttgcacagtacattgattagtagaatgcacatttgctatgcaagagaaaaggcaaggactaggaattgttgcctgtcttgcctgctttgcgagccagtcagccacattgtttgagtccctgttgattttgatgatcgaatgttgcatccctttagtgatttgtgcaaacttagaaagaattggttgcg

SEQ ID NO: 46665 - protein, 94 aa, Panicum virgatum
  misc_feature: Ceres CLONE 2031764
  misc_feature: SWISSPROT Homolog: EC 4.2.3.24 Amorpha-4,11-diene synthase
PHVASTIKSYMKEHNVSIQIARKKIEELKEDTWKDFNHEWLNPDNGVPRQLLESIFNMTRTMEFMYNQDDNFTNSQNLKDTIHLLFVEPFAISF

SEQ ID NO: 46666 - DNA, 680 bp, Panicum virgatum
  misc_feature: Ceres CLONE 2031776
  misc_feature: Encodes the peptide sequence at SEQ ID NO. 46667
atagccagctttcccttctcccccaactccggcggcggcgcggaaggcttccggtcggtctccgcctctcttttggcgccaaatccatccgcccctccgattccgggccttccagttttgtcaggtgccaacagttgagaatggtactgaagcgcctgaggagatgctgctgttgcagtgcaaagcacactgatggcgaggacaagattgattatgggggtggcaatgttcatgtcattacaagcaaagaaaactgggaccaaaaaattgaagaggcaaacaaggatgggaaaattgtggttgcgaatttcagtgcttcctggtgtgggccgtgccgggtcatctcaactgtttatgctgagatgtcgcagacgtacccacagctcatgttcttggcagtcgatgtcgacgagttaatggagttcagctcgtcgtgggacatccgggcgacaccgacgttcttcttcctgaagaacgggcagcaggtggacaagctggtcggcgccaacaagcccgagcttgagaagaaagtcgccgcggtcgccggtggcagcgtggcacctgacgccaagtgacaggacgacggtgtgggctgatatcatatcaacattcatcgaccagcccgtgcaaaactcgttctacccgtgcatgagcttgtttttcaccccgttgcgtagccg

SEQ ID NO: 46667 - protein, 144 aa, Panicum virgatum
  misc_feature: Ceres CLONE 2031776
  misc_feature (30)..(134): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MVLKRLRRCCCCSAKHTDGEDKIDYGGGNVHVITSKENWDQKIEEANKDGKIVVANFSASWCGPCRVISTVYAEMSQTYPQLMFLAVDVDELMEFSSSWDIRATPTFFFLKNGQQVDKLVGANKPELEKKVAAVAGGSVAPDAK

SEQ ID NO: 46668 - DNA, 511 bp, Panicum virgatum
  misc_feature: Ceres CLONE 2031787
  misc_feature: Encodes the peptide sequence at SEQ ID NO. 46669
taatcgatgaagctttaggaaaggaagttaaagttgcagtgtgcagtacatcaaatgagaaagctgtttcagcaatagtgtcatgcttattagggcctgacagagcagaaaagattgccatatttgccggggatgtcgttcctcgcaaaaaacctgacccggcaatctacatattagcggcaactacacttggagttgatccatctagctgtgttgttgttgaggacagtactattggacttgcagcggccaaagctgctggcatgaagtgtattgtaacaaaaagcggctacactgcacaagaggactttgcgacagcagatgccgtattcgattgcatcggagacccacccgaagcacgctttgatttggatttctgtgcggacctgctccgcaaacactatgtaagctaaacgaagggcacattcatggtacaccttgttacaaaacaagtattgtttgtaaaggacctcaaatataaaaacaaacaacaatgtgttgtacatgtaac

SEQ ID NO: 46669 - protein, 136 aa, Panicum virgatum
  misc_feature: Ceres CLONE 2031787
  misc_feature: SWISSPROT Homolog: EC 3.1.3.18 Phosphoglycolate phosphatase
IDEALGKEVKVAVCSTSNEKAVSAIVSCLLGPDRAEKIAIFAGDVVPRKKPDPAIYILAATTLGVDPSSCVVVEDSTIGLAAAKAAGMKCIVTKSGYTAQEDFATADAVFDCIGDPPEARFDLDFCADLLRKHYVS

SEQ ID NO: 46670 - DNA, 677 bp, Panicum virgatum
  misc_feature: Ceres CLONE 2031799
  misc_feature: Encodes the peptide sequence at SEQ ID NO. 46671
acgctaccagcccaaccacccagcgaccgtctcttccagtctcctcgcgagtttccttcaacctcccgtcctcttcgatccgtgcgccatggcgcccaaggcggagaagaagccggccgagaagaagcccgcggagaaggccgagaaggcccccaaggcggagaagaagcccaaggccgagaagcggctgccggcgtccaaggagggcggcgacaagaagggcaagaagaaggccaagaagagcgtcgagacctacaagatctacatcttcaaggtgctaaagcaggtgcacccggacatcggcatctcctccaaggccatgtcgattatgaactcgttcatcaacgacatcttcgagaagctcgcgcaggaggctgcgcgcctcgccaggtacaacaagaagcccaccatcacgtcgcgcgagatccagacctcggtccgccttgtcctccccggcgagctcgcgaagcacgccgtctccgagggcaccaaggccgtcaccaagttcacctcctcctagattgctagatgatgcgccccctttgaccttgtctgttcttcgcctcttttccctagttaggggtcgaggattagtttgtaattgatgatgctggtttacgaaacgatgaaatgaattggcaatgccacgtttggtatctgaatatcttgtcactgta

SEQ ID NO: 46671 - protein, 143 aa, Panicum virgatum
  misc_feature: Ceres CLONE 2031799
  misc_feature (50)..(120): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPKAEKKPAEKKPAEKAEKAPKAEKKPKAEKRLPASKEGGDKKGKKKAKKSVETYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 46672 - DNA, 546 bp, Panicum virgatum
  misc_feature: Ceres CLONE 2031816
  misc_feature: Encodes the peptide sequence at SEQ ID NO. 46673
gtagccgcacgatctgttctccaggtaatgaaagggttggtccacgatggggcctccccttccccagtaccgcctcttcgtgcgtctcctccagggtcatgtactccccaaactcgagctgccgctgctcccgtcccatcacagaagtggaaacccacacacccttcgaccatgcccacgggcctgatcagggaggttgctgggttcgctccttatgagaagcgaatcactgagcttctgaaggttggcaaggacaagcctgctctgaaggttgctaatagaacgctcggaactcacaacacggcaaacaacaacagagaggatatgggcaatgtcctcacgaaaatgacatctgctggtacccacactgataataacaaatagagcatctcaagtacgtgaagctggcggcaacattgtcctgtgtccgtttcccctacctgtacaacctaatacatttgttgcagtacctgacagctcatcattgtgttgttacttatgtgttgaaccaccccatgatttttatatccaaaaaacaataaaaaa

SEQ ID NO: 46673 - protein, 70 aa, Panicum virgatum
  misc_feature: Ceres CLONE 2031816
  misc_feature (3)..(62): Pfam Name: Ribosomal_L36e Pfam Description: Ribosomal protein L36e
MPTGLIREVAGFAPYEKRITELLKVGKDKPALKVANRTLGTHNTANNNREDMGNVLTKMTSAGTHTDNNK

SEQ ID NO: 46674 - DNA, 749 bp, Panicum virgatum
  misc_feature: Ceres CLONE 2031819
  misc_feature: Encodes the peptide sequence at SEQ ID NO. 46675
atcctcctcctcaggtcttccccctcctcccccgatccccaaatcctcctccggatttcgcactcagccgcggcgcaggtggtgaagggaggcagagaggggaaacatggggctcgcgttcgggaagctcttcagccggctcttcgccaagaaggagatgcggatcctcatggtcggcctcgacgccgccggtaaaaccaccatcctctacaagctcaagctcggtgagatcgtcaccaccatccccaccatcggtttcaatgttgagaccgttgagtacaagaacattagcttcaccgtctgggatgtcgggggtcaggacaagatcagacccctctggaggcattacttccagaacacacagggtcttatctttgttgtggacagcaacgaccgtgaccgtgttgttgaagccagagatgagctccacaggatgctgaacgaggatgagctacgtgatgctgtgctgcttgtttttgccaacaaacaagatcttcccaatgctatgaatgctgctgagatcaccgacaagcttggattacactccctgcgccagcgacactggtacatccagagcacttgtgccacaactggtgagggtctgtatgagggcctggactggctgtccagcaacattgctagcaaggcttgaggcattgctttggatatcaactgcgaactgactaggagctccggatgtatcatggaaacttgggacagaatcgcctctgcaacctgttaggtgtctt

SEQ ID NO: 46675 - protein, 181 aa, Panicum virgatum; identical to SEQ ID NO: 16418
  misc_feature: Ceres CLONE 2031819
  misc_feature (5)..(177): Pfam Name: Arf Pfam Description: ADP-ribosylation factor family
  misc_feature: Functional homolog of the protein sequence given in SEQ ID NO 50150
  misc_feature: Useful for making plants with altered alkaloid content
  misc_feature: Useful for making plants with altered lignin content
  misc_feature: Functional homolog of the protein sequence given in SEQ ID NO 50219
  misc_feature: Useful for making plants with modulated nitrogen use efficiency
  misc_feature: Functional homolog of the protein sequence given in SEQ ID NO 50220
  misc_feature: Useful for making plants with altered terpenoid content

SEQ ID NO: 46676 - DNA, 488 bp, Panicum virgatum
  misc_feature: Ceres CLONE 2031838
  misc_feature: Encodes the peptide sequence at SEQ ID NO. 46677
tgtttggccatcacatggaaggggttagtaaaaactcttgggctctgggactctgtacgcgagattgcacggatgtatgatgcaggaatgggtgccgtcatcttcgtgcccatcgttttcttctcgtggttcccgtttgtgtcaacattccagtcacgtatcctcttcaaccaagcatttagtcgtggcctggagatctccctcattctggcaggaaacaaggcgaatcagcagacataaaaggcttcgtatgtttctgttgcacttgcacattctgaattagcgagggctgcgtagttagttgactcgaacaatttagtgagggttattactcgttttgagaaagccagcctctgtacataattgtcgcagttatttggatgatagttgtttggagggaagagctacggaagtagatgtgtattcattattgtaacctgagcagatttacattcacctggtcttgacgaagcctttttttttgttcc

SEQ ID NO: 46677 - protein, 79 aa, Panicum virgatum
  misc_feature: Ceres CLONE 2031838
  misc_feature: Functional homolog of the protein sequence given in SEQ ID NO 51679
  misc_feature: Useful for making plants with altered cell wall content and/or composition
CLAITWKGLVKTLGLWDSVREIARMYDAGMGAVIFVPIVFFSWFPFVSTFQSRILFNQAFSRGLEISLILAGNKANQQT

SEQ ID NO: 46678 - DNA, 424 bp, Panicum virgatum
  misc_feature: Ceres CLONE 2031863
  misc_feature: Encodes the peptide sequence at SEQ ID NO. 46679
tatgagcgtcttatcttggacacgataagaggagatcagcaacactttgttcgccgagatgaactgagggctgcatgggagatcttcactcctttgcttcacgacatcgatgctggcaagctgaagtccgtttcatacaagccaggaacccgaggaccgcaggaggccgatgagatgagtaggaggatggggtatgtgcagacccatggctacatatgggtaccgccaactctcgctaagttttagatttttttgtcagttgccgtgtaatcacagaatggcagaaaggtcgcctaatctgaatgcgcaaacaagcacttgggaagaagagcccttgtaatacacgcgtcatgtaataagagaaacttctgcgtgttgaaagtgtaccatttacgatatgaaataaaattttcatgctgagtgt

SEQ ID NO: 46679 - protein, 81 aa, Panicum virgatum
  misc_feature: Ceres CLONE 2031863
  misc_feature: SWISSPROT Homolog: EC 1.1.1.49 Glucose-6-phosphate 1-dehydrogenase
YERLILDTIRGDQQHFVRRDELRAAWEIFTPLLHDIDAGKLKSVSYKPGTRGPQEADEMSRRMGYVQTHGYIWVPPTLAKF

SEQ ID NO: 46680 - DNA, 735 bp, Panicum virgatum
  misc_feature: Ceres CLONE 2031882
  misc_feature: Encodes the peptide sequence at SEQ ID NO. 46681
gcaccaagaagcacacgaacaccagcaatccacagatcaaccaaaccaaacaacaaaatcgatcgaagagaggccaagatccgcggcggcgagatggacgcgaggatgttcgggctggagacacccctgatggcggcgctgcagcaccttcttgacgtcccggacggcgaggccggcgacaaggcgagcgcggcggggagcggccccacgcgcacctacgtccgcgacgcgcgcgccatggcggcgacccccgccgacgtcaaggagctcccgggggcctactcgttcgtggtggacatgccggggctgggcactggcgacatcaaggtgcaggtggaggacgagcgggtgctggtgatcagcggcgagcggcgccgggaggagcgcgaggaagccaagtacctgcgcatggagcgccggatgggcaagttcatgcgcaagttcgtgctgccggacaacgccgacatggacaagatctctgccatgtgcaaggatggcgtcctcacggtgaccgtagagaagctgccgccgccggagcccaagaagcccaagaccattgaggtcaaggtcgcctctgaggatcatcgatcgaagcagaggatgaagtcagagaccattgaggtcaaggtcgcctctgaggatcatcgatcgaagcagaggatgaagtcagagcagtgccagtgagttgtggcgggtgctgaggagaagcatgcagttgtgcttgtttccttatgt

SEQ ID NO: 46681 - protein, 196 aa, Panicum virgatum
  misc_feature: Ceres CLONE 2031882
  misc_feature (55)..(158): Pfam Name: HSP20 Pfam Description: Hsp20/alpha crystallin family
  misc_feature: Functional homolog of the protein sequence given in SEQ ID NO 51719
  misc_feature: Useful for making plants with modulated heat sensitivity
  misc_feature: Functional homolog of the protein sequence given in SEQ ID NO 51720
  misc_feature: Useful for making plants with modulated drought sensitivity
  misc_feature: Useful for making plants with modulated water use efficiency
MDARMFGLETPLMAALQHLLDVPDGEAGDKASAAGSGPTRTYVRDARAMAATPADVKELPGAYSFVVDMPGLGTGDIKVQVEDERVLVISGERRREEREEAKYLRMERRMGKFMRKFVLPDNADMDKISAMCKDGVLTVTVEKLPPPEPKKPKTIEVKVASEDHRSKQRMKSETIEVKVASEDHRSKQRMKSEQCQ

SEQ ID NO: 46682 - DNA, 1058 bp, Panicum virgatum
  misc_feature: Ceres CLONE 2031886
  misc_feature: Encodes the peptide sequence at SEQ ID NO. 46683
tgattattccttctaattggtataaattaaaatgtgtttgattctttgataaactcttgcagtgggtacatggctccagaatatctatacagaggtgaaatctccaccatgtcagacatatatagtttaggcatgcttattcttgagatcacgactggagagaagaactgtggatattctgaagacagatctgcaagaaactttgttaccaatgtacatcaaaattggaaaacgaatgagcaaataatacacaagtacccatcactagatccaaatggcctccagcaagtaaatgcatgcattgtaattgggctgaagtgtgtggaggctgatcggaacaaaaggccttccatagttgatattgttgataagctcaatgggaaacgtgtaccaatttttgaccaggtatgaacaattcagacatgtcagatcaatgatctgttttcagatcatctagttttattatgttgtcttatgtattcaaaaattgtttcccctctttttttttgcaaggctgaaaactaaaccaaaaaaaaaacttcattggttacagtgagcatttctagagaagccgagacatgttaaacgcagtgtctaaatgttttcatctctttaaagttttttgacgtgctatgacattccttttttacggttcaaaccagtttctatcaaactgtttaaaccagattttaaatacaacttcatcttttacttaaatgcctaataccagtagaatcacagaatttatgctattattctgcggtgctagcatcctatatgaaatttcaggcctccacttcccaggagcgatgagacgtggtcttttgaaggagagatcaatatccaagatgaagtagaacctgctctatgatcagaagatgacatgaattttcttcagaacaaatatctactttttttaaaaaaatattggctcttccttgcaacaacgtaactgccactttacttatctttctaattagatttggcactgtattgttgaagcactgttctctctgttgacctcttttagagtagaatttctgttcctccgcggcatt

SEQ ID NO: 46683 - protein, 113 aa, Panicum virgatum
  misc_feature: Ceres CLONE 2031886
  misc_feature: SWISSPROT Homolog: EC 2.7.11.1 Non-specific serine/threonine protein kinase
MAPEYLYRGEISTMSDIYSLGMLILEITTGEKNCGYSEDRSARNFVTNVHQNWKTNEQIIHKYPSLDPNGLQQVNACIVIGLKCVEADRNKRPSIVDIVDKLNGKRVPIFDQV

SEQ ID NO: 46684 - DNA, 530 bp, Panicum virgatum
  misc_feature: Ceres CLONE 2031908
  misc_feature: Encodes the peptide sequence at SEQ ID NO. 46685
atcgttaaaaccgagaagagaccaaggccaaaggaaaacaaatcttaaaacctcgaagccatgggtctgcaggaggaatttgaggagtatgctgaaaaggcgaagaccttgcccgatagcacgagcaatgagaacaagctgatcctctacggactttacaagcaggccactgttggaaacgtgaatacccctcgtcctggcatattacaccagagggacagggccaagtgggatgcatggaaggctgttgaaggaaaatccaaggaagaggcaatgagtgactacatcaccaaggtgaagcagctccaggaggaggctgccaactgctgaaccaaacagctgctgtcagatgagctcctatgccatctgatgatgatgaaagcttgatcatttgatccactggggatgtgaaatatgtacctgtttatgtattgtttacctaagtttcccatccatccatctatctatctgtgaagactttaatcttctatttatgatatctgtgcctgtgtgatactgagttgcatagt

SEQ ID NO: 46685 - protein, 89 aa, Panicum virgatum
  misc_feature: Ceres CLONE 2031908
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase
MGLQEEFEEYAEKAKTLPDSTSNENKLILYGLYKQATVGNVNTPRPGILHQRDRAKWDAWKAVEGKSKEEAMSDYITKVKQLQEEAANC

SEQ ID NO: 46686 - DNA, 637 bp, Panicum virgatum
  misc_feature: Ceres CLONE 2031920
  misc_feature: Encodes the peptide sequence at SEQ ID NO. 46687
acagcagctcaaagcagcagagcactcttcaccttctacgcaggccggctgcaagcgcgaggaagaagcaccagcgcagaagtcgtcgaccgccatggctcagggaaggggcagtgcgacgacacggtgcctcgccgtcggcggcctgctcgccgcgtgcctcctcctcggcgccgccgacgcggccacccacagcgtcgtctggtcgttcaacgcggacacctggccccggggcaagagcttccgcgccggggacgtcctcgagttcaactacgacccctccctgcacaacgtggtggccgtggacgccagcggctacaacagctgcggctcctccggcaggacctacagctccgggagggatcgcatcacgctcggccccgggaccaactacttcatctgcagcctcaacgggcactgtgggatggggatgaagatgaccgtcaacgccagctgaaggctgaagcccccacgctgcttgcagagcaccaataagtgatgcgtgtcacagtcccaggcggtccgatcgttttggcagcgcacgccctgtgcgggaaacgcgccgcgatacaggtctcatgtcatgtgtcatgtactggcagggtatgtgtggagtggagtggtagttgaggcatgg

SEQ ID NO: 46687 - protein, 120 aa, Panicum virgatum
  misc_feature: Ceres CLONE 2031920
  misc_feature (37)..(113): Pfam Name: Cu_bind_like Pfam Description: Plastocyanin-like domain
MAQGRGSATTRCLAVGGLLAACLLLGAADAATHSVVWSFNADTWPRGKSFRAGDVLEFNYDPSLHNVVAVDASGYNSCGSSGRTYSSGRDRITLGPGTNYFICSLNGHCGMGMKMTVNAS

SEQ ID NO: 46688 - DNA, 619 bp, Panicum virgatum
  misc_feature: Ceres CLONE 2031939
  misc_feature: Encodes the peptide sequence at SEQ ID NO. 46689
actatcggatcagtgacccacctgcggaaccttcttttcgttgttttgaataccgctactacctgtcttacttttgggcaaatgacaatgccactagagctgcccttggggtcaaggagggaacagtgaaggaatgggttaggtgccagcgttcaggttttccctacacctacgatattccgagcagcataaagtaccacttcaacctcaccaccaggggttaccgcgctctggtatacagtggagaccatgatctaggtataccgttctcgggcacacatgcatggataagatccttcaacttctccattgttgatgactggagggcgtggcaccttgatggccaggctgcaggattcacgatcaaatatgcgaacaatctcactttcgcgacagtgaagggtggtcgccatgctgctccagggaatcggcccaaagaatgcttcactatggctaaaaggtggctggacaataagcctctctgatttgcctgccaactcaggctgcacttctgaatccggattcagtctgtaactgtgcaataagtctgtaaaatgacagctaaactagcgaagtaagttaattaatgtaataaaagcacgtcaaatattaagtttgc

SEQ ID NO: 46689 - protein, 160 aa, Panicum virgatum
  misc_feature: Ceres CLONE 2031939
  misc_feature (1)..(157): Pfam Name: Peptidase_S10 Pfam Description: Serine carboxypeptidase
  misc_feature: SWISSPROT Homolog: EC 2.3.1.91 Sinapoylglucose--choline O-sinapoyltransferase
  misc_feature: Functional homolog of the protein sequence given in SEQ ID NO 50513
  misc_feature: Useful for biocontainment applications
  misc_feature: Useful for making plants with modulated biomass
  misc_feature: Useful for making plants with modulated flowering time
YRISDPPAEPSFRCFEYRYYLSYFWANDNATRAALGVKEGTVKEWVRCQRSGFPYTYDIPSSIKYHFNLTTRGYRALVYSGDHDLGIPFSGTHAWIRSFNFSIVDDWRAWHLDGQAAGFTIKYANNLTFATVKGGRHAAPGNRPKECFTMAKRWLDNKPL

SEQ ID NO: 46690 - DNA, 475 bp, Panicum virgatum
  misc_feature: Ceres CLONE 2031940
  misc_feature: Encodes the peptide sequence at SEQ ID NO. 46691
gactggaaggagacgccggaggcccatgtcttcacggcggacgtgccggggctgaagaaggtggaggtggaggtcgaggacggcaacgtgctccagatcagtggcgagcgcagcaagaagcaggaagagaagaacgaccggtggcaccgggtggagcgcagcagcggcaggttccttcgcaggttcaggctgccggagaacgccaaggcagagcagatcaaggcgtccatggagaacggcgtgctcaccgtcaccgtgcccaaggaggaggctaagaagcccgatgtcaagcccgtccagatcaccggccaggaaggaaggagcacgcgtggcctgtggagctccaagtacctgttctggaaacgaatgccttctgtttttttgtggggtggtgtcaggtgtggtgtggccgtgtttggtttgagaacggttaattactagtattaaatgaaatagtctgtaaaactaatttcac

SEQ ID NO: 46691 - protein, 146 aa, Panicum virgatum
  misc_feature: Ceres CLONE 2031940
  misc_feature (1)..(102): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
DWKETPEAHVFTADVPGLKKVEVEVEDGNVLQISGERSKKQEEKNDRWHRVERSSGRFLRRFRLPENAKAEQIKASMENGVLTVTVPKEEAKKPDVKPVQITGQEGRSTRGLWSSKYLFWKRMPSVFLWGGVRCGVAVFGLRTVNY

SEQ ID NO: 46692 - DNA, 1273 bp, Panicum virgatum
  misc_feature: Ceres CLONE 2031944
  misc_feature: Encodes the peptide sequence at SEQ ID NO. 46693
gacgacggtacagcaccatggcgttcttcagcagcggatcacgggcgctggtcgaaatcctgacgagaatccagagtgccgaaagaccaatgcctgttgatctcaccttcttcgagttcggatcgatccgataccatgtggaggcttcagcgtcggatcctgagaacgcgtacctgtcgatatcgacgccacctctttcccacgaggcctcaccctcctccagcggcttgcccgaggccacgctgcaggaggcgaggaaggcgtaccacaagttcgcggaggtcgtcgagccgccccgagaagagtacgtcctgacgctgaagctgaacttctccggcctcgcccggccgaaagaccgcgtgaaggcgatcaaccaggtgtcgcggctgcaatccctggtgctgagctcgcagctcagggacatgctggggagcctcggcccgtccggcacgatgaagctcgtgtgcagccagagggagcccttcttcgtcagcaggacggccgagaggatccacgccatcttcccgatgcgtttcagggacgacaccgacctggccatcgcgacctccttcttccaggagctgcaggacctcgggaactcgttcgcgggggcgcccaggtgcagctggtcgccgatcccgccgccggagctgcgcggcgagcacgtgcaccgcctcaccaccaacggcggcttcgtgtccttcggcgttctgtcgcggcacgcgagggggaagaagcgggccgccaggacggcctggatcctgctcaacttccaggccttcgtcaagtatcacatcaagtgcacccggagccacatccagagccggatgcggcagcggctggaggccctgacggaggtgatccaggacgccagcctacgaggagggaacgacgccaagaccaccagatcacaggcggtggtgaagaagaggggcaagagacggctgatcagcttcgcgaaggccaacacgaagctgcagaagggtctcaaggccatcctggacaagatcaagcggctgcggctcaggatcagggtgaagagcctggaccggctccggcggcagtgccgatgcttcgccgtgcccaagctcccggtgccgccacgccggaaggaccacaggtaccacaagctagcatcagtgaaatctagtgagcaaggctaaagcgtgatgtaagttcgtatacatcaactttttttttttgaaggatgtaagttcctccactttgacttgaccatctccttggtctggcttatagaaattctttttctttg

SEQ ID NO: 46693 - protein, 381 aa, Panicum virgatum
  misc_feature: Ceres CLONE 2031944
  misc_feature (52)..(291): Pfam Name: P34-Arc Pfam Description: Arp2/3 complex, 34 kD subunit p34-Arc
MAFFSSGSRALVEILTRIQSAERPMPVDLTFFEFGSIRYHVEASASDPENAYLSISTPPLSHEASPSSSGLPEATLQEARKAYHKFAEVVEPPREEYVLTLKLNFSGLARPKDRVKAINQVSRLQSLVLSSQLRDMLGSLGPSGTMKLVCSQREPFFVSRTAERIHAIFPMRFRDDTDLAIATSFFQELQDLGNSFAGAPRCSWSPIPPPELRGEHVHRLTTNGGFVSFGVLSRHARGKKRAARTAWILLNFQAFVKYHIKCTRSHIQSRMRQRLEALTEVIQDASLRGGNDAKTTRSQAVVKKRGKRRLISFAKANTKLQKGLKAILDKIKRLRLRIRVKSLDRLRRQCRCFAVPKLPVPPRRKDHRYHKLASVKSSEQG

SEQ ID NO: 46694 - DNA, 311 bp, Panicum virgatum
  misc_feature: Ceres CLONE 2031960
  misc_feature: Encodes the peptide sequence at SEQ ID NO. 46695
ttgtgcagctcatccagcccgttgcttgtgagcagggaatgaggtttgctatccgtgagggtggtaagactgtcggcgccggtgtcatcaacaaaatcattgagtaaaccggatatgccatatccaccatgaaattttccctgtttactctcagcaaaatgctatgtagttgttattatgtgttgagctttaggggttgctcatgtgaagttgtagtatggcactttttttgtccagtgaatttgcatactttgtaacattcacgacaatgatacatcggtcttttgcaattgatttggctaagaggtgcc

SEQ ID NO: 46695 - protein, 34 aa, Panicum virgatum
  misc_feature: Ceres CLONE 2031960
  misc_feature: Functional homolog of the protein sequence given in SEQ ID NO 50509
  misc_feature: Useful for making plants with modulated oxidative stress sensitivity
VQLIQPVACEQGMRFAIREGGKTVGAGVINKIIE

SEQ ID NO: 46696 - DNA, 438 bp, Panicum virgatum
  misc_feature: Ceres CLONE 2031976
  misc_feature: Encodes the peptide sequence at SEQ ID NO. 46697
tttacctaaccgtatacctcagagtgtggttacacttgtgaaaatggtcaatgaagcaacagccagcataccgaactgggactcttatgcagctggttgagcttttacagatctggctagccaattcagtttgccaaatgtttccatggtggtgctggtacatgatcattgccgaacatgtaagcggggtggctgacaaccgtgggataaatgatacacaggtttagcaggctaccggtaccggctcctgacctttctgcctgaattttcctgacaatgttctggcgcagaaccgctggttcgtttgttttgtcaaacacacgcacgatgacactgcccactatgtcaaacacacgcactgatctgtgagactgttatttgtgagtatttggctggcataaacaagaagccactttagaaacatttttctgcaaagtt

SEQ ID NO: 46697 - protein, 32 aa, Panicum virgatum
  misc_feature: Ceres CLONE 2031976
  misc_feature: Functional homolog of the protein sequence given in SEQ ID NO 50514
  misc_feature: Useful for making plants with modulated drought sensitivity
LPNRIPQSVVTLVKMVNEATASIPNWDSYAAG

SEQ ID NO: 46698 - DNA, 716 bp, Panicum virgatum
  misc_feature: Ceres CLONE 2031991
  misc_feature: Encodes the peptide sequence at SEQ ID NO. 46699
atcacagcatcacaacaagaactagctcacatcctctcattagtacactgcgatcgcagctgagaaagcacgagccatccgacatggtttccaagaaaaccatgtcctccctcgccttcctcgtggcgctgctgctcgcatgcagctccatgagcagcgcggctcggtacctggaggagacgaagcccgagtacccgccgcaccccgccgtgccggagatccccaagccggagctgcctccgcaccccaccgtgccggagatcccaaagcccgagctgcctccgcaccctaatcctcatgccaagcgaataatttagcagctcaacaagaggtttggaaatggcgaacaagtttgtagttcttcttggtgttgtcctggcctttctcctcgtctgccaggatttggcatgtgctagagggctcactgaaaccaatgagtctgaaggaaaagatgtgaagcctgctggaggagtgcctggactcaaggatgaaaagtggggaggtggttacaatggaggatatggcaatggcggcagttatggtggtgggtacggtggtggctatgggcctagatatggtggaggataccaccatggccacggaggaggctatgggcccggatatggtggaggatatggatctggacatggtggtggctatgggggccctggatacggtggtgggtatggtggccctggatacggtggcgggtatgc

SEQ ID NO: 46699 - protein, 125 aa, Panicum virgatum
  misc_feature: Ceres CLONE 2031991
  misc_feature (1)..(120): Pfam Name: GRP Pfam Description: Glycine rich protein family
MANKFVVLLGVVLAFLLVCQDLACARGLTETNESEGKDVKPAGGVPGLKDEKWGGGYNGGYGNGGSYGGGYGGGYGPRYGGGYHHGHGGGYGPGYGGGYGSGHGGGYGGPGYGGGYGGPGYGGGY

SEQ ID NO: 46700 - DNA, 610 bp, Panicum virgatum
  misc_feature: Ceres CLONE 2031995
  misc_feature: Encodes the peptide sequence at SEQ ID NO. 46701
accactcctccccttccaaccccagcacccggcggcggcggcgagcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcggtcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgcggattctgagttttgagaaccccccccccccccccctttttttttttttt

SEQ ID NO: 46701 - protein, 147 aa, Panicum virgatum; identical to SEQ ID NO: 13747
  misc_feature: Ceres CLONE 2031995
  misc_feature (109)..(141): Pfam Name: L15 Pfam Description: Ribosomal protein L15

SEQ ID NO: 46702 - DNA, 616 bp, Panicum virgatum
  misc_feature: Ceres CLONE 2032061
  misc_feature: Encodes the peptide sequence at SEQ ID NO. 46703
ctatcaagcaatcagatgcatgtcatcatctaagctctttgttggagggctttcttatggcactgatgatcagagtctcagagattcctttgcgaattatggccaggttattgaagctagggttatcatggaccgtgagtctggaagatccagaggttttggctttgtaacttacacatcatctgaggaggcttcagctgccatcacagccatggatggacaggatctccatggaaggaacataagggctaaccatgctactgagaagacaggtggtttccgggctggtggcggcggcggttttggtggtggtggctatggcggcggcggttttggtggtggaggctatggcggcagtggttttggtggtggtggcagtggtggcggtggttacgatggcagcggagggtacggtgcgggctatggtagcggcggcggcggcgggggctatggtggtggcaactatggcaacaggggtggcggcggctatgggggtggtggagttgcaggtggagctggcggcaattttgctgctggaggtggcgacagctttggcagcaacttcggtggtgaaagtgggtttggaaaccctgctggtggattcggtgctcccagt

SEQ ID NO: 46703 - protein, 204 aa, Panicum virgatum
  misc_feature: Ceres CLONE 2032061
  misc_feature (12)..(83): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50182
  misc_feature: Useful for making plants with modulated biomass
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
YQAIRCMSSSKLFVGGLSYGTDDQSLRDSFANYGQVIEARVIMDRESGRSRGFGFVTYTSSEEASAAITAMDGQDLHGRNIRANHATEKTGGFRAGGGGGFGGGGYGGGGFGGGGYGGSGFGGGGSGGGGYDGSGGYGAGYGSGGGGGGYGGGNYGNRGGGGYGGGGVAGGAGGNFAAGGGDSFGSNFGGESGFGNPAGGFGAP

SEQ ID NO: 46704 - DNA, 1222 bp, Panicum virgatum
  misc_feature: Ceres CLONE 2032064
  misc_feature: Encodes the peptide sequence at SEQ ID NO. 46705
tcgggacatgggatcgaaggcctccccgatggatccattcgaaatgcaggataactcgaagaaatccaataagcccaaatattctaagtttacacagcaggagcttccagcatgcaaaccactgctaactccagcaattgtcatttctgccttcttactggttggcatcctatttgtcccaattggtcttgcatcgctttctgcatcacaagagattgtggagctgatagatagatatgatacaaattgtgggcccatcactgacaaggttgggtacattcaggactctaagactaataaatcatgcacaagaactctaactgtgcctaagcatatgaagagcccaattcaaatatattaccagattggtgacttctatcagaaccatcgccggtacgtgaaaagtcgtagtgataaacaattgctgtataaggatgctgcacacttgacaaaagattgtgatcctgaaggttatagtgctgatggtgctccaatcgttccatgtggcctcgttgcttggagtttgttcaatgacacatatacaatttcagtcaacaagaaagcgattgaagtgaataaaaaagatatagcttggcagagtgacaagaacaaaaaatttggcaatgatgtttatcccaggaactttcagaatggaaatcttataggtggtgccaagctaaatgcgagcatacctttaagcaagcaagaagatctcattgtttggatgagaactgctgcccttccgactttcagaaagctttatggcagaattgaaacggatattatggcaaacgatcaactaactgttgttatacagaacaactataacacatatagttttggagggtctaaagcattggtcctttcaactacatcttggattggaggcaaaaataaattcattggtgttgcatatctgattgtaggtggcttgtgcctttttcttgcactggttttcgtagttctctacatgtttaagccaaggactcttggagacccctcattcttgtcatggaatagagatactctggactatccaaactaatacgccggaatctgttctttatataaatagaagagcacttcaatggaaggacccattcggcatttggactatgctgcagagtctcagtttgtatctcgcattgctcacctcaaagaatgacactgcagataaaggtggaaacagtattactccaatccggtacagatttatgtacag

SEQ ID NO: 46705 - protein, 338 aa, Panicum virgatum
  misc_feature: Ceres CLONE 2032064
  misc_feature (56)..(325): Pfam Name: CDC50 Pfam Description: LEM3 (ligand-effect modulator 3) family / CDC50 family
  misc_feature: Functional homolog of the protein sequence given in SEQ ID NO 50291
  misc_feature: Useful for making plants with modulated nitrogen use efficiency
MDPFEMQDNSKKSNKPKYSKFTQQELPACKPLLTPAIVISAFLLVGILFVPIGLASLSASQEIVELIDRYDTNCGPITDKVGYIQDSKTNKSCTRTLTVPKHMKSPIQIYYQIGDFYQNHRRYVKSRSDKQLLYKDAAHLTKDCDPEGYSADGAPIVPCGLVAWSLFNDTYTISVNKKAIEVNKKDIAWQSDKNKKFGNDVYPRNFQNGNLIGGAKLNASIPLSKQEDLIVWMRTAALPTFRKLYGRIETDIMANDQLTVVIQNNYNTYSFGGSKALVLSTTSWIGGKNKFIGVAYLIVGGLCLFLALVFVVLYMFKPRTLGDPSFLSWNRDTLDYPN

SEQ ID NO: 46706 - DNA, 572 bp, Panicum virgatum
  misc_feature: Ceres CLONE 2032083
  misc_feature: Encodes the peptide sequence at SEQ ID NO. 46707
caaatcgtgctcctgctggaagggtgttactcctaaactacataggaggcgctacaaacacaggaattgtttctaagagtgaaagtgagctggtagaagcagttgaccgtgacctcaggaaaatgctaatcaaccctagagcagtgaatcctttagtgctcggtgtccgagtgtggccacaagccatacctcagttcctggtaggacatcttgatcttctggaggctgcaaaatctgccctggaccgaggtggctacgatgggctgttcctcgggggtaactatgtagcaggagtcgccctaggccgatgcgtggagggtgcctatgagagcgcctcgcaaatatctgacttcctgaacaagtacgcctacaagtgatgaaagaggtggagctgctcgttattttgcataggtgagatgaaaccaggagcgacacaaagtttacgagcattttttttccaccttatttcgtaaattgtactacttctgatccttttttttttcttgtgagtaattagttagattgtagggatgtgggacattgttctattagccatcctactaaacttattt

SEQ ID NO: 46707 - protein, 124 aa, Panicum virgatum
  misc_feature: Ceres CLONE 2032083
  misc_feature: SWISSPROT Homolog: EC 1.3.3.4 Protoporphyrinogen oxidase
NRAPAGRVLLLNYIGGATNTGIVSKSESELVEAVDRDLRKMLINPRAVNPLVLGVRVWPQAIPQFLVGHLDLLEAAKSALDRGGYDGLFLGGNYVAGVALGRCVEGAYESASQISDFLNKYAYK

SEQ ID NO: 46708 - DNA, 694 bp, Panicum virgatum
  misc_feature: Ceres CLONE 2032084
  misc_feature: Encodes the peptide sequence at SEQ ID NO. 46709
caatttcctgagcccttcccagaatgatttccctttggatcacacgctaaattcttcgggctgcttagatgatgttggttatgtgccttgttcagataattctgatcaagtgaatcgaccaccggcaaccttcgtgaaggtttacaaatctggaacctacggaaggtcgcttgatatcactaggtttagtagctatcatgagctccgtagggaactagggcgcctatttggccttgagggccagttggaagaccctatgagatcaggctggcagcttgtattcgtcgaccgagaggaggacgtccttctcgttggcgacgacccttggcaggaattcgtgagtacggtatcctgcataaagatactctccccgcaggaggtgcagcagatgggcaagcaggggcttgagcttctgagctcagccccagcgagaaggctcggtagcagctgtgatgactacgttagcaggcaggagtcaagaagcctaagcaccgggattgcgtcggtcgggtcagtagagttctgaagagagggcactaagcgccctcgagcttaaggctggtctgtgacacatgtttccttcgcatcccctggttttgacacttgagacccgtgtggaactgaaagcatcataagactaaagcctagtcgcaagtcatgtaccatctaataattctgtcatatgatgataact

SEQ ID NO: 46709 - protein, 174 aa, Panicum virgatum
  misc_feature: Ceres CLONE 2032084
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
NFLSPSQNDFPLDHTLNSSGCLDDVGYVPCSDNSDQVNRPPATFVKVYKSGTYGRSLDITRFSSYHELRRELGRLFGLEGQLEDPMRSGWQLVFVDREEDVLLVGDDPWQEFVSTVSCIKILSPQEVQQMGKQGLELLSSAPARRLGSSCDDYVSRQESRSLSTGIASVGSVEF

SEQ ID NO: 46710 - DNA, 698 bp, Panicum virgatum
  misc_feature: Ceres CLONE 2032090
  misc_feature: Encodes the peptide sequence at SEQ ID NO. 46711
attcctatccgatcctctactctaggagtatgtgaggaactcgcgggggatgagcctcttcgcatgcagatggctacctggaaagaggtggaggaccaagcagggtcctcgtcctcccaaggcgctcgtcttcctctgccatggttacgccgtggagtgcggcgttactatgcgcggcaccggcgagcgccttgcccgtgccggctacgccgtctacggcctcgactacgagggccacggccgctccgacggtctgcagggctacgtgccggacttccaggccctcgtccaggactgcgacgactacttcacctccgtcgcccgctcccaccctcaccggcgccgcttccttctaggcgagtccatgggcggcgccgtcgcccttctcctccaccgcgctcgccccgacttctgggccggcgccgtgctcgtagcgcccatgtgcaagatcgccgacgacatgcggcctcacccggtggtggtcaacatcctcagggccatgacctccatcatccccacctggaagatcgtgcccaccgccgatgtcatcgacgccgcctaccggatgcaggacaagagggacgagatccggggcaacccctactgctacaaggacaagccgcgactcaagaccgccttcgagctgctcaaggtcagcttggacgtggaggcaaacctcctgcacaaggtgtccttgc

SEQ ID NO: 46711 - protein, 216 aa, Panicum virgatum
  misc_feature: Ceres CLONE 2032090
  misc_feature: SWISSPROT Homolog: EC 3.1.1.23 Acylglycerol lipase
MSLFACRWLPGKRWRTKQGPRPPKALVFLCHGYAVECGVTMRGTGERLARAGYAVYGLDYEGHGRSDGLQGYVPDFQALVQDCDDYFTSVARSHPHRRRFLLGESMGGAVALLLHRARPDFWAGAVLVAPMCKIADDMRPHPVVVNILRAMTSIIPTWKIVPTADVIDAAYRMQDKRDEIRGNPYCYKDKPRLKTAFELLKVSLDVEANLLHKVSL

SEQ ID NO: 46712 - DNA, 720 bp, Panicum virgatum
  misc_feature: Ceres CLONE 2032096
  misc_feature: Encodes the peptide sequence at SEQ ID NO. 46713
accccatcccacacacatccaagggcatggtagaagtgagcataggtagagtgtgctaggtgtgtgttcctttgttgctccaatgagatcacggagtgaccgaggaggagcctgccaaggagccagaagacccgtaccgcgagcaggaagccgccgccgccgacgcgtacgaaagcgaagaggatccagactttgtgccggaagactacgagtagatcgtgtccgcacccaagctgatcgagtggagccgtgatggatgaagagctagtcctgcatgtcgctatgctagttgttatcctatggttgttctgtgtagctttgtgttgtcactttactcctcatgtacgtgttaaataaagctctgtatgactctggactccacttgatgtaacatgtattatgccggagaccttattcggtaattaatacatggtttagccttgatcttcgggtcggggcgcttcaacgcaccaccagaattgcgtgctcgtcgacatgccggcgtcggagacgacgcgccgggtcacggcgttcctcggcggcctcgacctctgcgtcggccgctacgacacgcccgcccacacgctcttccgcggcctccgcaccgtcttccacggcgacgtctacaaccccacgttccgggaggaggaggatgccaagaagctgggtccccggcagccgtggcacgacatgcattgccggctggacgggccggcggcg

SEQ ID NO: 46713 - protein, 74 aa, Panicum virgatum
  misc_feature: Ceres CLONE 2032096
  misc_feature: SWISSPROT Homolog: EC 3.1.4.4 Phospholipase D
MPASETTRRVTAFLGGLDLCVGRYDTPAHTLFRGLRTVFHGDVYNPTFREEEDAKKLGPRQPWHDMHCRLDGPA

SEQ ID NO: 46714 - DNA, 694 bp, Panicum virgatum
  misc_feature: Ceres CLONE 2032110
  misc_feature: Encodes the peptide sequence at SEQ ID NO. 46715
tccaagaacagcccgctgttttctcaattcataaaggacctgtcagttccaaaagaaaccagagtgaaggctataactgaaatattcgctgaagctgggttttcagatgtcacaaagaatttcttggctgtcttggcggacaatggcaggctgaaatatattgagcggattgctgagagatttgttgatttgaccatggcacataagggggaggtgaaggttgttgtcaggacagttattccacttcccgagaaggaggagaaagaactcaaggagacattgcaagatatccttgggaagaacaaaactattttggttgaacagaagattgactacagcatcatgggaggacttgtgattgaattcgggcagaaggtgtttgatatgtcgatcaagactagggcgaagcaaatggaggcgttcttgaggcaaccccttgaaatctaacttccttttggataaaaacatcatcagaatgcagtggctgtgctgctgaaggtttcctcatgtctgcaactgcaacttttatctggcctttgaataaaatgtttcctctaacaagagaatgccactgtttttattttgtcttgtgggctagaggcctgctgaacaatttatgtttatttcttgttacttgaagaagcttgcaccgaaaacatgatggatgccatgaaaagtttttcagctccaaatc

SEQ ID NO: 46715 - protein, 148 aa, Panicum virgatum
  misc_feature: Ceres CLONE 2032110
  misc_feature (1)..(142): Pfam Name: OSCP Pfam Description: ATP synthase delta (OSCP) subunit
  misc_feature: SWISSPROT Homolog: EC 3.6.3.14 H(+)-transporting two-sector ATPase
SKNSPLFSQFIKDLSVPKETRVKAITEIFAEAGFSDVTKNFLAVLADNGRLKYIERIAERFVDLTMAHKGEVKVVVRTVIPLPEKEEKELKETLQDILGKNKTILVEQKIDYSIMGGLVIEFGQKVFDMSIKTRAKQMEAFLRQPLEI

SEQ ID NO: 46716 - DNA, 754 bp, Panicum virgatum
  misc_feature: Ceres CLONE 2032127
  misc_feature: Encodes the peptide sequence at SEQ ID NO. 46717
aaccatatcctcgtggcaagtaacttgtaaacatattaattcgcaccgactgatcactagctaacacgatggtcgccggcagcatcaccgaggaggttgcgatggccgcgccggccgagccggtgtggaaggcgatcttcgcgacctgcgacgagtcctccctgcgcaacctgctggccggcgtgatcgacggcgtcgtgaaggttgacggcgacggcgggcccgggagccgctacaccctcaacttcaccctagccgtcggcgcagcgccggtgctcctcaaatgccggctggcggcgcgcgacaacgcggcgcgcgtgatcaccttcgacgaggtggcggtggagggcggcgaggtggcgccggcggcacagcccaagtcgcaggtggtccagttcaaggtggagcccgccggcgcgggcggctgcgtgatcaagatcgccgtggagtccgagcgccccgacggcacgccgctgtcgctggcggaggaccaggccaagctgaccaagctcgccgtccacctcatcaagaaggtggaggggaacatcgtcccgcgccctcagtgcgcctgatgtgctggtcccaagctcagatgatccaccacaagactgccgccattatacaataataagaatcgatagcacagtagtatgtatgatcgatgatccatccaccctgtttgcgttctgttgtgtttgcagtacctataaaaaaatataaatgtataataaccaaaggaagtgagatttttttg

SEQ ID NO: 46717 - protein, 167 aa, Panicum virgatum
  misc_feature: Ceres CLONE 2032127
  misc_feature (1)..(163): Pfam Name: Bet_v_I Pfam Description: Pathogenesis-related protein Bet v I family
MVAGSITEEVAMAAPAEPVWKAIFATCDESSLRNLLAGVIDGVVKVDGDGGPGSRYTLNFTLAVGAAPVLLKCRLAARDNAARVITFDEVAVEGGEVAPAAQPKSQVVQFKVEPAGAGGCVIKIAVESERPDGTPLSLAEDQAKLTKLAVHLIKKVEGNIVPRPQCA

SEQ ID NO: 46718 - DNA, 622 bp, Panicum virgatum
  misc_feature: Ceres CLONE 2032154
  misc_feature: Encodes the peptide sequence at SEQ ID NO. 46719
cacactcttcttgctcacggctctagcccaccgagcgcaggaatggcgtcgttcgccgtggcaacgatcccgtcgctggcggccccggcggccaggaagaggtccggcggcgtcacctacgtggagggcatgaacgcctacagcggcctcaaggggctcaacaaggtcaccatgctcgggctgcgcaagaccgccgactactccttcgccaagatcgtggcgtcgctcagccccgccggcaaggcgcggcgcggcagcgcgttcggggcgcagatgaacgccgccgcggagatcttcaggatcgccgccatcatgaacggcctcgtgctcgtcggcgtcgccgtcgggttcgtgctgctccgggtggaggccgccgtcgaggaggccgagtaggggtggatgcccgccccgccctgattgcagccagctgtcgcctcatataagccgtgatatataaaacgtgacgtatgcttttggttgaatttacttcggtatgtatccatgacaattgatgaataccgtgcaaacatgtttctggtcttctggagtcgaggtctgcaatggatcttcaggtgtttttgcgactctctgagatcagaatgcaaaaacatccacgtcttgc

SEQ ID NO: 46719 - protein, 116 aa, Panicum virgatum; identical to SEQ ID NO: 14270
  misc_feature: Ceres CLONE 2032154
  misc_feature (78)..(114): Pfam Name: PetM Pfam Description: PetM family of cytochrome b6f complex subunit 7

SEQ ID NO: 46720 - DNA, 709 bp, Panicum virgatum
  misc_feature: Ceres CLONE 2032158
  misc_feature: Encodes the peptide sequence at SEQ ID NO. 46721
ggagctaggacgacgtcaccttccgctctgctagctcagctcagctcgcatcgctcgagccaggaacaacgcggagcagaggaagcgaggcggcggcgatgtcggcggggctggtgaccgacgaggcgaccatgggccggctctaccgggtccggcggacggtgatgcagatgctgcgcgaccgcgggtacctggtgggcgagcacgagctcgccaccagccgccgcgacttcctccgcaagttcggcgagtccttccaccgcgaggacctcctcatcaacaagtacaagaagaacgacccctccgaccagatatatgttttcttccccaacgatgataaagtggggatgaagcacatcaagaagtacgttgaaatgatgacacatgagaacgtctccagagctgtgttggttcttcagcagaatctaactccatttgccaagtcatttctcatagaattagagccaaagatccacttggaaattttccaggaggccgagttgcttataaatatcaaggagcatgttcttgttcctgagcatcaggtgctcacaaatgaggagaagaagacattattggagcggtacaccttaaaggaaactcagcttccaagaatacagattacggatcccattgcaaggtactatggcctcagacgaggtcaggtagtgaagatcatcagacccagtgagacggccggccgatacgt

SEQ ID NO: 46721 - protein, 203 aa, Panicum virgatum
  misc_feature: Ceres CLONE 2032158
  misc_feature (137)..(203): Pfam Name: RNA_pol_Rpb5_C Pfam Description: RNA polymerase Rpb5, C-terminal domain
  misc_feature (6)..(95): Pfam Name: RNA_pol_Rpb5_N Pfam Description: RNA polymerase Rpb5, N-terminal domain
  misc_feature: SWISSPROT Homolog: EC 2.7.7.6 DNA-directed RNA polymerase
  misc_feature: Functional homolog of the protein sequence given in SEQ ID NO 51214
  misc_feature: Useful for making plants with modulated drought sensitivity
  misc_feature: Useful for making plants with modulated water use efficiency
MSAGLVTDEATMGRLYRVRRTVMQMLRDRGYLVGEHELATSRRDFLRKFGESFHREDLLINKYKKNDPSDQIYVFFPNDDKVGMKHIKKYVEMMTHENVSRAVLVLQQNLTPFAKSFLIELEPKIHLEIFQEAELLINIKEHVLVPEHQVLTNEEKKTLLERYTLKETQLPRIQITDPIARYYGLRRGQVVKIIRPSETAGRY

SEQ ID NO: 46722 - DNA, 708 bp, Panicum virgatum
  misc_feature: Ceres CLONE 2032177
  misc_feature: Encodes the peptide sequence at SEQ ID NO. 46723
accacacacacacacgacacagtacaagtgcaaatcactcatctagcaatggcggggaaggttgcgtgcttcgctctggcgctcgccgtggtggcagccgccggcgtcctcatcgcgccgtgcgcggcgcagaactcgccgcaggactttgtggacctgcacaacgcggcgcggtccgacgtcggcgtcggcccggtgtcgtgggacgacaacgtggcctcgttcgcgcagagctacgcggcccagcgcgccggcgactgcgcgctccagcactccagcggcagcggctacggcgagaacatcttcgtgggcggcgccggcgccgactggtcggcgtcggacgccgtcggcctgtgggtggcggagaagcagtggtacgaccacggcagcaactcctgctcggcgccgccgggccagtcgtgcggccactacacgcaggtggtgtggcgtgactccaccaccatcggctgcgcccgcgtcgtctgcaacaacggcggcgtcttcatcacctgcaactacaacccgccgggcaacttcgtcggacagagcccgtactagaataatctctcgatcggagtcgcacagagcatgccctagctagttccaaatttcaatgcatcgtacgcgtacatgcatatgcaggtgcattgacgcattgtggcatggtattaaataaattaagtacaaaaatgaatctcatcagcaata

SEQ ID NO: 46723 - protein, 169 aa, Panicum virgatum
  misc_feature: Ceres CLONE 2032177
  misc_feature (35)..(157): Pfam Name: SCP Pfam Description: SCP-like extracellular protein
  misc_feature: Functional homolog of the protein sequence given in SEQ ID NO 50414
  misc_feature: Useful for making plants with modulated biotic stress sensitivity
MAGKVACFALALAVVAAAGVLIAPCAAQNSPQDFVDLHNAARSDVGVGPVSWDDNVASFAQSYAAQRAGDCALQHSSGSGYGENIFVGGAGADWSASDAVGLWVAEKQWYDHGSNSCSAPPGQSCGHYTQVVWRDSTTIGCARVVCNNGGVFITCNYNPPGNFVGQSPY

SEQ ID NO: 46724 - DNA, 661 bp, Panicum virgatum
  misc_feature: Ceres CLONE 2032191
  misc_feature: Encodes the peptide sequence at SEQ ID NO. 46725
tgcacttgaaatgattcataggggggagaatgtaaggctcgagtctatcttctacggtggtgtcgacgttcatgacagacacagggacatgcgtttagacatagacaatatgtcatatgaggagctattggcactcgaggaaagaataggaaatgttaacactggcctcagcgaggaagcagtgataaagctgctgaagcaaagaaaattttcatcatggagactgaaagcatccttggaccatgagccatgttgtatctgccaggaggagtatgttgatggagacgaccttgggaggctcgactgcgggcacgacttccatgctggctgcatcaagcaatggctggtgctgaagaacgtgtgccccatctgcaaaaacacggcattgaagacctgaaactgaagaaaggctcgtcagagacccccatgttctatgttcgttggatcgcaagatcatttaccgattcgcgttactgtgctttttggttgggaaattttgccattcaccttcagttgggaaaggaatttaaaaaaagagagagaagtggtccctttaaactgctgctgcagtaaataatccctagaatatgtctccctgcatttaaccaaatatttatggccggtataatggatgtcgtaggtttaaaaaacttcaacgatt

SEQ ID NO: 46725 - protein, 131 aa, Panicum virgatum
  misc_feature: Ceres CLONE 2032191
  misc_feature (84)..(124): Pfam Name: zf-C3HC4 Pfam Description: Zinc finger, C3HC4 type (RING finger)
  misc_feature: The sequence is a functional homolog of SEQ ID NO 90 in the 10/666,642 US patent application
  misc_feature: The sequence is a functional homolog of SEQ ID NO 1145 in the 11/479,226 US patent application
  misc_feature: The sequence is a functional homolog of SEQ ID NO 140 in the 10/666,642 US patent application
  misc_feature: The sequence is a functional homolog of SEQ ID NO 504 in the 10/412,699 US patent application
  misc_feature: Functional homolog of the protein sequence given in SEQ ID NO 50716
  misc_feature: Useful for making plants with altered alkaloid content
  misc_feature: The sequence is a functional homolog of SEQ ID NO 406 in the 10/666,642 US patent application
ALEMIHRGENVRLESIFYGGVDVHDRHRDMRLDIDNMSYEELLALEERIGNVNTGLSEEAVIKLLKQRKFSSWRLKASLDHEPCCICQEEYVDGDDLGRLDCGHDFHAGCIKQWLVLKNVCPICKNTALKT

SEQ ID NO: 46726 - DNA, 595 bp, Panicum virgatum
  misc_feature: Ceres CLONE 2032203
  misc_feature: Encodes the peptide sequence at SEQ ID NO. 46727
gaaaaaaaaaaaaatgatttacgctggagagtatgatctcatatgcaactggctcgggaactcgagatgggtaaactctatggaatggtctggaaaggaagcttttgtctcatcgtctgataagcccttcactgtcgatggaaaagaagccggcgttctaaagagccatggtcctttgagtttcttgaaggtgcatgattctggtcacatggtaccgatggatcaaccgaaggctgctctggagatgctgaagaggtggacttccggaaacctttcgggcacgtcttcagtctcccagaagtttaatttcgatatgtgaccaacaagatccttcgtggtgtgcaacttggtgctgcaatgctgcccagcactagtctcctcagactaccttatgtaattttctgtgtactccaggattatcctcagctctgacaagcttatcttgcgaccgtacagatgttatttgccttgtacgggcgccccgaatgctgatgagacgtggtcttacaactcgattagcatgtaataaaattttcagagaattgtggcaaggcatgtacggagacttgccctgagaagcatcttttctgatgac

SEQ ID NO: 46727 - protein, 105 aa, Panicum virgatum
  misc_feature: Ceres CLONE 2032203
  misc_feature: SWISSPROT Homolog: EC 3.4.16.5 Carboxypeptidase C
KKKKMIYAGEYDLICNWLGNSRWVNSMEWSGKEAFVSSSDKPFTVDGKEAGVLKSHGPLSFLKVHDSGHMVPMDQPKAALEMLKRWTSGNLSGTSSVSQKFNFDM

SEQ ID NO: 46728 - DNA, 768 bp, Panicum virgatum
  misc_feature: Ceres CLONE 2032210
  misc_feature: Encodes the peptide sequence at SEQ ID NO. 46729
agtgctttgacattgatgccaatggtattctgaacgtctctgctgaagacaagacgactggccagaagaacaagattactatcaccaatgacaagggaaggctgagcaaggaggacattgagaagatggtccaggaggcagagaagtacaagtctgaggatgaggagcacaagaagaaggttgaggcaaagaactccctggagaactatgcctacaacatgaggaacaccatccaggatgagaagatcgcctccaagctgcctgcggccgacaagaagaagattgaggacgctgttgagcaggcgatccagtggctggacagcaaccagcttgctgaggtcgaagagtttgaggacaagatgaaggagctcgaaggcctctgcaaccccatcattgccaagatgtaccagggtgcaggtgctgacatggctggtggaatggaggatgatgctccagctgctggtggtggtgctggacccaagattgaggaagtcgactaaactattcagaccatcattggttgtcataatagtagtcaagttcataggtcttttgttgttaccagacccaagtggcaatcataccacttggcgtatagtaattaggtgcacgcaggcgcacgttggttattgttttacagggcgcgtcatgaacaatgcatgttttgggtttacacattcgcctggatgctgtttagtttggtcttgtattgacgcgcttcaaaatattctacattctgtttcggtacttgtctcttcatcagtggtt

SEQ ID NO: 46729 - protein, 165 aa, Panicum virgatum
  misc_feature: Ceres CLONE 2032210
  misc_feature: Functional homolog of the protein sequence given in SEQ ID NO 50352
  misc_feature: Useful for making plants with modulated drought sensitivity
  misc_feature: Useful for making plants with modulated heat sensitivity
CFDIDANGILNVSAEDKTTGQKNKITITNDKGRLSKEDIEKMVQEAEKYKSEDEEHKKKVEAKNSLENYAYNMRNTIQDEKIASKLPAADKKKIEDAVEQAIQWLDSNQLAEVEEFEDKMKELEGLCNPIIAKMYQGAGADMAGGMEDDAPAAGGGAGPKIEEVD

SEQ ID NO: 46730 - DNA, 650 bp, Panicum virgatum
  misc_feature: Ceres CLONE 2032216
  misc_feature: Encodes the peptide sequence at SEQ ID NO. 46731
taccggcagcttgaaccacgcaccaagaagctacgcttcaccgtcccgttcccgctcctcgcattccccgtctacctagtatgttgctgtctgctgggtgctgaaataaataaagttattactagctagtaactgattgaaagaaacccaatgcaatattgctgctggcagtggtacaggagccccggcaagaatggatctcactttcttcccagcagcgacctgttcagccccaaggagcgggccgatgtcatgctctcaaccacctgctgctgcgtcatgctcgcatcgctgctcgccatggcgtgcgccttcggaccactccacctgctcaagctctacgccgtcccataccttgtatttgtgatgtggcttgacctggtgacgtacctgcaccaccacggcagccccgagcagcagctcccctggtaccgcggcgacgagtggagctacctgcgtggggggctcaccaccgtggaccgggactacggctggatcaacaagatccaccacgacatcggcacccatgtcatacaccacctattcccacagataccgcactaccatctcgtagaagcagtaggcatgcgcttcttctttcttcttgtactttttatttatatataaaaaatttgaaatttgaaaacttc

SEQ ID NO: 46731 - protein, 158 aa, Panicum virgatum
  misc_feature: Ceres CLONE 2032216
  misc_feature (1)..(150): Pfam Name: FA_desaturase Pfam Description: Fatty acid desaturase
  misc_feature: SWISSPROT Homolog: EC 1.14.99.33 Delta(12)-fatty acid dehydrogenase
  misc_feature: Functional homolog of the protein sequence given in SEQ ID NO 50738
  misc_feature: Useful for making plants with modulated heat sensitivity
MQYCCWQWYRSPGKNGSHFLPSSDLFSPKERADVMLSTTCCCVMLASLLAMACAFGPLHLLKLYAVPYLVFVMWLDLVTYLHHHGSPEQQLPWYRGDEWSYLRGGLTTVDRDYGWINKIHHDIGTHVIHHLFPQIPHYHLVEAVGMRFFFLLVLFIYI

SEQ ID NO: 46732 - DNA, 334 bp, Panicum virgatum
  misc_feature: Ceres CLONE 2032227
  misc_feature: Encodes the peptide sequence at SEQ ID NO. 46733
acgctgctcaggcattcctcctactccagctcctcttctctcttcgttctctcgtctcctcttctcaatcgagcgctcgattgttgacctgctcagctgcacgccggcctgagacatcggaggggggcgtggtgaccggcagatggatccgtggatcagcagccagccttctctgagccttgacctgcacgtcggcctgccgccgctcagccgccaccaggcgccgctcgccttggccaagcccaaggtgctcgtcgaggagaacttcctgcagcctctcaagaaagaaccagaggtatggtggcgtgactgatctcgattgattctagctagc

SEQ ID NO: 46733 - protein, 56 aa, Panicum virgatum
  misc_feature: Ceres CLONE 2032227
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
MDPWISSQPSLSLDLHVGLPPLSRHQAPLALAKPKVLVEENFLQPLKKEPEVWWRD

SEQ ID NO: 46734 - DNA, 438 bp, Panicum virgatum
  misc_feature: Ceres CLONE 2032244
  misc_feature: Encodes the peptide sequence at SEQ ID NO. 46735
tcaaaaaaaaaaaaaaaaaaaatcgactccttgctatcaacatatgaggatgttattgtcaaagtgaaaggagatgccaccaaggaagatgttttttctgagatcgacaagctgctgagctctagcctggacaagaaaacagaaattgtggccaacgcctgagccagtaaaatccatgcaggtcaggcatgtttatgcaagctcccttgcatgctaggaaaacttcttcatttggatgtggttgaaacatagggtttgcctggaattgtaccatgtgttgttgtacacgaatggaagtgacaggtcattcatagggatgaggacttcagagatcctttttaatcatacctgcgctgtacatggtttgtttccaacctgtacatgttatgtttctcagctggagaaatggtcagttattgatttttattggtttgctgc

SEQ ID NO: 46735 - protein, 53 aa, Panicum virgatum
  misc_feature: Ceres CLONE 2032244
  misc_feature: SWISSPROT Homolog: EC 2.7.4.3 Adenylate kinase
SKKKKKKIDSLLSTYEDVIVKVKGDATKEDVFSEIDKLLSSSLDKKTEIVANA

SEQ ID NO: 46736 - DNA, 406 bp, Panicum virgatum
  misc_feature: Ceres CLONE 2032245
  misc_feature: Encodes the peptide sequence at SEQ ID NO. 46737
cgaggatttggttttgtaaccatggcaacaaaggatgaacttgacgatgccatttccgccctcgacgggcaggaattggatggccgcccacttcgggtgaatgttgcagcggagcggccccagaggggcttttgatgctgcgatatgagagagatggctgcttgttagtaatgagcatggagatacaacagaggagcaatgggacgcttttgcgggagctgatgccaagttgctagatatcctccctttgcttcctgttgtttggttcttgccacacggcttttgatgctgctatttgctgctgatgttaatgtcttaatatttgttgacaccactagttatatttttcaagtaggctactatcctgatgtggtgatgcataaaagatctccatcgctatatcttg

SEQ ID NO: 46737 - protein, 44 aa, Panicum virgatum
  misc_feature: Ceres CLONE 2032245
  misc_feature: Functional homolog of the protein sequence given in SEQ ID NO 50183
  misc_feature: Useful for making plants with altered alkaloid content
  misc_feature: The sequence is a functional homolog of SEQ ID NO 22 in US patent 7244875
  misc_feature: Functional homolog of the protein sequence given in SEQ ID NO 50182
  misc_feature: Useful for making plants with modulated biomass
RGFGFVTMATKDELDDAISALDGQELDGRPLRVNVAAERPQRGF

SEQ ID NO: 46738 - DNA, 607 bp, Panicum virgatum
  misc_feature: Ceres CLONE 2032329
  misc_feature: Encodes the peptide sequence at SEQ ID NO. 46739
aacactttacatatgttgcaaactcacaagagcaatggggcgaataaattaaggattttcaatatatactatcgatatgttaatattttatatatcaactgacattgaccctgcggcacagcaagagtaatcacttcaaaggaatgccattccgccatatcataaaaaattttgtgattcaaggtggtgattttgattttgatggagctgcccaagaatggataacaaaagctaaagccagtgggaagaatgatctcagtccaaagcacgaggcatttatgattgggactgctaagaatcctaataacaaaggatttgatttgtttatcacaactgccccaattcctgatttgaatgacaagcttgtagtatttgggcgagtcctcaagggagaagatattgttcaggagattgaagaagttgacaccgatgagcattatcagccaaagactcccataggcatcatgaatatcatactaaaacaggagccatgagctgataactttttggcaggctcgtgtacatgaaaaccttaactacctgtctccctactctctgtagtatacttagtatgaaaaagtccatacgtctcattgagtttctgttg

SEQ ID NO: 46739 - protein, 116 aa, Panicum virgatum
  misc_feature: Ceres CLONE 2032329
  misc_feature (3)..(113): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MPFRHIIKNFVIQGGDFDFDGAAQEWITKAKASGKNDLSPKHEAFMIGTAKNPNNKGFDLFITTAPIPDLNDKLVVFGRVLKGEDIVQEIEEVDTDEHYQPKTPIGIMNIILKQEP

SEQ ID NO: 46740 - DNA, 643 bp, Panicum virgatum
  misc_feature: Ceres CLONE 2032336
  misc_feature: Encodes the peptide sequence at SEQ ID NO. 46741
acctcagcaactaggctctcttcacacgagcgcaaccacccaccactacaagcggaagcgagcggcggcggcggcgatgtcgggcaggggcaagggcggcaaggggctcgggaagggcggcgcgaagcgtcaccggaaggtgctccgcgacaacatccagggcatcacgaagccggcgatccggaggctggcgaggaggggcggagtgaagcgcatctccgggctgatctacgaggagacccgcggcgtgctcaagatcttcctcgagaacgtcatccgcgacgccgtcacctacacggagcacgcccgccgcaagaccgtcacagccatggacgtcgtctacgcgctcaagcgccagggccgcaccctctacggcttcggcggctaggttaggggtctgtcgatgtggttcggttccatgggtagcctcatcgccttccatgttttccggtagttgctgtagcggagtagtagctggttgcttggtccctttggcgtcgggtgtgtggatgtaagaaccgctggttcgaagcaattggtctggatgcaggatgctgatgtaggaaatctgcagttcactttcaattgctattctacgaatactgtttgtctcgaagtaaactctgcacaatttgtcctggat

SEQ ID NO: 46741 - protein, 103 aa, Panicum virgatum; identical to SEQ ID NO: 12044
  misc_feature: Ceres CLONE 2032336
  misc_feature (25)..(94): Pfam Name: Histone Pfam Description: Core histone H2A/H2B/H3/H4

SEQ ID NO: 46742 - DNA, 692 bp, Panicum virgatum
  misc_feature: Ceres CLONE 2032341
  misc_feature: Encodes the peptide sequence at SEQ ID NO. 46743
actgcacagcacctcactcgctcgctcgctcactcagcaggttcagctcagagccccagacacccacccgccactgcgcagccagcagccatgagcaagggggagaagcaccaccggcacgagcaccacctgcgccgctgctgcggctgcctggcctcggtcctgctggcgctggtcctcgtggtggccttcgtcgcgctggtcgtctacctcgcgctgcgcccctccaagccgtccttctacctgcaggacctgcagctccgccggcccatccacgtcggcgacccctccctctcggcgtccgcgcaggtcacgctcgcctcccgcaaccccaacgaccgcgtcggcgtcctctacaagcggctcgacgtcttcctcacctaccgcgaccagctcgtcacggcgcccgtctccctcccgccgcagtaccagggccaccgggacgtcatcgtctggtcccccgtgctggccgccgagtccgtgcccgtggccggctacgtcgccgacgccatgaagcaggacgtcgccgccgggttcgtcgcgctgcaggtcaaggtcgacggccgcgtcaagtggaaggtcgggagctgggtctccgggagctaccacctcttcgtcagctgccccgccgtgctctccgccggcggcttcttcggaggctccaacgccacggtgctcaagttcgcgcagcc

SEQ ID NO: 46743 - protein, 200 aa, Panicum virgatum
  misc_feature: Ceres CLONE 2032341
  misc_feature (40)..(178): Pfam Name: Hin1 Pfam Description: Harpin-induced protein 1 (Hin1)
MSKGEKHHRHEHHLRRCCGCLASVLLALVLVVAFVALVVYLALRPSKPSFYLQDLQLRRPIHVGDPSLSASAQVTLASRNPNDRVGVLYKRLDVFLTYRDQLVTAPVSLPPQYQGHRDVIVWSPVLAAESVPVAGYVADAMKQDVAAGFVALQVKVDGRVKWKVGSWVSGSYHLFVSCPAVLSAGGFFGGSNATVLKFAQ

SEQ ID NO: 46744 - DNA, 459 bp, Panicum virgatum
  misc_feature: Ceres CLONE 2032345
  misc_feature: Encodes the peptide sequence at SEQ ID NO. 46745
aaccgagcccaaggtacgcgacgcgcggcacaccggaaccaaagccagaacctaagcctgaaccaaaaccgaagcctgagccgaaaccagaacctaagcctgaacctgaaccgaagcctgagcccaaaccgaaaccaaagccggaacctaagcctgagccaaagcccgaaccaaaaccgaagccggagccaaagcccgaaccaaagcctaaacccgagccaaagcctgagcccaaaccgaagccagacccacctcacatcccacctgcagccgacaactgacgaagtggccgctagctattttgtatggcgtcgcagagtatagtagtatctgaataaaaccggccggaccggagttgcagcatctagattggtgcttgctgctgcttgatgtacttattctttctttccattgtattcagctcagtacattatcagtgcagcttaatttgttctttgt

SEQ ID NO: 46745 - protein, 92 aa, Panicum virgatum
  misc_feature: Ceres CLONE 2032345
  misc_feature: Functional homolog of the protein sequence given in SEQ ID NO 50172
  misc_feature: Useful for making plants with modulated biomass
  misc_feature: Useful for making plants with modulated flowering time
PSPRYATRGTPEPKPEPKPEPKPKPEPKPEPKPEPEPKPEPKPKPKPEPKPEPKPEPKPKPEPKPEPKPKPEPKPEPKPKPDPPHIPPAADN

SEQ ID NO: 46746 - DNA, 1013 bp, Panicum virgatum
  misc_feature: Ceres CLONE 2032351
  misc_feature: Encodes the peptide sequence at SEQ ID NO. 46747
atcgtcacatcggtagtgttgaggttcctgcaggctttcagctgagcgttcgtcagtagtagccaagtgttcatcgctgctttcatttcctgagagtgattcgagcgatcgatctctgttcgtgtgtttttagttagctcgagggtgagagatcgtcgtcatggcttcccaccaggacaaggctagctaccaggccggcgagaccaaggcccacaccgaggagaaggctgggcaggcgatgggggcgaccagggacacggcgcagcacgccaaggaccgggcgtcggacgcggcggggcacgcggcgggcaagggccacgacgccaaagaggcgaccaagcagaaggcgtccgacaccggcagctacctgggccagaagaccgaggaggccaagcacaaggccggcgagaccaccgaggccgccaagcacaaggccggggagaccaccgaggccgccaagcacaagaccgccgagaccaccgaggccggcaagcagaagaccgccgagaccaccgaggccaccaagcagaaggccggcgaggccggcgagtacgccaaggagagcgccgtcgccggcaaggagaagaccggcagcgtcatccagcaggctactgagcaggtgaagagcgcggcggtgggcgccaaggacgcggtgatgaacacgctggggatgagcggggacaacaaggagggcggcgccggcaaggaggaggaccactccaccatcaccagggatcagtagacgcgcgcgcgagcttgcatgcgtcccgcactcgatcgatccatccatccattccccggttgcttgttcatgagtccattatgtatcttttttcggttccatgattcctacgaattcggtgctgtaagtttggcgttgctgtatttgcgtctgtaaacgagtcggggtgggagcggtctggctggcgatctctatgctcgtcggtcaggcgtctctcagctttgtggttttttattatggtgtaatgaagctggtaaatcctcttatgtat

SEQ ID NO: 46747 - protein, 193 aa, Panicum virgatum
  misc_feature: Ceres CLONE 2032351
  misc_feature (107)..(150): Pfam Name: LEA_4 Pfam Description: Late embryogenesis abundant protein
  misc_feature: Functional homolog of the protein sequence given in SEQ ID NO 51080
  misc_feature: Useful for making plants with modulated water use efficiency
MASHQDKASYQAGETKAHTEEKAGQAMGATRDTAQHAKDRASDAAGHAAGKGHDAKEATKQKASDTGSYLGQKTEEAKHKAGETTEAAKHKAGETTEAAKHKTAETTEAGKQKTAETTEATKQKAGEAGEYAKESAVAGKEKTGSVIQQATEQVKSAAVGAKDAVMNTLGMSGDNKEGGAGKEEDHSTITRDQ

SEQ ID NO: 46748 - DNA, 644 bp, Panicum virgatum
  misc_feature: Ceres CLONE 2032367
  misc_feature: Encodes the peptide sequence at SEQ ID NO. 46749
ttgtgctttggtcgttatgattcacctgagcatagagttgtggattttcctccttcgacatggcctggaaaggattactacaatcctagagaatccgagccaaattcttgggaggatacgatgaaagatgagcttgatcgtactaaatatcctcgcatgccttggcatgatgttcagtgcgcactttatggtccagcatgtagagatgtagcaaggcattttgttcagagatggaactatgcaaagaggaataaagcaccaaatgagcaagcaattccattattgatgcctcatcatcacatggtgattcctcattacatgggtacaagcaaagaaacaaatggggaaacagagagtaaacagaacctcagcatggatattaaaattgataggctaaactctatgaaaacaccagcatcgtgtcaggacattccattgcttttgccacatgaacctgatcaccatgcatttccaaatggagattttgcactgaacggtatgaatatcaacaatggaatttcagatcatgcaaataaaaccaatcggaaccagccactgcccaaccgaaaggccaaagtagatcattctttacaagatttacagatgaaaggatttgtggacaatgtcggctcccctgaggtttc

SEQ ID NO: 46749 - protein, 214 aa, Panicum virgatum
  misc_feature: Ceres CLONE 2032367
  misc_feature: SWISSPROT Homolog: EC 3.1.4.4 Phospholipase D
LCFGRYDSPEHRVVDFPPSTWPGKDYYNPRESEPNSWEDTMKDELDRTKYPRMPWHDVQCALYGPACRDVARHFVQRWNYAKRNKAPNEQAIPLLMPHHHMVIPHYMGTSKETNGETESKQNLSMDIKIDRLNSMKTPASCQDIPLLLPHEPDHHAFPNGDFALNGMNINNGISDHANKTNRNQPLPNRKAKVDHSLQDLQMKGFVDNVGSPEV

SEQ ID NO: 46750 - DNA, 643 bp, Panicum virgatum
  misc_feature: Ceres CLONE 2032395
  misc_feature: Encodes the peptide sequence at SEQ ID NO. 46751
attccgctttgagcttgcttgcagctccagctcccctcgtctcttggtggctacgccatggccaccgtagtcctgatgagctgcagcctccgcgcgccggccagcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatgttttgattatatatatatatatatatatataattaaaccctacgtcgtgcgtgctatagctatagctat

SEQ ID NO: 46751 - protein, 149 aa, Panicum virgatum; identical to SEQ ID NO: 18646
  misc_feature: Ceres CLONE 2032395
  misc_feature (58)..(133): Pfam Name: Fer2 Pfam Description: 2Fe-2S iron-sulfur cluster binding domain

SEQ ID NO: 46752 - DNA, 428 bp, Panicum virgatum
  misc_feature: Ceres CLONE 2032401
  misc_feature: Encodes the peptide sequence at SEQ ID NO. 46753
tctactttagaattgagatgtgcctagtgggtctgaatagtcagagcatggcagggatagattacatgtcagccaagttcggtaatgaggagggccctgtggctattagtgttgtgtcagctggtgtgtatgataacactgaagacgatccagatgttctagtttacactggacagggcatgtctggcaaggatgaccaaaaacttgagaggggtaatcttgcactggagaggagtctgcatagaggtaatccaattagagtcattcgtagtgtaaaagatttgacttgtccaactggcaagatatacatatatgacggtctttacaagatcaaagaagcctggatggagaaagggaaatctggtttcaatgtgtttaaacacaagttactcagagaacctggccaacccgatggcattgcagtgtgg

SEQ ID NO: 46753 - protein, 141 aa, Panicum virgatum
  misc_feature: Ceres CLONE 2032401
  misc_feature (1)..(135): Pfam Name: YDG_SRA Pfam Description: YDG/SRA domain
  misc_feature: SWISSPROT Homolog: EC 2.1.1.43 Histone-lysine N-methyltransferase
YFRIEMCLVGLNSQSMAGIDYMSAKFGNEEGPVAISVVSAGVYDNTEDDPDVLVYTGQGMSGKDDQKLERGNLALERSLHRGNPIRVIRSVKDLTCPTGKIYIYDGLYKIKEAWMEKGKSGFNVFKHKLLREPGQPDGIAV

SEQ ID NO: 46754 - DNA, 715 bp, Panicum virgatum
  misc_feature: Ceres CLONE 2032412
  misc_feature: Encodes the peptide sequence at SEQ ID NO. 46755
aatggagtctaccgcgctaatcgcaccattaccgcttctaacctctcgctcccgttccaaacccccctcccctgcctccattagagctcgccgccccgcctccattcccttctacgggagcggccgcgtcgtcctattttcccgccgcggccgcgagtacgccggcgttggatccttggtctccgccgccgcagcgactggggaggcagcagatggcggctctgaggccatcctgctcagtgtccagggtatgatgtgcgacgggtgcgcggcgagcgtgaagcggattctggagagccaaccagaggttacatctgctaccgttgattttaaggaaacaaatgcagttgtgtggacaacagctgaagctagggcatcggataattggcagaagcaatgtggagagaaacttgctaaacacctcggcacttgtggatttgagtctcggctgcaaggtaattagagtaaggtgaagacaaacaaagctgatactgaatataagtgatgttatcccatgggttcaacgtcagacgttatcctatgagttcagcgtcagttcaatttccaccatcatctgtgttgcagacttgccgggagccctggagagttatgcaacccaaattccagtgttccatctcatggagctcgagcttagtgccggtgtactagtgcttcctttcacttttctcatggggctttagctagttttgtttgg

SEQ ID NO: 46755 - protein, 70 aa, Panicum virgatum
  misc_feature: Ceres CLONE 2032412
  misc_feature (1)..(67): Pfam Name: HMA Pfam Description: Heavy-metal-associated domain
  misc_feature: SWISSPROT Homolog: EC 1.16.1.1 Mercury(II) reductase
MMCDGCAASVKRILESQPEVTSATVDFKETNAVVWTTAEARASDNWQKQCGEKLAKHLGTCGFESRLQGN

SEQ ID NO: 46756 - DNA, 717 bp, Panicum virgatum
  misc_feature: Ceres CLONE 2032416
  misc_feature: Encodes the peptide sequence at SEQ ID NO. 46757
gcagaactcagaacagccgagaaacacacacgcgagcctgaatcaataatcatcgaagcaacagcaatcccagactcccagtctcccgcgtcactcaaacaccaagcaaccacccaccgatcaacaatgtcgctgatccgccgcagcaacgtgttcgaccccttctccctcgacctctgggatcccttccagggcttccccttcggctccggcagcggcagcagcagcctcttcccctcgtttgcaggcaccaactctgagaccacggccttcgccggcgcccgcatcgactggaaggagaccccggaggcgcacgtgttcaaggcggacgtcccggggctgaagaaggaggaggtcaaggtggaggtcgaggacggcaacgtgctccagatcagcggcgagcgcaacaaggagcaggaggagaagaacgacaagtggcacagggtggagcgcagcagcggcaagttcctgcgccggttcaggctgccggagaacgccaagacggagcagatcagcgcgtccatggagaatggcgtgctcaccgtcaccgtgcccaaggacgaggtcaagaagcccgaggtcaagcccgtccagatcaccggctagagccgggagcctggctgtttttgcgtcgtgtggagtcgctcgacgtggagtctgttcttccattcttgggtccaaaatgctagtgttagcgtccgagtccgagtaaagctt

SEQ ID NO: 46757 - protein, 159 aa, Panicum virgatum
  misc_feature: Ceres CLONE 2032416
  misc_feature (55)..(158): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFQGFPFGSGSGSSSLFPSFAGTNSETTAFAGARIDWKETPEAHVFKADVPGLKKEEVKVEVEDGNVLQISGERNKEQEEKNDKWHRVERSSGKFLRRFRLPENAKTEQISASMENGVLTVTVPKDEVKKPEVKPVQITG

SEQ ID NO: 46758 - DNA, 679 bp, Panicum virgatum
  misc_feature: Ceres CLONE 2032444
  misc_feature: Encodes the peptide sequence at SEQ ID NO. 46759
aaaagatcacaaactttaattgggccgtcacaagcaaacctcatctactatttttgcaggaaggaagagctagctccttgtgtgtgtgtgtgacaggaagagggtcgagatggctacggcgtacgctcccatggcgagccaggtgatgaagagcggcatggtgcactcgaggccgaggggcctctctggcgctgcgctgacgaggcggccacgcttcaccgtgaaggccatccagcctgagaagccaacgtaccaggtggtgcagcccatcaacggcgaccccttcatcggcagcctggagacgcccgtcacctcgagcccgctcgtggcctggtacctctccaacctgccggcctaccgcaccgccgtgagcccgctgctccgcggcatcgaggtcggcctcgcgcacggctacctcctcgtcgggcccttcgcgctcaccggcccgctccgcaacacgcccgtgcacggccaggccggcgccctgggcgccgccgggctcgtcaccatcctcagcgtctgcctcaccatgtacggcgtcgcctccttcaacgagggggacccgtccacggcgcccacgctcacgctcacggggcgcaagaaggaggccgacaagctgcagaccgccgacgggtgggccaagttcaccggaggcttcttcttcggcggcatctccggc

SEQ ID NO: 46759 - protein, 189 aa, Panicum virgatum
  misc_feature: Ceres CLONE 2032444
  misc_feature (48)..(189): Pfam Name: PsaL Pfam Description: Photosystem I reaction centre subunit XI
MATAYAPMASQVMKSGMVHSRPRGLSGAALTRRPRFTVKAIQPEKPTYQVVQPINGDPFIGSLETPVTSSPLVAWYLSNLPAYRTAVSPLLRGIEVGLAHGYLLVGPFALTGPLRNTPVHGQAGALGAAGLVTILSVCLTMYGVASFNEGDPSTAPTLTLTGRKKEADKLQTADGWAKFTGGFFFGGIS

SEQ ID NO: 46760 - DNA, 681 bp, Panicum virgatum
  misc_feature: Ceres CLONE 2032446
  misc_feature: Encodes the peptide sequence at SEQ ID NO. 46761
acggttgcagagccagcgagagacgcgacttgcttttcgcttcatccgtagcgagcttacgagttgctgcccatcactttcttggtcgtctctgatcgatcggcctgagctcccggcagcggcagtggaagcggaaggagaggaggaggatgagctcggtgtgcgcgaggcccgtgggctcgggctgctacttcgccggggccaggggccagcggcgggcgcgggtgcgggtggccgccgcggcggcggtggccgcgccggcgtcgaaggcgacgatgtacgaggtgctggcggtggaggagacggcggggcccgaggagatcaaggcggcgtaccggcgcgcggcgcggcggtggcacccggacgcgtgccccggcggcgccgaccgcttcatggcggcgcgggaggcctacgaggtgctgtccgacccggagcgcaggcgcggctacgacatccagctccgctgcggcggcttcggcttcggcgacgcgggctaccgcgcggcgcggcgcgcggggttcgccgactgggagtcgcagctggccgggctgcagtggcgcgcggcggagcggcgcggccgggagacgtggggcagcaggatgcgccgggccgccgcgtagcagacccattgtaaccctggaggcgctatcaaatactccattgtaaccctggaggcgctat

SEQ ID NO: 46761 - protein, 156 aa, Panicum virgatum
  misc_feature: Ceres CLONE 2032446
  misc_feature (42)..(101): Pfam Name: DnaJ Pfam Description: DnaJ domain
MSSVCARPVGSGCYFAGARGQRRARVRVAAAAAVAAPASKATMYEVLAVEETAGPEEIKAAYRRAARRWHPDACPGGADRFMAAREAYEVLSDPERRRGYDIQLRCGGFGFGDAGYRAARRAGFADWESQLAGLQWRAAERRGRETWGSRMRRAAA

SEQ ID NO: 46762 - DNA, 628 bp, Panicum virgatum
  misc_feature: Ceres CLONE 2032450
  misc_feature: Encodes the peptide sequence at SEQ ID NO. 46763
cgacacacgcaccagaggcgaaggtccgatcgaggagagcgcaggcgcagcgacggcaatggcagcgtcactccaagccgcggccaccctgatgcagccggccaagatcggcggccgcgcctccgcctcgctgccgtcccgtcagccgtcccacgccgccaagctcgccggcttcgcactcgccacctcggcgctcctcgtctccggcgcgagcgcggagggcacgcccaggaggctgacctacgacgagatccagagcaagacgtacatggaggtgaaagggaccggcacggcgaatcagtgcccgaccatcgacggcggtgtcgagtccttcccgttcaagcccggcaagtaccagatgaagaagttctgcctggagccgacgtcgttcaccgtcaaggccgagggcatcgccaagaacgcgccgcccgagttccagaagaccaagctcatgacccgcctcacctacacgctcgacgagatcgagggcccgctcgaggtcggctccgacggcgccctcaagttcgaggagaaggacggcatcgactacgccgccgtcaccgtgcagctcccgggaggcgagcgcgtgcccttcctcttcaccgtcaagcagctcgtcgccaccggc

SEQ ID NO: 46763 - protein, 189 aa, Panicum virgatum
  misc_feature: Ceres CLONE 2032450
  misc_feature (64)..(189): Pfam Name: MSP Pfam Description: Manganese-stabilising protein / photosystem II polypeptide
MAASLQAAATLMQPAKIGGRASASLPSRQPSHAAKLAGFALATSALLVSGASAEGTPRRLTYDEIQSKTYMEVKGTGTANQCPTIDGGVESFPFKPGKYQMKKFCLEPTSFTVKAEGIAKNAPPEFQKTKLMTRLTYTLDEIEGPLEVGSDGALKFEEKDGIDYAAVTVQLPGGERVPFLFTVKQLVAT

SEQ ID NO: 46764 - DNA, 719 bp, Panicum virgatum
  misc_feature: Ceres CLONE 2032459
  misc_feature: Encodes the peptide sequence at SEQ ID NO. 46765
tgcgacctgactccatggggtcatcccttgcccttcaagtctccaaggataatgagaagcgcaattcagttcatttccaagcactggccatactggaacaggacagagggagcagatcatttctttgttgtcccacatgactttggtgcatgcttccattaccaggaagagaaagctattgagcgaggagtccttccattgcttcgccgtgcgacgctggtccagacttttgggcagaaagatcatgtctgcctaaaggaaggctccattaccatcccaccatatgcacccccgcagaagatgaaaactcaccttgttcccccagagacccttcgttcaatctttgtctatttccgtggtttgttctatgatactgcaaatgatcctgagggtggttactatgcaaggggcgcccgtgcatcagtgtgggagaacttcaagaacaacccgctgttcgacatatcggcagaccacccaccaacttactatgaggacatgcagcgtgccgtcttctgcttgtgcccactgggctgggccccatggagcccccgtttggtggaggcagtggtctttggctgcatcccagtgatcattgctgatgacatcgtccttccctttgcggacgctatcccatgggaggaaatcggtgtttttgtggccgaggacgacgtccccaagctggacaccatcctgacctccataccaatgggagtgatcct

SEQ ID NO: 46765 - protein, 239 aa, Panicum virgatum
  misc_feature: Ceres CLONE 2032459
  misc_feature (8)..(238): Pfam Name: Exostosin Pfam Description: Exostosin family
  misc_feature: Functional homolog of the protein sequence given in SEQ ID NO 50624
  misc_feature: Useful for making plants with altered carbohydrate content
  misc_feature: Functional homolog of the protein sequence given in SEQ ID NO 50625
  misc_feature: Useful for making plants with altered cell wall content and/or composition
CDLTPWGHPLPFKSPRIMRSAIQFISKHWPYWNRTEGADHFFVVPHDFGACFHYQEEKAIERGVLPLLRRATLVQTFGQKDHVCLKEGSITIPPYAPPQKMKTHLVPPETLRSIFVYFRGLFYDTANDPEGGYYARGARASVWENFKNNPLFDISADHPPTYYEDMQRAVFCLCPLGWAPWSPRLVEAVVFGCIPVIIADDIVLPFADAIPWEEIGVFVAEDDVPKLDTILTSIPMGVI

SEQ ID NO: 46766 - DNA, 648 bp, Panicum virgatum
  misc_feature: Ceres CLONE 2032469
  misc_feature: Encodes the peptide sequence at SEQ ID NO. 46767
cgactcggacgacctgccgctcaacatctcccgggagacgctgcagcagaacaagatcctcaaggtcatccgcaagaacctcgtcaagaagtgcatcgagatgttcttcgagatcgccgagaacaaggaggactacgccaagttctacgacgccttctccaagaacctcaagctgggcatccacgaggactcgcagaaccgcgccaagctcgccgacctcctccgctaccactccaccaagagcggcgacgagatgacgtcgctcaaggactacgtcacgcgcatgaaggaggggcagaaggacatctactacatcaccggcgagagccggaaggccgtggagaactcgccgttcctggagcgcctcaagaagaagggctacgaggtgctcttcatggtggacgccatcgacgagtacgccgtcgcccagctcaaggagtacgacggcaagaagctggtgtcggccaccaaggagggcctcaagctggacgaggagacggaggaggagaagaagcgccgcgaggagcgcaagaagcagttcgaggacctgtgcaaggtgatcaaggagatcctgggagaccgcgtcgagaaggtagtggtgtcggaccgcatcgtcgactcgccgtgctgcttggtcaccggcgagta

SEQ ID NO: 46767 - protein, 215 aa, Panicum virgatum
  misc_feature: Ceres CLONE 2032469
  misc_feature (1)..(215): Pfam Name: HSP90 Pfam Description: Hsp90 protein
DSDDLPLNISRETLQQNKILKVIRKNLVKKCIEMFFEIAENKEDYAKFYDAFSKNLKLGIHEDSQNRAKLADLLRYHSTKSGDEMTSLKDYVTRMKEGQKDIYYITGESRKAVENSPFLERLKKKGYEVLFMVDAIDEYAVAQLKEYDGKKLVSATKEGLKLDEETEEEKKRREERKKQFEDLCKVIKEILGDRVEKVVVSDRIVDSPCCLVTGE

SEQ ID NO: 46768 - DNA, 708 bp, Panicum virgatum
  misc_feature: Ceres CLONE 2032486
  misc_feature: Encodes the peptide sequence at SEQ ID NO. 46769
acgactcgggcagacaaatcctatcctcctccacctagtcaccacagtcgtctctccctgcgccgcgttagctgccaacgatggcccttgagacgtgcttcagagcgtgggcgctgcacgccgcccctgccggcggcaaggacaggctcgccgtcggcggcggcggcagcagcagcagcagcttcgcgccgtccaagcgggccgcggccgccgccgccgccgcgccgctgtccgtcggccgcgttgccacgcggcggccccggcacgtctgccagtccaagaacgccgtcgacgaagtgctggtggcggatgagaagaactgggacgggatggtgatggcgtgcgagacgccggtgctggtggagttctgggcgccgtggtgcgggccctgccggatgatcgcgccggtgatcgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatggatgatgttgttggagatgaactaaatacatacgtgtccgtgctcgcgcatacacaccatgcatctc

SEQ ID NO: 46769 - protein, 179 aa, Panicum virgatum
  misc_feature: Ceres CLONE 2032486
  misc_feature (72)..(175): Pfam Name: Thioredoxin Pfam Description: Thioredoxin
  misc_feature: SWISSPROT Homolog: EC 1.8.1.8 Protein-disulfide reductase
MALETCFRAWALHAAPAGGKDRLAVGGGGSSSSSFAPSKRAAAAAAAAPLSVGRVATRRPRHVCQSKNAVDEVLVADEKNWDGMVMACETPVLVEFWAPWCGPCRMIAPVIDELAKDYAGKIKCCKVNTDDCPNVASTYGIRSIPTVLIFKAGEKKESVIGAVPKTTLTTIIDKYIGSS

SEQ ID NO: 46770 - DNA, 907 bp, Panicum virgatum
  misc_feature: Ceres CLONE 2032496
  misc_feature: Encodes the peptide sequence at SEQ ID NO. 46771
ctaccacagcaagaatagtgatctgcacagctcgtgtgtcatcctcattgctcgtacgcccggcagcggcaggccagcgcatcatcacggtcagataaggctaagctcgtcgtcatggcaaccgccctgcccctcgtcgcgctgctcgtcgccgggtgcgcggcgctggcctcggccacgacgttcaccgtcggcgagtcgcagggctggacgaccggcgccaactacgacagctgggccaacggcaagagcttcgccgtcggggacacgctagtgttccggtacgtgagcaaggcgcacacggtgacggaggtgaccaagagcggctacgacacctgctccggctccggcgccaacgcgctgagcgacgacgacagcggctccaccaccgtcacgctcaccacccccggcacgcactacttcatctgcaacgtgcccgggcactgcgccagcggcatgaagttcgccatcaccgtctccgccacgcgctccggcgccgccgcgtccgcggccgccccgcaggttccggtgccgacagtggcctccgtcgctgtcgccgcggccgccgcgatcaagctcttgttcttctgacggcggagctgagcacggccgtctcgatcttcggagtctcagggtagagacagtgcatgcattgcaggctacacgttcttagccgctgacgacattctcgtgtaataatccatcagaaattgctgtccatatttctgctacgttttctggcgattcctcgtcgtgcagcagctcatgtacgtacttacgctgccgtgccgtgtccttttgatgtctgtggctgtgtgtactgtattcgtcagcaggtgtacatcatgtctgatcgttttttgttgggtgtgaaaataaaatttgctcctcttgtgttcgatggacg

SEQ ID NO: 46771 - protein, 158 aa, Panicum virgatum
  misc_feature: Ceres CLONE 2032496
  misc_feature (32)..(115): Pfam Name: Cu_bind_like Pfam Description: Plastocyanin-like domain
MATALPLVALLVAGCAALASATTFTVGESQGWTTGANYDSWANGKSFAVGDTLVFRYVSKAHTVTEVTKSGYDTCSGSGANALSDDDSGSTTVTLTTPGTHYFICNVPGHCASGMKFAITVSATRSGAAASAAAPQVPVPTVASVAVAAAAAIKLLFF

SEQ ID NO: 46772 - DNA, 669 bp, Panicum virgatum
  misc_feature: Ceres CLONE 2032509
  misc_feature: Encodes the peptide sequence at SEQ ID NO. 46773
tctcgctcgtctaccttcccctccatcccatctcaccgtaccgtacgtaccaggtagcagctagctaggcgcaggccatggccgccgtgaccgtctctctgtcgtccttcccggccgctgccaaggcggccgctgcttggccgtccccgtactcgtcatgcacgtacccgcggcgggcggtgcgggtgcgcgttcaggtgtcgacgacggagaccgctgaggcggggccggcgccggtgaagacggagaagatctccaagaagcaggacgagggtgtggtgaccaacaagtacaagcccaaggagccctttgtggggaggtgcctgctcaacaccaggatcacaggagacaaggcgccgggggagacgtggcacatggtcttcagcacagaaggcgagatcccttacagagaagggcagtccatcggcgtcatcgccgacggcgtggacaagaacggcaagccgcacaagctcaggctctactccatcgccagcagcgccctcggggatttcggcgactccaagaccgtgtcgctgtgcgtgaagaggctcgtgtacaccaacgatcaaggagaggtcgtcaaaggagtctgctccaactacctatgtgacctgaagcccggcgctgaggtgaagatcacagggccagtcggcaaggagatgctcatgc

SEQ ID NO: 46773 - protein, 197 aa, Panicum virgatum
  misc_feature: Ceres CLONE 2032509
  misc_feature: SWISSPROT Homolog: EC 1.18.1.2 Ferredoxin--NADP(+) reductase
MAAVTVSLSSFPAAAKAAAAWPSPYSSCTYPRRAVRVRVQVSTTETAEAGPAPVKTEKISKKQDEGVVTNKYKPKEPFVGRCLLNTRITGDKAPGETWHMVFSTEGEIPYREGQSIGVIADGVDKNGKPHKLRLYSIASSALGDFGDSKTVSLCVKRLVYTNDQGEVVKGVCSNYLCDLKPGAEVKITGPVGKEMLM

SEQ ID NO: 46774 - DNA, 1064 bp, Panicum virgatum
  misc_feature: Ceres CLONE 2032510
  misc_feature: Encodes the peptide sequence at SEQ ID NO. 46775
tagaatgttttatcttgttatgcttggtagtttcaggagtccatacaaatctaatcagtatctactttccggaacagtctggaatgaaatcaataggatgtagtatgtgcaaggagccaaggaatgtgtcaaagtttcttattgctcatacaacttccactgaaccaaatgattgcttattgtcttaccatcatcaggatttgttcatttatattgataataaaatcacgtgctgttgtgcacagtgatcaagtagtgtacatgtttctaccggtgcatcattttccttattgctactaatgtacccatgttatctgatgcagcaaagctgaaagatctggggaattctgtgctggggcgcttcggaatgagcgttgacaatttcaaagctgtcaaagatccaaacacaggttcctactccattcaattccagaagtaacacatggtgaagaaatacacagatgaatatcgctgggaggcatatttcagttaatggactcactggattcttcgctgtaattgcccgaggcacttctgcatcacatacatggtccatgttcacatagaatcctgcacatcgatctgaacataagcgatccttgaatcttttgtttgcgctcattgcacattcgagatgatttcccccttccccgtcatccttcaaaggttcggagatccttggttcgatggtacttccctcttccgcccatagaagcgggggagtgcgaacttatggtattttcctcgacacaaaagtcgcttgtgatggaaacgggaagcgtttccctgttgtgaaaattttccgtcctttccccaagatgtcaaatcgacactttgaccagatgtcgagagagtttttcggacactaattaaaaaactaatttcagaactcacttggaaaccgcgagacgaatcttttgaggcctttgatcgcatcattagcacatgtgtgttactgtagcacttatgactaatcatgtactaattatgctcgaaagattcgtctcgtcgtgtagatcataactgtgtaattagttttattatttaattacatttagtgtttc

SEQ ID NO: 46775 - protein, 43 aa, Panicum virgatum
  misc_feature: Ceres CLONE 2032510
  misc_feature: Functional homolog of the protein sequence given in SEQ ID NO 50975
  misc_feature: Useful for making plants with altered alkaloid content
  misc_feature: Useful for making plants with altered terpenoid content
MLSDAAKLKDLGNSVLGRFGMSVDNFKAVKDPNTGSYSIQFQK

SEQ ID NO: 46776 - DNA, 677 bp, Panicum virgatum
  misc_feature: Ceres CLONE 2032517
  misc_feature: Encodes the peptide sequence at SEQ ID NO. 46777
ataaaagccggggtgctggggttgagcctcttcgttcagcttagtgtgctcgatcatcaagcaatcaacaaagcctcccaattatcctttcatcagaccatcttccttcttccaagatgtcttgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgcatgctagctactacctactactctgcttgtgtgtgacttgatgattgaacaagaataaggatgagcctgagccatcatgtctcatgtatcggtttggctccggcctcatcaagcatgcatgcgtcgcctgcccctctgtgtgctttgcgtccgtcctgtgtctgtatgtgttgatcattgcaaagaaaccatgcaggcatacatctctgcatgtgtctctgtaatgatcggtccagagtgatgaatatataaaactggtttgctttatctgcctaaaatgcgtatttatcgtcttaatttggatcgtctttgg

SEQ ID NO: 46777 - protein, 69 aa, Panicum virgatum
  misc_feature: Ceres CLONE 2032517
  misc_feature (1)..(69): Pfam Name: Metallothio_2 Pfam Description: Metallothionein
MSCNCGSNCKCGKMYPDLEEKSSGGAQATIVLGVAPEKKAGQFEAAAESGETAHACKCGNSCSCDPCNC

SEQ ID NO: 46778 - DNA, 678 bp, Panicum virgatum
  misc_feature: Ceres CLONE 2032529
  misc_feature: Encodes the peptide sequence at SEQ ID NO. 46779
gaggagagcgccggccggcagctgggtgatcggagaagaacggcggccttgctaggatctttcgatcggtcgacatggacaggccagatcgccaccagcaccagtttttcatgccgctgccggtgctgcagcagcagcagcagctgtgcgcgcccatgatggacgagcaggcgtcgttcttggcggggagggccggtggcggcggcgggggaggtggaggtggagcggcggggaggggggagaggaagcggcggttcacggaggagcagatacggtcgctggagtccatgttccaggcgcaccacgccaagctggagccccgggagaaggcggagctggcgcggcagctgggcctgcagccgcggcaggtggccatctggttccagaacaagcgcgcccggtggcggtccaagcagctcgagcacgactacgccgcgctccgcgacaagttcgacgccctccacgcccgcgtcgagtccctcaagcaggagaagctcgccctcgccgcacagttgcaagagctaagcgagaggctgagggagcgggaggaccaccgggccgccagtggcggcgtcgcggcgacggctagcagcagcagctgcaacggcggcggcggcggcgaggaggcggaggacgacaaagaggagcgtcgtcctccggtgcgtccacatgcccccc

SEQ ID NO: 46779 - protein, 201 aa, Panicum virgatum
  misc_feature: Ceres CLONE 2032529
  misc_feature (57)..(112): Pfam Name: Homeobox Pfam Description: Homeobox domain
  misc_feature (113)..(157): Pfam Name: HALZ Pfam Description: Homeobox associated leucine zipper
MDRPDRHQHQFFMPLPVLQQQQQLCAPMMDEQASFLAGRAGGGGGGGGGGAAGRGERKRRFTEEQIRSLESMFQAHHAKLEPREKAELARQLGLQPRQVAIWFQNKRARWRSKQLEHDYAALRDKFDALHARVESLKQEKLALAAQLQELSERLREREDHRAASGGVAATASSSSCNGGGGGEEAEDDKEERRPPVRPHAP

SEQ ID NO: 46780 - DNA, 692 bp, Panicum virgatum
  misc_feature: Ceres CLONE 2032543
  misc_feature: Encodes the peptide sequence at SEQ ID NO. 46781
cacggaggtgaagtacagggtggcggcgaagggctcgtcgcgggagatcctgggcgggatatccgggtcggcgtcccccggcgaggtgctggcgctgatgggcccgtccggcagcggcaagacgacgctgctgagcatcctgggcggcagggccggcggcggcgccgtggagggctgcgtctcctacaacgacgagccctacggcaagtccctcaagcgcaggtaacctacccaccaccgtgtcgactcatcgacgcgcgccttaattgcaccactgctttaactaactagcagggcatgggcatctaactaatactaattcaatattcatttaactaattaattaaaaaataatggtattgaattctctggggcggagtttatacattatcagctagatctaggtgcttaattaattaattagttgtgtggtcagctttcggtaagttaagtgggtccatcgggcggtgatgaggtgttgctcgtagttacaggtggtgtccctgcacgcaatacctgtgcctgtctgtagctggtaagtgcatgctgaaaagatgcagcttagctagctgcctaactgtggctcacggttatcctgcgagtttgttaagtgttgacgcatggcctctcgctctccggtttactgttcatccaactctcgttgtgagggattgtctgcacagtgcagtact

SEQ ID NO: 46781 - protein, 74 aa, Panicum virgatum
  misc_feature: Ceres CLONE 2032543
  misc_feature (12)..(47): SWISSPROT Homolog: EC 3.6.3.27 Phosphate-transporting ATPase
  misc_feature (17)..(65): SWISSPROT Homolog: EC 3.6.3.25 Sulfate-transporting ATPase
TEVKYRVAAKGSSREILGGISGSASPGEVLALMGPSGSGKTTLLSILGGRAGGGAVEGCVSYNDEPYGKSLKRR

SEQ ID NO: 46782 - DNA, 829 bp, Panicum virgatum
  misc_feature: Ceres CLONE 2032548
  misc_feature: Encodes the peptide sequence at SEQ ID NO. 46783
actagcaggcatcgagttctcacaggcaggcaaagagaaactcccagcatccaaagcagaactgcagatagagctgctccaaacaatggagagttttgcccaggagcatgtcatcggaattcctttggcttcgtttgcatatgcccaagaggaaacgaaagggaaaccttcctgttctgccttgcttaataagaagaataagaagggttccttcatttaccggatgagcaaattgagccagaaaacagatagctacatgcaagggttcaaagaacacttaaccctgggaccaaaattttcagaaactatcaaagggaaagttagcttcggagcaaaggttctacaagctggcagcattgataaagtcttcagggaatactttgaagtcgagaaagatgagaaattattgaaggctttccagtgttatctttcaaccacagctggtccaatagctggaatgcttttcatctcaactgagaagatagcattccatagtgataggcctctgagtatagcgtgttccaaaggaggcaagacaagggtgccctacaaggtgttgatccccacaaaaaggataaagagtgcttcagtgagagaaaatatgtacaatcctgacgagaagtatattgatgtagttactgttgatggctttgatttttggtttatgggttttattagctacgagaagtccttcagatatcttcagaatgtaatttcggagttgagatgatacacgtagttctgtagtctgaaacatactgcataccatgctgatatggtttatgtatatgtatattaaaacacagaattgataaatcaaattgaattg

SEQ ID NO: 46783 - protein, 214 aa, Panicum virgatum
  misc_feature: Ceres CLONE 2032548
  misc_feature (93)..(171): Pfam Name: GRAM Pfam Description: GRAM domain
MESFAQEHVIGIPLASFAYAQEETKGKPSCSALLNKKNKKGSFIYRMSKLSQKTDSYMQGFKEHLTLGPKFSETIKGKVSFGAKVLQAGSIDKVFREYFEVEKDEKLLKAFQCYLSTTAGPIAGMLFISTEKIAFHSDRPLSIACSKGGKTRVPYKVLIPTKRIKSASVRENMYNPDEKYIDVVTVDGFDFWFMGFISYEKSFRYLQNVISELR

SEQ ID NO: 46784 - DNA, 670 bp, Panicum virgatum
  misc_feature: Ceres CLONE 2032587
  misc_feature: Encodes the peptide sequence at SEQ ID NO. 46785
tatcctcctgctgttggtaattcatttgtctttaagcttcgggaccagaatggacgtatgcatagatttacttgtgggtatgagagtttagatgagttgatatcttctgtaatgcaaagattaggcattggtggtgaaaagagcacagttcaacttttgtatgaggatgatgaaggtgacaaggtgctccttactacagattctgatcttgctggtgctgtgctcaatgccaaatcatctcgattaaaggctttgaagttgcatattgacgactctgattccaaaaacaaagtagcagcacaacaattgtcagagctagaaccatcccacggaattgagttgatggatgttcattatggtctgatggcttgtggaattgctctaacaggagtagccatgatggttttcttgagacactccacagtctaaatttttcaaggggaatgtataattttgtatttatatatacagctaatatgtatagatgggtggcacgccttggctcattgagaaggctaagaatgaagaaaacaagggtcgtcaatggtgcactgagttcatttgtggcccaaaaggaatcagctgactgtcaagttctccaattggctcagtgcagtggtgggaaggaagcctgtacaacttgaatccggtgacatctcgagtaatcttt

SEQ ID NO: 46785 - protein, 142 aa, Panicum virgatum
  misc_feature: Ceres CLONE 2032587
  misc_feature (8)..(92): Pfam Name: PB1 Pfam Description: PB1 domain
YPPAVGNSFVFKLRDQNGRMHRFTCGYESLDELISSVMQRLGIGGEKSTVQLLYEDDEGDKVLLTTDSDLAGAVLNAKSSRLKALKLHIDDSDSKNKVAAQQLSELEPSHGIELMDVHYGLMACGIALTGVAMMVFLRHSTV

SEQ ID NO: 46786 - DNA, 678 bp, Panicum virgatum
  misc_feature: Ceres CLONE 2032646
  misc_feature: Encodes the peptide sequence at SEQ ID NO. 46787
aagagcctcctcccccccccccctttcgaacgccggagcgcgaggaagacgcacgcagagaattggcgcactgcaagaattagaaactgaactgtaagatggcatcagcggagctttcccgtgaggagaatgtgtacatggccaagctcgctgagcaggctgagaggtacgaggagatggttgagttcatggagaaggtagccaagactgttgagctcactgtcgaggagcgcaacctcctttctgttgcgtacaagaatgtcattggagcccgccgtgcttcgtggcgcatcatctcctcgattgagcagaaggaggagggccgaggcaatgaggaccgtgtaacactcatcaaggactaccgtggcaagattgagactgagctcaccaagatctgtgatggcatcctcaagctgctcgagtcccaccttgtgccctcatccactgcccccgagtccaaggtcttctacctcaagatgaagggtgactactacagataccttgctgagttcaagactggggctgagagaaaggatgctgctgagaataccatggtggcatacaaggctgcccaggacattgctttggctgagctacctccaactcaccctattaggcttgggctggcacttaacttctcagtgttctactatgagattctcaactcacctgatcgtg

SEQ ID NO: 46787 - protein, 193 aa, Panicum virgatum
  misc_feature: Ceres CLONE 2032646
  misc_feature (8)..(193): Pfam Name: 14-3-3 Pfam Description: 14-3-3 protein
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: Functional homolog of the protein sequence given in SEQ ID NO 50648
  misc_feature: Useful for making plants with modulated drought sensitivity
  misc_feature: Functional homolog of the protein sequence given in SEQ ID NO 50649
  misc_feature: Useful for making plants with modulated water use efficiency
  misc_feature: The sequence is a functional homolog of SEQ ID NO 809 in the 11/479,226 US patent application
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 404 in the 10/374,780 US patent application
  misc_feature: The sequence is a functional homolog of SEQ ID NO 68 in the 11/375,241 US patent application
  misc_feature: The sequence is a functional homolog of SEQ ID NO 864 in the 10/225,066 US patent application
MASAELSREENVYMAKLAEQAERYEEMVEFMEKVAKTVELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDR

SEQ ID NO: 46788 - DNA, 219 bp, Panicum virgatum
  misc_feature: Ceres CLONE 2032653
  misc_feature: Encodes the peptide sequence at SEQ ID NO. 46789
ccgaggtcacatagcatgcgagaaacgcataccttcaaattctagatattcggtatgaccgcatgtattggtggacttcttgcaaaaatatgtgacaagcatggaatcccctatgaatatggaaaaggccgcttgcaagaccgctctacactcctcctagacatccaaacgattaagccgacacatgtattaactgctgctggcgtaactggcagaccc

SEQ ID NO: 46789 - protein, 54 aa, Panicum virgatum
  misc_feature: Ceres CLONE 2032653
  misc_feature: Functional homolog of the protein sequence given in SEQ ID NO 51125
  misc_feature: Useful for making plants with altered carbohydrate content
  misc_feature: Functional homolog of the protein sequence given in SEQ ID NO 51124
  misc_feature: Useful for making plants with altered cell wall content and/or composition
MTACIGGLLAKICDKHGIPYEYGKGRLQDRSTLLLDIQTIKPTHVLTAAGVTGR

SEQ ID NO: 46790 - DNA, 688 bp, Panicum virgatum
  misc_feature: Ceres CLONE 2032658
  misc_feature: Encodes the peptide sequence at SEQ ID NO. 46791
tacacaggcctgctccctacagattttgatgccttcatatgcaatggtgggagtgatatatattatccttcacagtctagtgatgtgccaagtaattctcttgttacatttgcactggacaatagttaccgatcacatatcgagtatcgttggggaggggagggtttaaggaagtacttggttaagtgggcttcttcagtagtagagagaaggggaagaactgaaaagcaagtcatctttgaagattcggaacactcttcaacatactgtctagcatttagagtggttaatccaaatcatttgcctcctttgaaagagctgcaaaagttgatgagaatccagtcactacgttgtcatgctttgtataaccatggtgctaccaggctatccgtaattccaattcatgcatcacgatctcaggctctaaggtatttgtctattcgctggggcttggagttgccagatgctgttgttatcgttggcgaatccggtgattctgattatgaagaactgtttggaggtcttcacaaggcaatcatccttaagggtggattcaatactcctgcaaataggatccatacggtcagaaggtaccctttacaggatgttgttgctcttgatagctcaaatatcattggaattgagggtttcagcagtggtgacatcaggtctgcaatgcaacagcttg

SEQ ID NO: 46791 - protein, 229 aa, Panicum virgatum
  misc_feature: Ceres CLONE 2032658
  misc_feature: SWISSPROT Homolog: EC 2.4.1.14 Sucrose-phosphate synthase
YTGLLPTDFDAFICNGGSDIYYPSQSSDVPSNSLVTFALDNSYRSHIEYRWGGEGLRKYLVKWASSVVERRGRTEKQVIFEDSEHSSTYCLAFRVVNPNHLPPLKELQKLMRIQSLRCHALYNHGATRLSVIPIHASRSQALRYLSIRWGLELPDAVVIVGESGDSDYEELFGGLHKAIILKGGFNTPANRIHTVRRYPLQDVVALDSSNIIGIEGFSSGDIRSAMQQL

SEQ ID NO: 46792 - DNA, 676 bp, Panicum virgatum
  misc_feature: Ceres CLONE 2032696
  misc_feature: Encodes the peptide sequence at SEQ ID NO. 46793
agcgccctcctctcccgctctccctccgcgctctcggcttccctccaatgccgccacccatggcgctgcccctccccacctccgcctccgcctcggcctccaccacgcacccgcactttcgcccctgccctcccgcaccgctgcgcctcccctccgcccgcgcccgcgcggtctccgccggctacgcggcgtccttctacggcggctcggcgtccgcgaccggcggcgccgaggacgaggagggctccgcctcggggttcggctccgggctggggctcggcggcggcgggctcgggatgtcggcggcgctggcgctggaggagcgggagatgccgccctgcccgccgggcctgcgccagtacgagaccatggtcgtgctgcggcccgacatgtccgaggaggagcgcctcgcgctcatccagcgctacgaggagctgctcgtcgccggcggcgccatgtacgtggaggtcttcaaccggggcgtcatcccactggcatacagcatcaggaagaggaacagccggaccgggctgccgtccacctactacgacggcatttacctcctcgtcacctacttcaccaagcccgactccctgtccaccctgcagcagaggctcaacgccgacgatgacgtcatccggtcgaccagcttcaaggtccgcccgcggaaggcctt

SEQ ID NO: 46793 - protein, 209 aa, Panicum virgatum
  misc_feature: Ceres CLONE 2032696
  misc_feature (103)..(204): Pfam Name: Ribosomal_S6 Pfam Description: Ribosomal protein S6
MPPPMALPLPTSASASASTTHPHFRPCPPAPLRLPSARARAVSAGYAASFYGGSASATGGAEDEEGSASGFGSGLGLGGGGLGMSAALALEEREMPPCPPGLRQYETMVVLRPDMSEEERLALIQRYEELLVAGGAMYVEVFNRGVIPLAYSIRKRNSRTGLPSTYYDGIYLLVTYFTKPDSLSTLQQRLNADDDVIRSTSFKVRPRKA

SEQ ID NO: 46794 - DNA, 763 bp, Panicum virgatum
  misc_feature: Ceres CLONE 2032697
  misc_feature: Encodes the peptide sequence at SEQ ID NO. 46795
tgggcgttacggatgacggtctattcaatttcaagcctagtgtgaggcctgtacctcttgaagtgcatatccagggatatcctgggaaattctactgtccgagaatgaatagcatgaacaaaccagcttatgcagccatatgctctcattcacccaataaacctgttctcatttttgtgtcatcacgtcgacagacaagacttacagcccttgatatcattcagcttgcagcatcagacgaaaaaccaaggcagttcctgagcatggatgacaactccctagacatggttctgtcacaagtttctgatagtaatttgaggcatactctgcagtttggcataggtctgcatcatgcaggtttaaatgacagagacagatccttggttgaggaactcttttcaaacaataggattcaggtactggtatgtaccagcacgttggcgtggggtgtcaatcttccagctcatctggtcataatcaagggcactgaatactatgacggcaaaacaaaaagatacattgattatgatatcacagatattctgcaaatgatgggtcgtgctggtcgaccacaattcgaccaacatggcaaagctgttattctcgtccatgaaccaaaaaagagcttttacaagaagttcctctacgaaccatttcctgtggagagtaatctgagggagcacttgcacgatcacataaatgcagaaattgtttctggcaccatcagcaacaaaggaggaagcgatcatttatctcacttgga

SEQ ID NO: 46795 - protein, 253 aa, Panicum virgatum
  misc_feature: Ceres CLONE 2032697
  misc_feature (105)..(191): Pfam Name: Helicase_C Pfam Description: Helicase conserved C-terminal domain
GVTDDGLFNFKPSVRPVPLEVHIQGYPGKFYCPRMNSMNKPAYAAICSHSPNKPVLIFVSSRRQTRLTALDIIQLAASDEKPRQFLSMDDNSLDMVLSQVSDSNLRHTLQFGIGLHHAGLNDRDRSLVEELFSNNRIQVLVCTSTLAWGVNLPAHLVIIKGTEYYDGKTKRYIDYDITDILQMMGRAGRPQFDQHGKAVILVHEPKKSFYKKFLYEPFPVESNLREHLHDHINAEIVSGTISNKGGSDHLSHL

SEQ ID NO: 46796 - DNA, 713 bp, Panicum virgatum
  misc_feature: Ceres CLONE 2032707
  misc_feature: Encodes the peptide sequence at SEQ ID NO. 46797
agagaagtcctccggccttcgtcgctgacgcgctctcgcgtcgcgcgctatataaccggcagccccgcagccttccgtcgccacggttgcagagccagagcaagacgcgactgcttttgcttcatcagtagcgagcctacgcgttgccgcccatcactttcttggtcgtgtctcatcgatcgggctgagctagctcccggcagcggaagggcaggaagaggacgaggatgagctcggtgtgcgcgaggcccgtgggcgcggggtgctacttcgtcggcggggccaggggcccgcggcggacgcgggtgcgggtggcggcggcggcggcggcggcggtggccgcgccggcgtcgagggcggcgacgatgtacgaggtgctggcggtggaggagacggcggggcccgcggagatcaaggcggcgtaccggcgcgaggcgcggcggtggcacccggacgcgtgccccggcggcgccgaccgcttcatggcggcgcgggaggcctacgaggtgctgtccgacccggagcgcaggcgcggctacgacatccagctccgctgcggcgggttcggtggcgccggcgactctggctaccgcgcggcgcggcgcgcggggttcgccgactgggaggcgcagctggccgggctgcagtggcgcgcggcggagcggcgcggccgcgcgggcggggagacgtggggtagcaggatgcgcccggcc

SEQ ID NO: 46797 - protein, 161 aa, Panicum virgatum
  misc_feature: Ceres CLONE 2032707
  misc_feature (46)..(105): Pfam Name: DnaJ Pfam Description: DnaJ domain
MSSVCARPVGAGCYFVGGARGPRRTRVRVAAAAAAAVAAPASRAATMYEVLAVEETAGPAEIKAAYRREARRWHPDACPGGADRFMAAREAYEVLSDPERRRGYDIQLRCGGFGGAGDSGYRAARRAGFADWEAQLAGLQWRAAERRGRAGGETWGSRMRP

SEQ ID NO: 46798 - DNA, 689 bp, Panicum virgatum
  misc_feature: Ceres CLONE 2032716
  misc_feature: Encodes the peptide sequence at SEQ ID NO. 46799
agcatcagttgtctgtcatctcacaactgaattcacttggagtgtcccctagggtgttttctcactgcctgaaaggttctgacaacggtggtggcattcttgtgcttggtgaaattgtggagccaggcttagtctataccccactggttccatcacagcctcattacaacttgtatctggaaagcatcgctgtcaatggtcaaaagctacccattgattcctccttgtttacaacgtcaaatacacaaggaacaattgtggattcaggaacaacattggcataccttgcagatggagcctatgatccatttgttactgcgatagctggtgcagtctctccatctgtacgctctcttgtcagcaaagggaaccaatgctttcttacttccagcaggggtggtgttgcgatgacggttaagccagagaactatcttttgcagcaggcttcagttgacaacaatgtattgtggtgcattggttggcaaaggaaccagggccaagaaataactatactcggagatcttgtcttaaaagataagatattcgtgtacgacttggcgaacatgcgcatgggctgggctgattacgactgttcgatgtcggtgaacgtcaccacatcgtcagggaagaaccggtacgtgaacactgggcagtacgacgtgaacggctccacgcggcgcgcgtcgtac

SEQ ID NO: 46799 - protein, 228 aa, Panicum virgatum
  misc_feature: Ceres CLONE 2032716
  misc_feature: SWISSPROT Homolog: EC 3.4.23.12 Nepenthesin
HQLSVISQLNSLGVSPRVFSHCLKGSDNGGGILVLGEIVEPGLVYTPLVPSQPHYNLYLESIAVNGQKLPIDSSLFTTSNTQGTIVDSGTTLAYLADGAYDPFVTAIAGAVSPSVRSLVSKGNQCFLTSSRGGVAMTVKPENYLLQQASVDNNVLWCIGWQRNQGQEITILGDLVLKDKIFVYDLANMRMGWADYDCSMSVNVTTSSGKNRYVNTGQYDVNGSTRRAS

SEQ ID NO: 46800 - DNA, 717 bp, Panicum virgatum
  misc_feature: Ceres CLONE 2032723
  misc_feature: Encodes the peptide sequence at SEQ ID NO. 46801
atccatccaaaaaaatccccaatctctcgaaacagttctccgggcgaccgaagcgagtcgaaggagtctctcacgatcctctcaagatgcagatcttcgttaagaccctaactggcaagaccatcacactcgaagttgagtcctcggacaccattgataacgtcaaggctaagatccaggacaaggaaggcattcctcctgaccagcagaggttgatctttgctggcaagcagcttgaggatggccgcaccctcgctgattacaacattcagaaggagtcgaccctccacctagtgctccgtctgcgtggtggtatgcagatttttgtcaagaccctcactggcaagaccattacccttgaggttgagtcctcggatacgatcgacaacgtgaaggctaagatccaggacaaggaaggcatcccccctgaccagcagcgtctcatcttcgctggcaagcagcttgaggatggccgtaccctcgccgactacaacatccagaaggagtcgacccttcacctggtgctccgcctacgtggtggcatgcagatctttgttaagaccctcactggcaagaccatcaccctggaggtggaatcctctgacaccattgacaacgtgaaggcaaagatccaggataaggagggcatccccccaggccagcagcgtctcatctttttgcggcagcagctggaggatggccgcaccctggcggact

SEQ ID NO: 46801 - protein, 210 aa, Panicum virgatum
  misc_feature: Ceres CLONE 2032723
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(210): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50134
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPGQQRLIFLRQQLEDGRTLAD

SEQ ID NO: 46802 - DNA, 731 bp, Panicum virgatum
  misc_feature: Ceres CLONE 2032725
  misc_feature: Encodes the peptide sequence at SEQ ID NO. 46803
aatccctggctcaatggcggcttgctgccgcttacaagctgaattatttgcgctcttttgattctcctccttggaggttatcccctagaaatctcacctgcgagcttctttttctagctaatccagtccgctcggtctctctgcaagcccgcacgtcggctatggcgcaggatgatccggttgtttctgctcagtggctgcacctgcacctaggagcgcctgacgttaaggttttggatgcttcctggtacatgccggtagagaacagggatccatgggaagaataccaggtggcacatatccctggtgcgttgttcttcaacatagatggcatagtcgatcagaaaactgacttaccacacatgttgccatcagaagacgcttttgcagcagcagtttctgcgctggatataaaaaaccaggataaagttattgtttatgatggaaaaggattcttcagtgcacctcgtgtttggtggatgtttagagtttttgggcacaataaagtttgggtgttagatggaggtttacctcagtggcgagcttcagggtttgatcttggaagtgccaaccctgatgatgcagttcttaaatccaaaactgccaataaggctgttgaaagggtttataatggtgaactgacaaatacaatcacattcaagactgaatttcagcctcatctatattggatactggaaaaggtcgtgcataatgttgctgctaagaactac

SEQ ID NO: 46803 - protein, 189 aa, Panicum virgatum
  misc_feature: Ceres CLONE 2032725
  misc_feature (9)..(129): Pfam Name: Rhodanese Pfam Description: Rhodanese-like domain
  misc_feature: SWISSPROT Homolog: EC 2.8.1.1 Thiosulfate sulfurtransferase
MAQDDPVVSAQWLHLHLGAPDVKVLDASWYMPVENRDPWEEYQVAHIPGALFFNIDGIVDQKTDLPHMLPSEDAFAAAVSALDIKNQDKVIVYDGKGFFSAPRVWWMFRVFGHNKVWVLDGGLPQWRASGFDLGSANPDDAVLKSKTANKAVERVYNGELTNTITFKTEFQPHLYWILEKVVHNVAAKN

SEQ ID NO: 46804 - DNA, 668 bp, Panicum virgatum
  misc_feature: Ceres CLONE 2032730
  misc_feature: Encodes the peptide sequence at SEQ ID NO. 46805
agagtcacgatccgttaccactcgcttggcgtgggcagcggcgagaggaggcggaaggacgccgccctactaggtcgccaccgcattcgactcgcgccatggcgaggagggagaagaggaggggtgcaccgccgctagaaggcgacgagcagcggctgcggcggaggcaggaggaggcggggctcctcctcctcaggatcagagggctcgtgcgctgggtcgtcgagggggtcgccaccggccgctccccgtccatcgtgctccaccggtaccggaactactgctcggccgccgacgctgcgtccccatcccattgtgactgcagctacgacgcccccgtcggcacagacgtcctctccctgctccacaaggactgccacacctctcgcctcaatgtgctcctgagggtgcttctcgtggtgcagcagctcctgcagcagaacaagcactgctccaagagggacatctactacatgtacccctccattttcgtagaagtagctgttgttgaccgtgccatcaatgatatctgcatactcttcaagtgcagtcggcacaatctcaatgtggtaggtaccattagtatgcctattttcaggtgctttaactattgcatgtagagaagacctctccgttagcaaagaagtttctccttgctccttttcggt

SEQ ID NO: 46805 - protein, 173 aa, Panicum virgatum
  misc_feature: Ceres CLONE 2032730
  misc_feature (89)..(158): Pfam Name: TP6A_N Pfam Description: Type IIB DNA topoisomerase
MARREKRRGAPPLEGDEQRLRRRQEEAGLLLLRIRGLVRWVVEGVATGRSPSIVLHRYRNYCSAADAASPSHCDCSYDAPVGTDVLSLLHKDCHTSRLNVLLRVLLVVQQLLQQNKHCSKRDIYYMYPSIFVEVAVVDRAINDICILFKCSRHNLNVVGTISMPIFRCFNYCM

SEQ ID NO: 46806 - DNA, 705 bp, Panicum virgatum
  misc_feature: Ceres CLONE 2032748
  misc_feature: Encodes the peptide sequence at SEQ ID NO. 46807
acacgtatgatgttggtttaatacaggtactgtttataaaaaaaaaaacccaccacacggccagccgccgccccggctccctccctcccttatgctcgtttgcctccggcgaggcctctcgctcgtcaggcagcacacaccccggcggccccgcttccttccctcgccgcctctccatcccgcccgccgcttcctgcaccacctctccgccgcccacgggatgggtgagggctccgctgccggaaaggacgccaaggggaaggccaaggccaaggcccccgccgcggcttcggccccggtcgtcgcgcgcgatgactcctacctggaggccgtcacacacaagagggtccgcatgttcgaggacatccaggctaggcaggccgtcgaccggctcaacatcggcggcgaggtcatcaaagtaactctacccgatggcgctatcaaggaagggaagaagtggataacaaccccaatggatatcgctaaggagatatcaagcggattggcagctagctgtttgatagctcaagtggacgacacactctgggatatggggaggccactggaaggtgactgtaaattgcagttgttcaagtttgacagcaatgaagggcgtgacaccttctggcactcaagtgctcatattcttggagagtctattgagagagcatatggctgcaagctgtgtattgggccttgcaccac

SEQ ID NO: 46807 - protein, 204 aa, Panicum virgatum
  misc_feature: Ceres CLONE 2032748
  misc_feature (108)..(168): Pfam Name: TGS Pfam Description: TGS domain
  misc_feature: SWISSPROT Homolog: EC 6.1.1.3 Threonine--tRNA ligase
MLVCLRRGLSLVRQHTPRRPRFLPSPPLHPARRFLHHLSAAHGMGEGSAAGKDAKGKAKAKAPAAASAPVVARDDSYLEAVTHKRVRMFEDIQARQAVDRLNIGGEVIKVTLPDGAIKEGKKWITTPMDIAKEISSGLAASCLIAQVDDTLWDMGRPLEGDCKLQLFKFDSNEGRDTFWHSSAHILGESIERAYGCKLCIGPCT

SEQ ID NO: 46808 - DNA, 647 bp, Panicum virgatum
  misc_feature: Ceres CLONE 2032760
  misc_feature: Encodes the peptide sequence at SEQ ID NO. 46809
tggcgtcgtcgtgtgcgtccaatccaatccgctccccatcgaccacgccgacgcgtacccgtctgctccgctccgctgcgcagctcgctccctcccgccgccgcctcacctcgcgcgccatggcggcgccgctgtacagggacgcgtcggtgccggtggaggcgcgggtgcgggacctgctggcccgcatgacgctgcgggagaaggcggcgcagatgtcccagatcgagcgcggcgtcgcgtcgccgcgcgccctcgcggagctcggcgccggcagcgtcctcaacgccggcgggagcgcgccgcgcgagcgggcctcgcccgccgactgggccgtcatggtcgacggcatgcagcgccacgctctcgcctcccgcctcggcgtccccatcctctacggcaccgacgccgtccacggccacaacaacgtctacggcgccaccgtgttcccccacaacgtcggcctcggcgcaaccagggacgcggagctcgcgcgtaggatcggcgaggcgacggcgctcgaggtacgcgccaccggcatccactggaccttcgcgccctgcgtcgccgtctgtcgggatccgaggtgggggagatgctacgaaagctacagcgaggatccggagattgtacgctcgttgaccacc

SEQ ID NO: 46809 - protein, 175 aa, Panicum virgatum
  misc_feature: Ceres CLONE 2032760
  misc_feature (81)..(175): Pfam Name: Glyco_hydro_3 Pfam Description: Glycosyl hydrolase family 3 N terminal domain
  misc_feature: SWISSPROT Homolog: EC 3.2.1.21 Beta-glucosidase
MAAPLYRDASVPVEARVRDLLARMTLREKAAQMSQIERGVASPRALAELGAGSVLNAGGSAPRERASPADWAVMVDGMQRHALASRLGVPILYGTDAVHGHNNVYGATVFPHNVGLGATRDAELARRIGEATALEVRATGIHWTFAPCVAVCRDPRWGRCYESYSEDPEIVRSLT

SEQ ID NO: 46810 - DNA, 634 bp, Panicum virgatum
  misc_feature: Ceres CLONE 2032761
  misc_feature: Encodes the peptide sequence at SEQ ID NO. 46811
atattcagcagcagcggcagttctaccggtagcagttaaccccacgccacagcaacccacatggcgggcggcgaccacggctcctccgacgcggcggcggagctccggcggggcttcgagaccctcgccgtgacccggccggacccgtccgcgggcttctacgaggtccgtctcaaccgccccgcgcagcgcaacgcgctcagcccggccgccttcgccgagatcccgcgcgccatgtccctcctcgaccgcctccccgccgcgcgcgccgtcgtgctctccgccgcggggccccacttctgcgcgggcatcgagctcggcgggcccgggaacccgctcaccgcggccgccgccgggggcgccgaccccgcggccgcggccgaggggctccgccgcgtgatcttcgggatgcaggaggcgctcacggccatcgagcggtgccggaagcccgtcgtcgccgcggtgcacggcgcttgcatcggaggcggcgtcgacgtcgtcgcggcctgcgacatccgctgctgctccagggacgccacgttcgtgctcaaggaggtggacatggccctcgtcgccgacctcggcgcgctgcagcgcctgccgcggatcgtcggctacgggaacgccgcagacc

SEQ ID NO: 46811 - protein, 191 aa, Panicum virgatum
  misc_feature: Ceres CLONE 2032761
  misc_feature (34)..(191): Pfam Name: ECH Pfam Description: Enoyl-CoA hydratase/isomerase family
  misc_feature (124)..(185): SWISSPROT Homolog: EC 4.2.1.17 Enoyl-CoA hydratase
  misc_feature (18)..(83): SWISSPROT Homolog: EC 5.3.3.8 Dodecenoyl-CoA isomerase
MAGGDHGSSDAAAELRRGFETLAVTRPDPSAGFYEVRLNRPAQRNALSPAAFAEIPRAMSLLDRLPAARAVVLSAAGPHFCAGIELGGPGNPLTAAAAGGADPAAAAEGLRRVIFGMQEALTAIERCRKPVVAAVHGACIGGGVDVVAACDIRCCSRDATFVLKEVDMALVADLGALQRLPRIVGYGNAAD

SEQ ID NO: 46812 - DNA, 3818 bp, Panicum virgatum
  misc_feature: Ceres CLONE 2032791
  misc_feature: Encodes the peptide sequence at SEQ ID NO. 46813
gccggggatgggcgtcgtcctcctgctccagagctcactccgctcgcgctcctccgccacagcagttcaggaggagtgatatccagtggttgagtgcttcaagtatttgagattgaaacagaaaatgtcttcctcaaggcctactcagtgttccagttcatccagcagaactcgccagaactcacgagcaaggatattagcacaaacaacccttgatgctgaactcaatgcagagtatgaagaatctggtgattccttcgattactccaagttggttgaagcgcagcggagtgctccacctgagcagcaagggcgttcagagaaggtcatagcctacttgcagcacattcagagaggaaagctaatccaaccatttggttgcttgttggcccttgatgagaagagcttcagggttattgcattcagtgagaatgctccggaaatgcttacaacagtcagccatgctgtgcctaatgttgatgatcccccaaagctaggaatcggtaccaatgtacgctctcttttcactgacccaggtgccacagcactacagaaggcactaggctttgctgacgtttcattgctgaatcctatcctagttcaatgcaagacctcaggcaagccattctatgccattgttcatagggcaactggttgtctggtagtagattttgagcctgtaaaacctacagaatttactgccactgctgctggggctttgcagtcttataagcttgctgctaaagcaatctccaaaatccagtcactaccaggtgggagcatggaggccttatgcaatactgtggttaaggaaatcttcgaccttacaggttatgacagggtgatggcttacaagttccatgaagatgagcatggggaggtctttgcggagatcacaaaacctggtattgagccttatcttggccttcactatccggccactgatattcctcaagctgcaaggttccttttcatgaagaacaaagtacggatgatttgtgattgtcgtgcaagatctgtgaaaattattgaagatgaagcactctccattgatattagcttgtgtggttcaactcttagagcaccacacagttgtcaccttcagtatatggagaacatgaactcaattgcatcccttgtcatggctgttgtggtcaatgaaaatgaagaggatgatgaacccaatcctgaacaacaatcacagcagcagaagaagaagaggctgtggggtctccttgtttgtcatcatgagagccccagatatgtcccgtttccactgaggtatgcctgtgaattcttagcacaagtgtttgctgtccatgtaaacaaggagttcgaattggagaagcagatacaagagaaaagcattctacgaatgcaaacaatgctctctgacatgctattcagggaagcatctcccttgagtatcatatctgggagtccaaatattatggacctagttagatgtgatggtgctgctcttttgtatgggggcaaagtatggcgtcttcaaacagctccaactgagtctcagatacgtgatattgccttctggctttcagaagttcatagggattccactggcttgagtactgacagcctccaggatgctggatatccaggagctgcctcccttggtgacatgatttgtggaatggcagtggctaagatcacttccaaggatattcttttctggttcaggtcacatacagctgctgaaatcaaatggggaggtgcaaagcatgatccatctgacaaggacgacaacagaaggatgcacccaaggttgtccttcaaggcattcctagaggttgtcaagatgaagagtttgccatggaatgactacgagatggatgctattcactcattgcaacttatacttagaggtacactgaatgaggccacgaagccggcccagacatctggtttagataaccagattggtgatctcaaacttgacgagcttgctgaattgcaggcagtgacaagtgaaatggttcgcctgatggaaactgcaactgttccgatcttagcagtagatggcaatggattggtcaatgggtggaatcaaaaggtagcggcattgacaggattgagagttgatgaggctataggaagacacatacttacacttgtggaagattcttctgtatcaactgttcagaggatgctatacttggctctgcagggcagagaagagaaggaaattcgatttgagttgaagacacatggctccaagagggatgatggccctgttatcttggttgtaaatgcctgtgccagtcgtgaccttcatgaccatgttgttggggtgtgctttgtagcccaggatatgactgttcataagttggtcatggacaaatttactcgtgtggaaggggactacaaggcaatcgttcaaaacccaaacccactcattcctcccatatttggtgctgaccaatttgggtggtgctctgagtggaatgcagccatgaccaagcttaccgggtggcacagagatgaggtgattgataagatgctccttggtgaggtttttgatagcagtaatgcttcctgccttttgaagaacaaagatgcatttgtgcgtctttgcattatcatcaacagtgcattagccggtgatgaggcagaaaaggctccatttggcttcttcgatcgaaatgggaagcacattgagtgtcttctttcagtgaacagaaaagtaaatgcagatggtgttgtcactggagtgttctgtttcattcatgttcctagtgatgagctgcagcatgcactgcatgtgcagcaagcgtcggagcaaacagcagtgagaaggctgaaggctttctcgtacatgcgacatgccatcaacaaacctctgtcaggtatgctttactctaggcaagcgctcaagagcacaggtctgaatgaagagcagatggggcaggtccatgttgcagatagttgtcatcgccagctagacaagatactttccgacttagatcaagataacattactgacaagtcaagttgtttggatttggatatggctgaatttgtgttgcaagatgtggtggtggctgcagtcagtcaagtactgataggttgccagggtaaagggatcagagtttcttgcaacctgccagagagattcatgaagcaaaaagtgtacggggatggtattcgactccagcagatcctctctgacttcctatttgtttcggtgaagttctctcctgttggaggttctgttgatatctcttccaaactgactaagaacagcattggggaaaacctccatctcatagacctggagcttaggatcaagcaccagggaacaggtgttccagcagaaatactatcacaaatgtatgaggaggacaataaggaacagtcagaagagggcttgagccttctagtttctagaaaccttctgaggctcatgaatggtgacattcgtcacatgagggaagctggcatgtcaaccttcatccttaccgcggaacttgcctctgctcctgccgccagtggacattgaagccaacactgcaactagtggtttcaaatgctcattttcagttcattcggaaaaccagatggttcgtggagaatgggaacgctgcagtctgtagggccacaacgcataaataagtttgacttgtatggttgtttgtcgggggaaaaaggtagtacgggcatagtaggctctgtacttctaccctgtttctacctggttatccaactttgtaaatttttttttcctttcagaaacaggaaatcctatcttgtaagtttcaagtttaagttaacatgaataaagcgtcaaatttagctcc

SEQ ID NO: 46813 - protein, 1131 aa, Panicum virgatum
  misc_feature: Ceres CLONE 2032791
  misc_feature (415)..(595): Pfam Name: Phytochrome Pfam Description: Phytochrome region
  misc_feature (70)..(186): Pfam Name: PAS_2 Pfam Description: PAS fold
  misc_feature (752)..(877): Pfam Name: PAS Pfam Description: PAS fold
  misc_feature (622)..(737): Pfam Name: PAS Pfam Description: PAS fold
  misc_feature (219)..(404): Pfam Name: GAF Pfam Description: GAF domain
  misc_feature (1011)..(1123): Pfam Name: HATPase_c Pfam Description: Histidine kinase-, DNA gyrase B-, and HSP90-like ATPase
  misc_feature (897)..(961): Pfam Name: HisKA Pfam Description: His Kinase A (phosphoacceptor) domain
  misc_feature: SWISSPROT Homolog: EC 2.7.11.1 Non-specific serine/threonine protein kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
MSSSRPTQCSSSSSRTRQNSRARILAQTTLDAELNAEYEESGDSFDYSKLVEAQRSAPPEQQGRSEKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFTATAAGALQSYKLAAKAISKIQSLPGGSMEALCNTVVKEIFDLTGYDRVMAYKFHEDEHGEVFAEITKPGIEPYLGLHYPATDIPQAARFLFMKNKVRMICDCRARSVKIIEDEALSIDISLCGSTLRAPHSCHLQYMENMNSIASLVMAVVVNENEEDDEPNPEQQSQQQKKKRLWGLLVCHHESPRYVPFPLRYACEFLAQVFAVHVNKEFELEKQIQEKSILRMQTMLSDMLFREASPLSIISGSPNIMDLVRCDGAALLYGGKVWRLQTAPTESQIRDIAFWLSEVHRDSTGLSTDSLQDAGYPGAASLGDMICGMAVAKITSKDILFWFRSHTAAEIKWGGAKHDPSDKDDNRRMHPRLSFKAFLEVVKMKSLPWNDYEMDAIHSLQLILRGTLNEATKPAQTSGLDNQIGDLKLDELAELQAVTSEMVRLMETATVPILAVDGNGLVNGWNQKVAALTGLRVDEAIGRHILTLVEDSSVSTVQRMLYLALQGREEKEIRFELKTHGSKRDDGPVILVVNACASRDLHDHVVGVCFVAQDMTVHKLVMDKFTRVEGDYKAIVQNPNPLIPPIFGADQFGWCSEWNAAMTKLTGWHRDEVIDKMLLGEVFDSSNASCLLKNKDAFVRLCIIINSALAGDEAEKAPFGFFDRNGKHIECLLSVNRKVNADGVVTGVFCFIHVPSDELQHALHVQQASEQTAVRRLKAFSYMRHAINKPLSGMLYSRQALKSTGLNEEQMGQVHVADSCHRQLDKILSDLDQDNITDKSSCLDLDMAEFVLQDVVVAAVSQVLIGCQGKGIRVSCNLPERFMKQKVYGDGIRLQQILSDFLFVSVKFSPVGGSVDISSKLTKNSIGENLHLIDLELRIKHQGTGVPAEILSQMYEEDNKEQSEEGLSLLVSRNLLRLMNGDIRHMREAGMSTFILTAELASAPAASGH

SEQ ID NO: 46814 - DNA, 681 bp, Panicum virgatum
  misc_feature: Ceres CLONE 2032800
  misc_feature: Encodes the peptide sequence at SEQ ID NO. 46815
ctgctctaaaccacgccggtcgagttagttgatttttctcatccgtatcattgttgatcctcacactgccccgcatggcagatacgatcaaggatgaagttgggtcatttcctccagggaaaaagattgccgttgtgtttgtcataggtggccctggcagtggcaagggcactcagtgttctatgattgtcaaacagtttggcttcacccatctaagcgctggagatcttctgcgtgaggaagctaaatctgatactgaacaaggtacgatgataaagaatctgatgcatgaaggaaagcttgtgccgtccgagctcattgtcaagcttctgttaaaggcaatgcttcaaagtgggaatgacaagttccttgttgacggatttcctcgaaacgaagagaaccgccaagcatatgagagtattattaaaattgaacctgatttcgtactatttattgattgcccaaaagaagagttggagcggcgcattctaaaccgaaatcagggaagagatgatgataacattgacactatcaggaggcggtttgaagttttccaggaatcaactctacctgttgtgcagtactatgagaaaaggaggaagctcagaagggttgacggtgctaaatctgctgatgcagtttttcaagatgtgaaggccatattcactcaactgaacactc

SEQ ID NO: 46815 - protein, 202 aa, Panicum virgatum
  misc_feature: Ceres CLONE 2032800
  misc_feature (23)..(176): Pfam Name: ADK Pfam Description: Adenylate kinase
  misc_feature: SWISSPROT Homolog: EC 2.7.4.3 Adenylate kinase
MADTIKDEVGSFPPGKKIAVVFVIGGPGSGKGTQCSMIVKQFGFTHLSAGDLLREEAKSDTEQGTMIKNLMHEGKLVPSELIVKLLLKAMLQSGNDKFLVDGFPRNEENRQAYESIIKIEPDFVLFIDCPKEELERRILNRNQGRDDDNIDTIRRRFEVFQESTLPVVQYYEKRRKLRRVDGAKSADAVFQDVKAIFTQLNT

SEQ ID NO: 46816 - DNA, 751 bp, Panicum virgatum
  misc_feature: Ceres CLONE 2032827
  misc_feature: Encodes the peptide sequence at SEQ ID NO. 46817
aaaactggccgatccgctccgcgccacccatcggacggacatcggagcgatgcgcgcgggcggcggcgcgagcccccgaccccgacccgcaccactccccgcggccacctccgccactgccacgctactagtacccgccgcctccgtcgccatgcccccgccgcgcctcgcgcaccttctcctcctcccactccgcgccgccgctctccacccgctcgtccctagcccccggcgcccgcttcccaagccgcttcacccgccccttctcctcctcccccgcgccatggccggcgccgcccacgcaggtgtggcggcggtgtcggcggagtacgaggaggtgctcgggtgcctcgggtcgctgataacgcagaaggtgcgcgcggacaccggcaaccgcggaaaccagtgggagctcatggccaagtacgtgcagatactggaactggaggagcccatcgcgcatttgaaggtggttcacgttgccgggaccaaggggaagggttcaacatgcacatttgctgagtcaattcttcggtcatgtggtttccgtactggactgttcacttcacctcatttgatggatgtccgtgaacggtttcgacttgatgggctggacatttcggaagacaagttcataaggtatttctggtggtgctggaacaagctgaaggaaaagactggtgatgatgtaccaatgccagcctactttaggttccttgcactgctagcattcaagatcttttcagatgag

SEQ ID NO: 46817 - protein, 199 aa, Panicum virgatum
  misc_feature: Ceres CLONE 2032827
  misc_feature: SWISSPROT Homolog: EC 6.3.2.17 Tetrahydrofolate synthase
MPPPRLAHLLLLPLRAAALHPLVPSPRRPLPKPLHPPLLLLPRAMAGAAHAGVAAVSAEYEEVLGCLGSLITQKVRADTGNRGNQWELMAKYVQILELEEPIAHLKVVHVAGTKGKGSTCTFAESILRSCGFRTGLFTSPHLMDVRERFRLDGLDISEDKFIRYFWWCWNKLKEKTGDDVPMPAYFRFLALLAFKIFSD

SEQ ID NO: 46818 - DNA, 654 bp, Panicum virgatum
  misc_feature: Ceres CLONE 2032834
  misc_feature: Encodes the peptide sequence at SEQ ID NO. 46819
ctgtcgcgtccttccgcccgaaggaagcgaacgaaagccccccaaaacagccttcaaccgcgtccgcgtccgccttcttctccttcaccgcacacacaggcaggctcccgacgcgcctccgccggccgcgcgcggttgccctgccctctctccgccgctcctccaccggtttctccaaccatgtataataactatgggaaccctcctgggatgcagatgccacagcaaaattctcagcctggccagtttaacaatccattatatggtgcaagctcaggtctaattagatctgggctaggagtatatggggagaagttcttggattctagttcagaattcatgcaaagcaatatcaatagatacttctccaacccgcagtattacttccatgtgaatgatcaatatgtcaggaacaagttgaaagttatattgtttccattctttcacagggggcactggactcggataagtgaacctgttggtgggcgtttgtcctacaaacctccaatctatgatataaatgcaccagatctgtacatccctttcatggcatttggaagcttcatcattcttgcaggttttacattaggtttcatgggaaagttcactccagaagctataaatctacagttttccagggcactcattggatgg

SEQ ID NO: 46819 - protein, 157 aa, Panicum virgatum
  misc_feature: Ceres CLONE 2032834
  misc_feature (34)..(157): Pfam Name: YIF1 Pfam Description: YIF1
MYNNYGNPPGMQMPQQNSQPGQFNNPLYGASSGLIRSGLGVYGEKFLDSSSEFMQSNINRYFSNPQYYFHVNDQYVRNKLKVILFPFFHRGHWTRISEPVGGRLSYKPPIYDINAPDLYIPFMAFGSFIILAGFTLGFMGKFTPEAINLQFSRALIG

SEQ ID NO: 46820 - DNA, 683 bp, Panicum virgatum
  misc_feature: Ceres CLONE 2032836
  misc_feature: Encodes the peptide sequence at SEQ ID NO. 46821
taatttacagggacaatcacagttcgagcaagaggttgctatcttgagtagagtgaggcaccctcaccttgtaactctgttaggagcctgcttggagtcatctacacttgtatatgagttcttaccaaatggaagccttgaagattttcttgtttgtgcagaaaagaggcgcagtctaccctggcagactcgcatccgaattattgctgagatttgttcagcattgacatttctgcacaagaataaaccacaccctgttgttcatggagatctgaaacctgccaacatccttcttgatgttaatttagtcagtaaaattagtgactttggtatctctcgccacctgttgcagtcaagcaccaacaacactaccatgtatcgcaccatgcatcccatgggaacccttcagtacatggacccagaattttttgccacgggagagctgacatgtcaatccgatgtttattcttttgggattgtggtcttgcgccttttgacaggaaagcctcctgatggtataaagaagattgtggaggatgccatgttgaaaggcgacctgaactcagttcttgataccttagcaggagagtggccttacgtatacgcccagcagctagcacaccttgctctcagttgcacagagacaagccggaggtgccgtcctgatctttcagtcgtggtgt

SEQ ID NO: 46821 - protein, 227 aa, Panicum virgatum
  misc_feature: Ceres CLONE 2032836
  misc_feature (1)..(227): Pfam Name: Pkinase_Tyr Pfam Description: Protein tyrosine kinase
  misc_feature: SWISSPROT Homolog: EC 2.7.11.1 Non-specific serine/threonine protein kinase
NLQGQSQFEQEVAILSRVRHPHLVTLLGACLESSTLVYEFLPNGSLEDFLVCAEKRRSLPWQTRIRIIAEICSALTFLHKNKPHPVVHGDLKPANILLDVNLVSKISDFGISRHLLQSSTNNTTMYRTMHPMGTLQYMDPEFFATGELTCQSDVYSFGIVVLRLLTGKPPDGIKKIVEDAMLKGDLNSVLDTLAGEWPYVYAQQLAHLALSCTETSRRCRPDLSVVV

SEQ ID NO: 46822 - DNA, 672 bp, Panicum virgatum
  misc_feature: Ceres CLONE 2032837
  misc_feature: Encodes the peptide sequence at SEQ ID NO. 46823
aagcttttctgtaaagtggcacatcattaaaaatgtacgcaactacaccttccgaagtatcttactgcagaacaatgagtctaagtgtgtgaccagtagccgagatacacaagagatacactacactcctggaacaactatgcttgaactcttcaaatataccagagcagagggatgtgtgcttgatgacttcatggtgcatgaggaggaggaagcaagatgtagacgacaccagaggtttaagctgcgccccggtgctccacattttatacctgaatggcatggccctcatacttcacctgtgctgcccaaatcagatagcatgctgatggacagaattgtcagtgggacaaacaatctgactgacaagctacagaatctcaacttggacaagcattatggttcatggcaagaatttgggaacctgactagcgaagcttccaccacaaacaaacagaaagaaagccattgctatggaaaccaggtccatgagaatcctgtgaaggcaagactatctccaactccaacataccagcctttggcttcagacgtgaaatctgcttcagatggagaacaacaatgctggaagaaggttgagatcatcctaactggaaaaccacaaccagaaactgttgcaagagtctcgttgaagccaccacctgaggagcgtcg

SEQ ID NO: 46823 - protein, 223 aa, Panicum virgatum
  misc_feature: Ceres CLONE 2032837
  misc_feature (1)..(54): Pfam Name: YTH Pfam Description: YT521-B-like family
SFSVKWHIIKNVRNYTFRSILLQNNESKCVTSSRDTQEIHYTPGTTMLELFKYTRAEGCVLDDFMVHEEEEARCRRHQRFKLRPGAPHFIPEWHGPHTSPVLPKSDSMLMDRIVSGTNNLTDKLQNLNLDKHYGSWQEFGNLTSEASTTNKQKESHCYGNQVHENPVKARLSPTPTYQPLASDVKSASDGEQQCWKKVEIILTGKPQPETVARVSLKPPPEER

SEQ ID NO: 46824 - DNA, 616 bp, Panicum virgatum
  misc_feature: Ceres CLONE 2032838
  misc_feature: Encodes the peptide sequence at SEQ ID NO. 46825
aatccatctgcaagtcaagtctcactagtcacacataatcataaaccacctgacacctctggtgttagaagtgcaatggcgaccagcaccatggccctctcctctacagccttcgccgtgcaaggacgacaacttgccatcatctctctttggcgaggcccgcgtgaccatgcgcaagaccccagcgaagcccaagccggctgcctcctggagcccgtggtacagcccagacatcatgctctacctcaggccgctctccgagaagaccccgagctacctgaccggccagttcccctgcgactactgctgggacaccgccgggatctcatccgaccccaaaaccttctgcaaaaacccgaaactggaggtgatccacgcccgctgggccatgctcggcgagctcggctgcttcttcccaaagctgctcgcccgacatggcatcaagatcggcgaggccgtctggttcacggcgggttcgcagatcttcagcgagggctggcttgagaacctcagacacccgagcctgatccactcgcataccatcctcgacatcaggacatgacatgtcgtgctcatgggatccatccaggggtaccgcattgctcgcggcccgctt

SEQ ID NO: 46825 - protein, 130 aa, Panicum virgatum
  misc_feature: Ceres CLONE 2032838
  misc_feature (32)..(125): Pfam Name: Chloroa_b-bind Pfam Description: Chlorophyll A-B binding protein
MRKTPAKPKPAASWSPWYSPDIMLYLRPLSEKTPSYLTGQFPCDYCWDTAGISSDPKTFCKNPKLEVIHARWAMLGELGCFFPKLLARHGIKIGEAVWFTAGSQIFSEGWLENLRHPSLIHSHTILDIRT

SEQ ID NO: 46826 - DNA, 518 bp, Panicum virgatum
  misc_feature: Ceres CLONE 2032848
  misc_feature: Encodes the peptide sequence at SEQ ID NO. 46827
actgaaactgctgaaggctttggctctcatcagacatcttccctgtcctctcccaagcgtcgtcagggcttgtgtgttgtgtgtgtagcagcagctgcaggcttggaaggtagccatgagcttgatcagcatgatggaggcgcggctgcccccggggttccggttccacccgagggacgacgagctcgtgctcgactacctctgccgcaagctctcgggcggtggcggcggcgcgtacggcggcatcgccatggtcgacgtcgacctcaacaagtgcgagccatgggagctgccaggtactttcttgcccaacttgctgccacggcatcagttgcacctctctacaacaagtctagaaccatatgcatcctctctcgaacaaaaaagagccatatgcatcttgcacaaaaggaaatcaatagacagaacagttgcatgaaaattccgggcagaagaggcattcggttagccctgatccaggaaatcatatgctagatattgcccaaattggaaaccgg

SEQ ID NO: 46827 - protein, 107 aa, Panicum virgatum
  misc_feature: Ceres CLONE 2032848
  misc_feature (11)..(107): Pfam Name: NAM Pfam Description: No apical meristem (NAM) protein
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Functional homolog of the protein sequence given in SEQ ID NO 51050
  misc_feature: Useful for making plants with altered lignin content
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
MSLISMMEARLPPGFRFHPRDDELVLDYLCRKLSGGGGGAYGGIAMVDVDLNKCEPWELPGTFLPNLLPRHQLHLSTTSLEPYASSLEQKRAICILHKRKSIDRTVA

SEQ ID NO: 46828 - DNA, 692 bp, Panicum virgatum
  misc_feature: Ceres CLONE 2032865
  misc_feature: Encodes the peptide sequence at SEQ ID NO. 46829
ttttactggagcatcatgcagatgtgaacaaggtctcagcaagggattgtacacccctggctgaaactcttcttgccattccggaaagaatgaatgaatcaactcgcttgaagtgcatgaaactccttgtcaaggctggtgctgatttgaattctagacatccacaaactccattggtgatagcaactttgaagggcttaacagaatgtgttgaatacttgttggaggccggagcagatgctaatattcctgctattgatgttggtagcaaacccattgaacttgctgcggaatctggaagaagaaagcttgtggaggtcttatttcctttcacttcacctattcaggctgtgtcaaactggagtgtcgaaggaataattgctcatgcaaaatcaattaactcaaaggacaaggttgatcaacgtgataataaagatagcaaggtccatctgaatttacatgatgaaaaagcaatcaagcatgatgctgtttcatctaaacctcttgaggataagtcaagtgacaaggatagaaaggcccagctaaaattacaaggtggaaaagcagtcgaggtcaaggattatgccagtgcactcaagttttacagtgaggcgatcaatctggatcctaaagatgctgtcctgtattccacaggagcttctgccatgtaaaacttggggaagctttttgag

SEQ ID NO: 46829 - protein, 222 aa, Panicum virgatum
  misc_feature: Ceres CLONE 2032865
  misc_feature (53)..(85): Pfam Name: Ank Pfam Description: Ankyrin repeat
  misc_feature: The sequence is a functional homolog of SEQ ID NO 1843 in the 10/374,780 US patent application
LLEHHADVNKVSARDCTPLAETLLAIPERMNESTRLKCMKLLVKAGADLNSRHPQTPLVIATLKGLTECVEYLLEAGADANIPAIDVGSKPIELAAESGRRKLVEVLFPFTSPIQAVSNWSVEGIIAHAKSINSKDKVDQRDNKDSKVHLNLHDEKAIKHDAVSSKPLEDKSSDKDRKAQLKLQGGKAVEVKDYASALKFYSEAINLDPKDAVLYSTGASAM

SEQ ID NO: 46830 - DNA, 640 bp, Panicum virgatum
  misc_feature: Ceres CLONE 2032867
  misc_feature: Encodes the peptide sequence at SEQ ID NO. 46831
atcctcttgtatgttcagcctggcgccaagcttccggccgctgcccttcgggaggatgtttgatgtgggtaggaattgatagaaagcagctgatagcctggtgctatatagcagtataaacagtatctgagcgagcggccaagcaatggagccaacagttatagagtatcaagaattaaaacaaattacagatggattctccgagaatcgaaaaatcggtgaaggcggatatggaaaagtttattgggggttacgtgaaaatggagatgagattgccgtgaagatgctccgagataatattcgtttagatgataagcaattccagaatgagtttggccaccatttcgagctcaagcatgataacattgtccgactagttggcttctgccatgagtccaaaggtgatgccataatgcaccaagggaattttgttcttgcagagaaacgatatagagctttgtgcttcgagtatatgcacaatgggagccttcaaaagtatatatctgatgaatgtgataaacttgactggcataccagttacaaaataattaaggggacttgtgagggtttgaaatacctccacgaaagatccaaacctattttgcatttagatctgaaacccgacaatatattgcttgac

SEQ ID NO: 46831 - protein, 164 aa, Panicum virgatum
  misc_feature: Ceres CLONE 2032867
  misc_feature (18)..(163): Pfam Name: Pkinase_Tyr Pfam Description: Protein tyrosine kinase
  misc_feature: SWISSPROT Homolog: EC 2.7.11.1 Non-specific serine/threonine protein kinase
MEPTVIEYQELKQITDGFSENRKIGEGGYGKVYWGLRENGDEIAVKMLRDNIRLDDKQFQNEFGHHFELKHDNIVRLVGFCHESKGDAIMHQGNFVLAEKRYRALCFEYMHNGSLQKYISDECDKLDWHTSYKIIKGTCEGLKYLHERSKPILHLDLKPDNILL

SEQ ID NO: 46832 - DNA, 677 bp, Panicum virgatum
  misc_feature: Ceres CLONE 2032870
  misc_feature: Encodes the peptide sequence at SEQ ID NO. 46833
gacaagccgcagcagcagtagcagccgcagtccggcagcggaaccgcggaaggaaggagcgagtcggggagggcgggttggtgaggtggtgggaacgcgcgcggcgggagcgggggcgaggatggccgcggcctcggggaggaaggtggcggtcgccgccgtgcagttcgcctgcaccgacgtcgaggccgagaacgtcgccaccgccgagaggttgattagggaagcgcacaagaaaggtgcgaagattgtactcattcaggaattgtttgaggggcactatttctgtcaagctcaaaggatggatttctttcgtcgtgctaagccttataaaggcaacccaactatcgcaaggatgcaacagcttgcaaaggagttggaagttgtgatacctgtcagtttttttgaagaagcaaacaatgcccattacaattcagtggcaatcattgatgctgatggtactgatcttggcctctatcgcaaatcacacattccagatggaccaggttatcaagagaaattttatttcaaccccggtgacactggctttaaggctttcaaaaccaagtatgcgacgattggtgttggaatctgctgggatcagtggttcccggagtgtgcaagagcaatggctcttcagggggccgaaatactattctatcccactgcaattggat

SEQ ID NO: 46833 - protein, 185 aa, Panicum virgatum
  misc_feature: Ceres CLONE 2032870
  misc_feature (10)..(183): Pfam Name: CN_hydrolase Pfam Description: Carbon-nitrogen hydrolase
  misc_feature: SWISSPROT Homolog: EC 3.5.1.53 N-carbamoylputrescine amidase
MAAASGRKVAVAAVQFACTDVEAENVATAERLIREAHKKGAKIVLIQELFEGHYFCQAQRMDFFRRAKPYKGNPTIARMQQLAKELEVVIPVSFFEEANNAHYNSVAIIDADGTDLGLYRKSHIPDGPGYQEKFYFNPGDTGFKAFKTKYATIGVGICWDQWFPECARAMALQGAEILFYPTAIG

SEQ ID NO: 46834 - DNA, 622 bp, Panicum virgatum
  misc_feature: Ceres CLONE 2032884
  misc_feature: Encodes the peptide sequence at SEQ ID NO. 46835
acgccacgacggcctctgactgagggccggcaagaaaactctgttggcagcaccgcagcaggcgcaagcgcaacgcgagcaatggcgtcgagctcgagcctggatttggcgatggcccccggcgtcctcctccaccgccgcgtggtcacgcacgcctctttcatccggggaaggggaaggggcgcgagcgggaggaggagcagcagcaatctggccctctccgcttcctcctccaacggtgcagcagttccatccttgacaagtgactcagataagaagggccctgtgatcatggaaattccactggacaagatccgaaggccactgatgcgaacacgtgccaatgatccagccaaggtgcaagagctcatggacagtattcgtgtcattggcctccaagtacctgtgggtatctatattaatttcttttcctctcaaattacttgatccagaagtacagttattggttagtcctgatcttgttagataggattctatcagattcgaactctcttattgggaattcagtatcaacagtaactcaactctgtgctaatgcatatacctgttccatacttccaccttagtgaattcaatgaatcgcaaagaaagctttgaacac

SEQ ID NO: 46835 - protein, 121 aa, Panicum virgatum
  misc_feature: Ceres CLONE 2032884
  misc_feature: Functional homolog of the protein sequence given in SEQ ID NO 51725
  misc_feature: Useful for making plants with altered alkaloid content
MASSSSLDLAMAPGVLLHRRVVTHASFIRGRGRGASGRRSSSNLALSASSSNGAAVPSLTSDSDKKGPVIMEIPLDKIRRPLMRTRANDPAKVQELMDSIRVIGLQVPVGIYINFFSSQIT

SEQ ID NO: 46836 - DNA, 774 bp, Panicum virgatum
  misc_feature: Ceres CLONE 2032898
  misc_feature: Encodes the peptide sequence at SEQ ID NO. 46837
gcagtcacagctagagcagctagcctttgctgggagaggaattgaaggggcgaggcgagggagaggagaggagaggacgatggcggaggccgaggaggcggcgctgcagttcacgccgacgtggatcgtggcggcggtctgctcgatcatcgtgctcatctccctcgccgccgagcgtggcctccatcacctcggcaagacgctcaagaagaacgatcagaggtcgctctacgaggcgctcctcaaggtcaaagaagagctgatgctgctggggttcatctccctgctgatgacggtgctccaggggacgatccagcggacgtgcatccctcccagctggacggactacatgctgccgtgccagaaggcggggggcgatcaccagcagcctgcgggggtcgccgcgcgtttcagcgccgccgatatcctcgccgggatcagcagggcacgggtgctcagcgagggtggggctggagccgaggccgggctctgccagaaggagggaaaagttccactgctgtcggaagaagccttgcaccagctgcacatcttcatatttgttctggctgtggcgcatgtcttcttcagtgctacgactatgcttctgggaggtgcaaagatacacaaatggaaacagtgggaggaggaaattcagcaaaacaatgatgcaggaaacggacctaagaaggtgctacctatgcatcaagttttcttcgttagggagcattacaaggggatgggcaaagattctatgacattgtcttggctgcaatc

SEQ ID NO: 46837 - protein, 231 aa, Panicum virgatum
  misc_feature: Ceres CLONE 2032898
  misc_feature (4)..(231): Pfam Name: Mlo Pfam Description: Mlo family
MAEAEEAALQFTPTWIVAAVCSIIVLISLAAERGLHHLGKTLKKNDQRSLYEALLKVKEELMLLGFISLLMTVLQGTIQRTCIPPSWTDYMLPCQKAGGDHQQPAGVAARFSAADILAGISRARVLSEGGAGAEAGLCQKEGKVPLLSEEALHQLHIFIFVLAVAHVFFSATTMLLGGAKIHKWKQWEEEIQQNNDAGNGPKKVLPMHQVFFVREHYKGMGKDSMTLSWLQ

SEQ ID NO: 46838 - DNA, 751 bp, Panicum virgatum
  misc_feature: Ceres CLONE 2032901
  misc_feature: Encodes the peptide sequence at SEQ ID NO. 46839
aaacacgagctcctcctcctcccagaaagaccgagaggaagggttccgctctactcttccccgacaccactccgccaccgccgcatcccccaactcccgcaagatccgccgggtgcccgggctgtcgatttctcgggaggaggaggggttaacctttgtggggggaaacaatgtactttgagggctatggctaccatggaaacactttcgagcagacatatcgctgctacccagcatctttcattgacaagccacaacttgaggctggtgacaaaattattatgccaccatcggctcttgattgtctcgcatctctgcatattgagtatcctatgctttttgaagtccacaatacggcagcagaacggacttcacattgtggtgttctggagttcattgcagaagaaggcatgatctatatgccatattggatgatgcaaaatcttcttctgcaagagggagatatggtgttcataaaaaatgcgaacctccccaagggcaaatatgtcaagttgcagcctcatacaacagactttttggatatctcaaaccccaaagcaatcttggagaaaactttgaggaacttttcttgtctaaccacaggtgacagcattatggtagcttataataacaagaagtactacattgatatagtggagacaaaacctttcaatgctatcagtattatcgagactgattgtgaggttgactttgctcccacacttgactataaagagcctgagtcagtaaa

SEQ ID NO: 46839 - protein, 193 aa, Panicum virgatum
  misc_feature: Ceres CLONE 2032901
  misc_feature (10)..(184): Pfam Name: UFD1 Pfam Description: Ubiquitin fusion degradation protein UFD1
MYFEGYGYHGNTFEQTYRCYPASFIDKPQLEAGDKIIMPPSALDCLASLHIEYPMLFEVHNTAAERTSHCGVLEFIAEEGMIYMPYWMMQNLLLQEGDMVFIKNANLPKGKYVKLQPHTTDFLDISNPKAILEKTLRNFSCLTTGDSIMVAYNNKKYYIDIVETKPFNAISIIETDCEVDFAPTLDYKEPESV

SEQ ID NO: 46840 - DNA, 730 bp, Panicum virgatum
  misc_feature: Ceres CLONE 2032917
  misc_feature: Encodes the peptide sequence at SEQ ID NO. 46841
aaagccaaaaacacaagcccggacacccatctgcaccctgcattccatataacacagcaagcttgagagacgccggcctgaccagtggccacctgcctctctctgcctgtgccgtgtctctgttcgtgtgagctagcgttccttcccctctcggcagtcggcctacaacaacacacatgaaggaccgccgaggcagctccggcggcggcgaccgcttcgccgtcttccccttctccatgggctgcatgtcgcagtccgccgtctccgtcgccgaccccaccgagaagaagccgcagggcgacccctcttcctcctcctcggccaccgccacgaccacggcacagacagcagcagcaggttcgtcagaagatggtgccggcgagaccgcgaaggagaaggctgccgtcgccgcggccgcgccgggcctcgtggcggccggggtgtccaggctgatgaaggggatcaggagcctgtccctgatgttcgccggcgacgacgaagaggaggaggagagggagatggtgatcgggtacccgacggacgtgcagcacgtggggcacatcggctgggacggccacaacaaggtcggcgccatgggcatggtgaacgccttctccctgccctcctccctctccctccgccagctcgagatggccatggaccaggcggcgcacgcgtcggcctgatgatcatcggctgccacagtggtggtggcggtagcagtaaaaat

SEQ ID NO: 46841 - protein, 169 aa, Panicum virgatum
  misc_feature: Ceres CLONE 2032917
  misc_feature (116)..(159): Pfam Name: PBD Pfam Description: P21-Rho-binding domain
MKDRRGSSGGGDRFAVFPFSMGCMSQSAVSVADPTEKKPQGDPSSSSSATATTTAQTAAAGSSEDGAGETAKEKAAVAAAAPGLVAAGVSRLMKGIRSLSLMFAGDDEEEEEREMVIGYPTDVQHVGHIGWDGHNKVGAMGMVNAFSLPSSLSLRQLEMAMDQAAHASA

SEQ ID NO: 46842 - DNA, 712 bp, Panicum virgatum
  misc_feature: Ceres CLONE 2032921
  misc_feature: Encodes the peptide sequence at SEQ ID NO. 46843
aaccgaggagaccgacccacccaaccagtgcggcggcggcggccatgatcggcgggcaggcggcggacagccagccgccgtcggcgtcggcgtcctgctcctcctcgtcctcgtcctcgccgtcgggcccggcggccggggccggcgcccgcctccaccgcagcaagaggcggcccgacatcctcaacatgctcatgaccgcagcatgtctcagtacatcatcatctgatactggaaaaggacaaagtaagttgtcaagcaacaaagtaacacacggatttcacttagtggaaggaagatctggccatgacatggaagactaccatgtagcagagtacagatatgaaaatgatcacgaacttggtctgtttgccatttatgatggccatttgggagatagcgtggccagttatttgaaagctaatctttttaacaacatactgaaagagcctctcttctggtcggaccctcaagaagccattaaaaatgcatacagctctacaaacaaatatattctggaaaattctaaacaactaggaccaggaggttcaacagcagttactgctattgtagttgatggtaaagatttgtggatagcaaatataggtgattcaagagctgttgtgtgtgaaagaggtactgccaatcagcttactgttgatcatgaaccccatacaattaatgaacgaaaaaaggatgaaaagcaaggtgt

SEQ ID NO: 46843 - protein, 222 aa, Panicum virgatum
  misc_feature: Ceres CLONE 2032921
  misc_feature: SWISSPROT Homolog: EC 3.1.3.16 Phosphoprotein phosphatase
MIGGQAADSQPPSASASCSSSSSSSPSGPAAGAGARLHRSKRRPDILNMLMTAACLSTSSSDTGKGQSKLSSNKVTHGFHLVEGRSGHDMEDYHVAEYRYENDHELGLFAIYDGHLGDSVASYLKANLFNNILKEPLFWSDPQEAIKNAYSSTNKYILENSKQLGPGGSTAVTAIVVDGKDLWIANIGDSRAVVCERGTANQLTVDHEPHTINERKKDEKQG

SEQ ID NO: 46844 - DNA, 678 bp, Panicum virgatum
  misc_feature: Ceres CLONE 2032922
  misc_feature: Encodes the peptide sequence at SEQ ID NO. 46845
gcatgggtttagattcatggagccgattacatcgaagattccactgatggtgatagaggggaaccatgagattgaaccacaggggcatgggggcgaagtgacgtttgcatcatacttggcgcgattcgctgttccatccgaggagtctggatccaacaccaaattttactactccttcaacgctggtggcattcattttatcatgcttggtgcgtacgtggactacaaccgcacaggagctcagtactcatggttggataaggatttgcagagggttgatcgcagagttaccccttgggttgtcgctgcttggcattcaccttggtataacagctattcttctcactaccaggaattcgagtgcatgaggcaagaaatggaagatctcttgtaccgacatcgagttgacatagtattctcaggacatgtacatgcgtatgaaaggatgaatcgagtgttcaactacacattggatccctgtggcccactttacatcaccattggagatggcgggaacattgagaaaattgatattgatcatgcagatgaccctgggaagtgcccctcaccgggtgataaccaccctgaatttggtggggtctgccatctgaacttcacttctggtcccgccaagggaaaattttgttgggaccgacagccagaatggagtgcgtacag

SEQ ID NO: 46845 - protein, 225 aa, Panicum virgatum
  misc_feature: Ceres CLONE 2032922
  misc_feature: SWISSPROT Homolog: EC 3.1.3.2 Acid phosphatase
HGFRFMEPITSKIPLMVIEGNHEIEPQGHGGEVTFASYLARFAVPSEESGSNTKFYYSFNAGGIHFIMLGAYVDYNRTGAQYSWLDKDLQRVDRRVTPWVVAAWHSPWYNSYSSHYQEFECMRQEMEDLLYRHRVDIVFSGHVHAYERMNRVFNYTLDPCGPLYITIGDGGNIEKIDIDHADDPGKCPSPGDNHPEFGGVCHLNFTSGPAKGKFCWDRQPEWSAY

SEQ ID NO: 46846 - DNA, 702 bp, Panicum virgatum
  misc_feature: Ceres CLONE 2032943
  misc_feature: Encodes the peptide sequence at SEQ ID NO. 46847
tcagaggtcttgcaaggagtttcttcggactcgacacagaagttcagtgatactcaaaaggggccatcagaaatttctcaagatggatcgaaggctaagaaggtacggggccgacctaaaaagaaaacctatgactgggacagtttacgaaaagaagtgctttccaatggtgagaataaacgacaaaatcataatgcaagggatactgttgattgggaggctgttagacaagcagaagtgcgagaaatctctgaaactatcagagaaagaggaatgaacaacatgcttgcagaacggataaaggaattcctggaccgattggtgacagatcatggaagcattgatcttgaatggttaagagacgttcaaccggacaaagcaaaggactaccttctaagcattagagggcttggactcaaaagtgttgagtgcgttcgtctactgactctgcatcatatggcttttccagtggacaccaatgttggtcggatatgcgtgaggcttggatgggtgccacttcaacccctgccagagtctcttcagttgcacctattggaaatgtatcccatgctcgagcacatacagaaatacctttggcctcgactatgcaagttagatcaacggacattgtatgagcttcactaccaaatgattacttttggaaaggttttctgcacaaaaagcaaaccaaattgcaattca

SEQ ID NO: 46847 - protein, 233 aa, Panicum virgatum
  misc_feature: Ceres CLONE 2032943
  misc_feature (50)..(190): Pfam Name: HhH-GPD Pfam Description: HhH-GPD superfamily base excision DNA repair protein
  misc_feature: SWISSPROT Homolog: EC 4.2.99.18 DNA-(apurinic or apyrimidinic site) lyase
  misc_feature: Functional homolog of the protein sequence given in SEQ ID NO 51390
  misc_feature: Useful for making plants with modulated endosperm cell number
  misc_feature: Useful for making plants with modulated endosperm cell size
  misc_feature: Useful for making plants with modulated seed quality
SEVLQGVSSDSTQKFSDTQKGPSEISQDGSKAKKVRGRPKKKTYDWDSLRKEVLSNGENKRQNHNARDTVDWEAVRQAEVREISETIRERGMNNMLAERIKEFLDRLVTDHGSIDLEWLRDVQPDKAKDYLLSIRGLGLKSVECVRLLTLHHMAFPVDTNVGRICVRLGWVPLQPLPESLQLHLLEMYPMLEHIQKYLWPRLCKLDQRTLYELHYQMITFGKVFCTKSKPNCN

SEQ ID NO: 46848 - DNA, 700 bp, Panicum virgatum
  misc_feature: Ceres CLONE 2032945
  misc_feature: Encodes the peptide sequence at SEQ ID NO. 46849
aaaccaaaataatcaaaggaacaatggcacctttcctcctcttggccttcctcctgctactatcctcagcatctgttcatgctcaacaaaacatcaccttgggctcctccttaacaccccaagggcctaacagattttggctctcaccatccggtgacttcgcgttcggcttcaggccaatcgatggcaacacctcctcctacctgctcgccatctggtttaacaggatcagcagcaagacagtggcttggtatgccaagaccattgatcaagatgcagcgctggtgcaagtttcatccggttcacggcttcagctcaccaccagagggatattgtcactccaggactccactggcacagaggtatggaaaccccaagttgtggatgcagcctatgctattatgctcgatactggaaactttgtactggctgctgcagacggctctaccaagtgggagagcttcaaaaaccctatagataccatccttcttactcaggtgctcacccctggaatgatgctccgcagccagatcatccccaaatactactccaatggtcggttcctcctcagcctgaaaaatgatggtgttttcttttattatattgctgtgccatccggtcaccaatatgactactattggtccatacctcagaacaggacaaatatggtgttcaatgcaacaagtatcattagtagcgg

SEQ ID NO: 46849 - protein, 225 aa, Panicum virgatum
  misc_feature: Ceres CLONE 2032945
  misc_feature (71)..(179): Pfam Name: B_lectin Pfam Description: D-mannose binding lectin
MAPFLLLAFLLLLSSASVHAQQNITLGSSLTPQGPNRFWLSPSGDFAFGFRPIDGNTSSYLLAIWFNRISSKTVAWYAKTIDQDAALVQVSSGSRLQLTTRGILSLQDSTGTEVWKPQVVDAAYAIMLDTGNFVLAAADGSTKWESFKNPIDTILLTQVLTPGMMLRSQIIPKYYSNGRFLLSLKNDGVFFYYIAVPSGHQYDYYWSIPQNRTNMVFNATSIISS

SEQ ID NO: 46850 - DNA, 740 bp, Panicum virgatum
  misc_feature: Ceres CLONE 2032953
  misc_feature: Encodes the peptide sequence at SEQ ID NO. 46851
ttttctttctaaactcatgtcaagtggtgcctatctgtaccggtccatcttgtgtcttatgcattgtaaactgctttgttcactgctgtttgtgtactgataagctgttgcgattgtcaaaaaaaaccacgactccctgcccttccccttcccccatccgctcatcgcctccgggtttgcgctcccacagcctcgtgtgccttcgcctcggccgatccgcgtcgccgttgtttctcgcgaggatggagcagaccttcatcatgatcaagcccgacggcgtccagcggggcctgatcggggacatcatcagtcggttcgagaagaaagggttctacctcaaggggatgaagtttatgaatgtggagaagtcctttgcacagcagcactacgctgacctttctgacaagcccttttttcccgggttggtggagtacatcatttctggacctgttgtcgcaatggtgtgggaggggaaggacgttgtgttgactggccgcaggatcattggggctaccaggccttgggaggctgcccctggcaccatccgtggtgactatgccgttgaagttggcaggaatgtcatccatggaagtgactccgtggaaaatggaaagaaggagattgctctttggttccctgaaggtgtggcagagtggagaagcaaccttcatccctggatctatgaggcttaagattctagatactggaagtgtggtttcctttaaaattgagttttgcct

SEQ ID NO: 46851 - protein, 149 aa, Panicum virgatum
  misc_feature: Ceres CLONE 2032953
  misc_feature (2)..(135): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVEKSFAQQHYADLSDKPFFPGLVEYIISGPVVAMVWEGKDVVLTGRRIIGATRPWEAAPGTIRGDYAVEVGRNVIHGSDSVENGKKEIALWFPEGVAEWRSNLHPWIYEA

SEQ ID NO: 46852 - DNA, 713 bp, Panicum virgatum
  misc_feature: Ceres CLONE 2032956
  misc_feature: Encodes the peptide sequence at SEQ ID NO. 46853
ggcgcccccaaccaccgcaaacgcgggggaagggagagccattcgtttcttgccaccttgttccacttctccctgtttcttcttccttgttcactgatgttttgtcctcacctagaggcaattaatagatcacctgccagggttcagcggctcgagctcacgccatagctgagagggagaagtgccagtgcggatctatttgaatctcctcaaactgagcttgatctgtctctagtcctgtccagccaagaataatccctttgcgcggcatcacttcgcttcttcgggcgtgattctttgtcagagtacaactatggaaccagaggaaataacctttcaatcattaagagaaatgacagatagtttctctgaggagcgaaaacttggccgtggtgcatatggagttgtttacatgggagtgagtaaaaacggaaagaaggttgctgtgaagaagctttacgacgccaacccagaacttaacgataagcagttccaaaatgagtttaacaacctcaagatgcttaggcataaaaatattgtacagattattggctattgctatgaaacagaacaagagcatgcagagcacaacggcagaatagtactagccgataagacatatagagcattctgcttggagtacatggacaatgggagccttcaagaatatatttctgatgaccttcacacacttaactggcaaacacgattca

SEQ ID NO: 46853 - protein, 133 aa, Panicum virgatum
  misc_feature: Ceres CLONE 2032956
  misc_feature (18)..(133): Pfam Name: Pkinase_Tyr Pfam Description: Protein tyrosine kinase
  misc_feature: SWISSPROT Homolog: EC 2.7.11.1 Non-specific serine/threonine protein kinase
MEPEEITFQSLREMTDSFSEERKLGRGAYGVVYMGVSKNGKKVAVKKLYDANPELNDKQFQNEFNNLKMLRHKNIVQIIGYCYETEQEHAEHNGRIVLADKTYRAFCLEYMDNGSLQEYISDDLHTLNWQTRF

SEQ ID NO: 46854 - DNA, 672 bp, Panicum virgatum
  misc_feature: Ceres CLONE 2032976
  misc_feature: Encodes the peptide sequence at SEQ ID NO. 46855
ctcggctcctccgatcatcacgagtcaacaactcaacgcgaggctctcgtctcgttgtcaagcaggtcacacgcctcgtacggtgtaggtgtaggggctgcgcataaacctccagccaaagccccaaactcatacgcacatcggcgcatgttcctgcaggggcgcggcgtcggcagcaacatggtcggcgacgtcgccacgcacgggcttccgtccggcgccgcgtccgtggcggcgtgcatggacacgtccctctccctgggcggcgctgccgcggcgaacggccagtacctccccctcaacgagaacgactccctcgacatgctcctcttcgacgtgctccgcgaggcccccgcgtccgccaccgtgtccgccatcgccatctcgacgccgccctcgtcgtcgccgctgcccccgcacaaggcgatcgcccccgtccccgcgcgcaagggcggcggcgacagcagcaggggcgcgtgctcggcgaggcggcactaccgcggcgtgaggcggcggccgtggggcaagtacgccgcggagatccgcgacccggcgcggcacggcgcgcggctctggctcggcaccttcggcacggcggaggaggccgccgcggcgtacgaccgcgccgcgctgcgcttgcggggtgccaaggcgctgctcaacttccccgcg

SEQ ID NO: 46855 - protein, 174 aa, Panicum virgatum
  misc_feature: Ceres CLONE 2032976
  misc_feature (115)..(167): Pfam Name: AP2 Pfam Description: AP2 domain
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
  misc_feature: The sequence is a functional homolog of SEQ ID NO 503 in the 10/374,780 US patent application
  misc_feature: Functional homolog of the protein sequence given in SEQ ID NO 51225
  misc_feature: Useful for making plants with altered cell wall content and/or composition
  misc_feature: Useful for making plants with altered lignin content
  misc_feature: Functional homolog of the protein sequence given in SEQ ID NO 50251
  misc_feature: Useful for making plants with altered oil content
  misc_feature: Functional homolog of the protein sequence given in SEQ ID NO 51224
  misc_feature: Useful for making plants with altered alkaloid content
MFLQGRGVGSNMVGDVATHGLPSGAASVAACMDTSLSLGGAAAANGQYLPLNENDSLDMLLFDVLREAPASATVSAIAISTPPSSSPLPPHKAIAPVPARKGGGDSSRGACSARRHYRGVRRRPWGKYAAEIRDPARHGARLWLGTFGTAEEAAAAYDRAALRLRGAKALLNFP

SEQ ID NO: 46856 - DNA, 681 bp, Panicum virgatum
  misc_feature: Ceres CLONE 2032994
  misc_feature: Encodes the peptide sequence at SEQ ID NO. 46857
tcctccccccccccccccccccctcgcgtctctctcgcccacacgcggagcggcagccgcagccgcgggagccccacccgcccacgccgccggccatgtcggtggagacggagcggagctccaccgagtcctccgccgcctcgggcctcgacttcgaggacaccgcgctcacgctcaccctccgcctcccgggctccgcgtcctcgtcctcgtcctcgtcctcctccgccttccccgaccccgaccgcaagcgcgcctcctccgacgccgacgccgcccgctcctccccgctcgccgccgcgtcctccgatgctcccccggcacccaaggcgcgggtggtggggtggccgccggtgaggtcgtaccgcaagaacgcgctcgccgacgtcgcgggctccagcaaggccaagcaggccgccaagttcgtcaaggtggccgtcgacggcgcgccctacctgcggaaggtggacctcgaggcctacgccggctacgaccagctcctccgcgcgctccaggacaagttcttctcccatttcaccatccggaagttcgccgacgacgagaggaagctggtggacgcagtgaacgggacggagtacgtgcccacgtacgaggacaaggacggcgactggatgctcgtcggcgacgtcccctggaagatgtttgtggaaaactgccagc

SEQ ID NO: 46857 - protein, 195 aa, Panicum virgatum
  misc_feature: Ceres CLONE 2032994
  misc_feature (18)..(195): Pfam Name: AUX_IAA Pfam Description: AUX/IAA family
  misc_feature: The sequence is a functional homolog of SEQ ID NO 738 in the 10/374,780 US patent application
  misc_feature: The sequence is a functional homolog of SEQ ID NO 736 in the 10/374,780 US patent application
MSVETERSSTESSAASGLDFEDTALTLTLRLPGSASSSSSSSSSAFPDPDRKRASSDADAARSSPLAAASSDAPPAPKARVVGWPPVRSYRKNALADVAGSSKAKQAAKFVKVAVDGAPYLRKVDLEAYAGYDQLLRALQDKFFSHFTIRKFADDERKLVDAVNGTEYVPTYEDKDGDWMLVGDVPWKMFVENCQ

SEQ ID NO: 46858 - DNA, 710 bp, Panicum virgatum
  misc_feature: Ceres CLONE 2032995
  misc_feature: Encodes the peptide sequence at SEQ ID NO. 46859
acaaaaaaaaaaaaaaaaaccccggctcctccactccacttcggcctctcctccaccggaagcaagaacaccctgattctccgatcccctggtttgctgctcacttccgtctcggaaaccgacccccgacgcgcggatcgcaaatcaggatgaagatctttgtgaggagccccactggcaggacaatctgcctcatggtccaaccaacggataccttgtctactgttaaggcaaagattctggaacaacactgcattgtctttgatggagagcagctagacgacaaccttacattggctgattatggcatccagcatcaatccacaattgatctccaagaaaagatgcagatctatgtaacggatacactagcaggaaagaacatcactcttgaggttcatagcttagatactattgacaacgtgaaggccaagattgaatatagtgaaggatttcccaaggctcagcagtgcctcatctttggcaacaaacaactcgaggataagggcaccttggcagaccacaacatctgcaaggagtccacccttctccttgtcctccacccgtttccaataggcacgatgcggatcttcgtgggtacgccattaggaacgaccatcgctcttgcggttaaaagctcagatactatctacaatgtcatggtgaagatccatgagaaggtaggtgttccctcccgacagcaacgcctc

SEQ ID NO: 46859 - protein, 186 aa, Panicum virgatum
  misc_feature: Ceres CLONE 2032995
  misc_feature (72)..(140): Pfam Name: ubiquitin Pfam Description: Ubiquitin family
  misc_feature (6)..(67): Pfam Name: ubiquitin Pfam Description: Ubiquitin family
  misc_feature: Functional homolog of the protein sequence given in SEQ ID NO 50133
  misc_feature: Useful for making plants with modulated nitrogen use efficiency
  misc_feature: Functional homolog of the protein sequence given in SEQ ID NO 50597
  misc_feature: Useful for making plants with modulated cold sensitivity
MKIFVRSPTGRTICLMVQPTDTLSTVKAKILEQHCIVFDGEQLDDNLTLADYGIQHQSTIDLQEKMQIYVTDTLAGKNITLEVHSLDTIDNVKAKIEYSEGFPKAQQCLIFGNKQLEDKGTLADHNICKESTLLLVLHPFPIGTMRIFVGTPLGTTIALAVKSSDTIYNVMVKIHEKVGVPSRQQR

SEQ ID NO: 46860 - DNA, 709 bp, Panicum virgatum
  misc_feature: Ceres CLONE 2032996
  misc_feature: Encodes the peptide sequence at SEQ ID NO. 46861
acagcgccctgaaagcgaacgccagccgcaggcgagggagccgtccactcttcttcctcgccgagcaccagccgtacgtttccttcctggaacttccagtctcccccattaagttcatccggccctctctcctcgcgcctcgagctccgctccctggaaggttcatggggagatggacgtgcaccggcgtagtggctctcataatcttgctgtctgctgcttcgcatggaagagaattgcctgtcaagaaaagtggccagagttttgtctacaatcacactcttgcaaaaactcttgtggaatatgcttcagcggtgtatatgacagatttaactgctctgtatacatggacatgctcaagatgcaatgacctgacccaaggctttgagatgagatctctaattgttgacgtggagaactgcttgcaggcatttgttggtgtagctcattatctaaattcgattgttgttgcaattagaggaactcaagagaacagtgtacagaattggttcaaggacttgatatggaagcagcttgatctaagatatccaaacatgccaaatgcaaaggtgcacagtggatttttctcctcctataataatacaattttgcgtctagctatcacaagtgctgttcgcaaggccagaaaatcatacgggaatatcaatgtcatagtgacaggccactcaatgggaggagccatggcttc

SEQ ID NO: 46861 - protein, 181 aa, Panicum virgatum
  misc_feature: Ceres CLONE 2032996
  misc_feature: SWISSPROT Homolog: EC 3.1.1.3 Triacylglycerol lipase
MGRWTCTGVVALIILLSAASHGRELPVKKSGQSFVYNHTLAKTLVEYASAVYMTDLTALYTWTCSRCNDLTQGFEMRSLIVDVENCLQAFVGVAHYLNSIVVAIRGTQENSVQNWFKDLIWKQLDLRYPNMPNAKVHSGFFSSYNNTILRLAITSAVRKARKSYGNINVIVTGHSMGGAMA

SEQ ID NO: 46862 - DNA, 680 bp, Panicum virgatum
  misc_feature: Ceres CLONE 2032997
  misc_feature: Encodes the peptide sequence at SEQ ID NO. 46863
agggatacccaaccaccacccaatcgccgccaccaccaccaccacagagcagagagccatggggcggttgccgtgctgcgagaaggcgcacacgaacaagggcgcctggaccaaggaggaggacgaccgcctcgtcgcctacatccgggcgcacggcgaggggtgctggcgctccctccccaaggccgcgggcctcctgcgctgcggcaagagctgccgcctgcgctggatcaactacctccgcccggacctcaagcgcggcaacttcaccgccgacgaggacgacctcatcgtcaagctccacagcctcctcggcaacaagtggtcgctcatcgccgcgcgcctccccggccgcaccgacaacgagatcaagaactactggaacacgcacatcaagcgcaagctcctcagccgcggcatcgaccccgtcacgcaccgccccatcgccgacgccgccagaaacgtcaccatctccttccagcccgacgcgccgtcgcagcagcagcagcagcagctcagcgacgacgccgaggcgccgccgccgcagcagcagcagcagctcaagccgccgcctaggtgccccgacctcaacctcgacctctgcatcagcccgccctgccacaaggaagaagaggaccaggagctcgtcaagcccgtcgccgccaagcgcgaggtgctgc

SEQ ID NO: 46863 - protein, 207 aa, Panicum virgatum
  misc_feature: Ceres CLONE 2032997
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: The sequence is a functional homolog of SEQ ID NO 1010 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1073 in the 10/374,780 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1004 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1002 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Functional homolog of the protein sequence given in SEQ ID NO 50478
  misc_feature: Useful for making plants with altered lignin content
  misc_feature: Functional homolog of the protein sequence given in SEQ ID NO 50946
  misc_feature: Useful for making plants with modulated nitrogen use efficiency
  misc_feature: The sequence is a functional homolog of SEQ ID NO 824 in the 10/412,699 US patent application
  misc_feature: Functional homolog of the protein sequence given in SEQ ID NO 50784
  misc_feature: Useful for making plants with altered alkaloid content
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 58 in the 10/666,642 US patent application
  misc_feature: The sequence is a functional homolog of SEQ ID NO 271 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 442 in the 10/412,699 US patent application
  misc_feature: Functional homolog of the protein sequence given in SEQ ID NO 50235
  misc_feature: Useful for biocontainment applications
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 836 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 1681 in the 10/374,780 US patent application
  misc_feature: The sequence is a functional homolog of SEQ ID NO 822 in the 10/412,699 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1566 in the 10/374,780 US patent application
  misc_feature: The sequence is a functional homolog of SEQ ID NO 126 in the 10/412,699 US patent application
  misc_feature: Functional homolog of the protein sequence given in SEQ ID NO 50733
  misc_feature: Useful for making plants with altered cell wall content and/or composition
MGRLPCCEKAHTNKGAWTKEEDDRLVAYIRAHGEGCWRSLPKAAGLLRCGKSCRLRWINYLRPDLKRGNFTADEDDLIVKLHSLLGNKWSLIAARLPGRTDNEIKNYWNTHIKRKLLSRGIDPVTHRPIADAARNVTISFQPDAPSQQQQQQLSDDAEAPPPQQQQQLKPPPRCPDLNLDLCISPPCHKEEEDQELVKPVAAKREVL

SEQ ID NO: 46864 - DNA, 732 bp, Panicum virgatum
  misc_feature: Ceres CLONE 2033007
  misc_feature: Encodes the peptide sequence at SEQ ID NO. 46865
agcaacagagaagtctgcttaatctcatcttttcctcctcttatctctgagagcacatcccagaggcggaaaataggaccggagcggcaaatccttggtttttgcccaagatgtcttctccaagcaagcgccgggagatggacctcatgaagctgatgatgagcgactacaaggtggagatggtgaacgatgggatgcaagagttctttgtcgaattccgtgggcctaacgaaagcatttatcaaggaggtgtatggaaggttagagtagaactgccagatgcatatccatacaagtccccatcgattggattcatcaataagatttatcacccaaatgttgatgaaatgtctggttcagtctgtttggatgtcataaatcagacatggagcccgatgtttgatcttgtcaatgtatttgaggtctttcttccacaacttctgttatatccgaacccttctgatccattaaatggagacgctgctgcactgatgatgcgtgatcgtcctgcttatgaacaaaaagtgaaagaatactgcgaaaagtatgccaaacccgaagatgctggtgtagtccccgaggacaagtccagcgacgaagaactgagtgatgaagatgaagataactctggtgatgaggagataatgggcaaacccgatccgtagtcaactcgggcaacctcttcctcgggctaatctgcaaacaatgtttgttgcagcaactgcaatcaac

SEQ ID NO: 46865 - protein, 184 aa, Panicum virgatum
  misc_feature: Ceres CLONE 2033007
  misc_feature (7)..(143): Pfam Name: UQ_con Pfam Description: Ubiquitin-conjugating enzyme
  misc_feature: SWISSPROT Homolog: EC 6.3.2.19 Ubiquitin--protein ligase
MSSPSKRREMDLMKLMMSDYKVEMVNDGMQEFFVEFRGPNESIYQGGVWKVRVELPDAYPYKSPSIGFINKIYHPNVDEMSGSVCLDVINQTWSPMFDLVNVFEVFLPQLLLYPNPSDPLNGDAAALMMRDRPAYEQKVKEYCEKYAKPEDAGVVPEDKSSDEELSDEDEDNSGDEEIMGKPDP

SEQ ID NO: 46866 - DNA, 671 bp, Panicum virgatum
  misc_feature: Ceres CLONE 2033008
  misc_feature: Encodes the peptide sequence at SEQ ID NO. 46867
aggccgcagccctctcctctccgtgaagcctcgaatcgaaaccaaccaaaggtcaaagcccaaccaaaccgttcctcccgccctcaccacccgtcccctttctccccttgaaccccctcccgtctttcgttcctcggcaagccctagggtttagggctttaggcgcgcgatgtacggcggaggcgggcactacggcggcgatggcggtggcgccgcgaacgccaactccctcttcggcggtgggggattcatgccctcgcagtccaccgcggtcccggagagcagcggcggcggcagcgtctccaagggccggaacgcgcagacgctgctgccgctcaccgtgaagcagatcatggacgcggcgcaggccagcgacgacaagtccaatttcgccatcaacggcgtcgaagtgtccacggttaggcttgttggacgcatgctgggtaagattgagcgggtcacagatgttgcattcactcttgatgatggtaccggcaagatagatgtgaatcgatgggaaaacgagtctactgacactaaggaaatggctgatgtcaatgatgggaactatgtcattgtcaacggtggtttgaaagcttttcaaggaaagcgccatgtggtagcttactctgttcggcgtgtgacaaacttcaatgatataacacatcact

SEQ ID NO: 46867 - protein, 167 aa, Panicum virgatum
  misc_feature: Ceres CLONE 2033008
  misc_feature (84)..(158): Pfam Name: tRNA_anti Pfam Description: OB-fold nucleic acid binding domain
MYGGGGHYGGDGGGAANANSLFGGGGFMPSQSTAVPESSGGGSVSKGRNAQTLLPLTVKQIMDAAQASDDKSNFAINGVEVSTVRLVGRMLGKIERVTDVAFTLDDGTGKIDVNRWENESTDTKEMADVNDGNYVIVNGGLKAFQGKRHVVAYSVRRVTNFNDITHH

SEQ ID NO: 46868 - DNA, 645 bp, Panicum virgatum
  misc_feature: Ceres CLONE 2033014
  misc_feature: Encodes the peptide sequence at SEQ ID NO. 46869
gcctccgcctccacctccgccgccgccgccgcttccgcgctcctggcgcgctgccgctccctcgccgcagtcaagcagctccacgcccatttcctcacccactccaacggccccttcccctacaaccacttcctctccaagctcctctccctctcctccgccacggtcgccgtcaccaatgccgcctccgactatgccctcctcctcctctcttaccacccggcgcccaccgccttctcgtacaacgtcgcgctccgcctcttcgcctcctcgcgcccgggcaccaccctccgcctgttcctccgcatgctccgcgccgggctccgccccgacgcctacacgctccccttcctgctcctcgccgccgcgcgcagcccgtccccgccggtcgctcgctccgcccacgcgcttctcgacaagcttgggctcagggaccacgaccacaccgtccactccctgatcaccatgtactcctacctcggggatcatcttgctgcgcgcagggtgttcgacgggattccccgccgggatgtcgtctcatggaactctatgatcaaggcctacgagcgggcagggatggtggctgaggtggaagggatgttccggtcgatggttgcagagggtacggtggcgcccaacggggtg

SEQ ID NO: 46869 - protein, 214 aa, Panicum virgatum
  misc_feature: Ceres CLONE 2033014
  misc_feature (179)..(213): Pfam Name: PPR Pfam Description: PPR repeat
ASASTSAAAAASALLARCRSLAAVKQLHAHFLTHSNGPFPYNHFLSKLLSLSSATVAVTNAASDYALLLLSYHPAPTAFSYNVALRLFASSRPGTTLRLFLRMLRAGLRPDAYTLPFLLLAAARSPSPPVARSAHALLDKLGLRDHDHTVHSLITMYSYLGDHLAARRVFDGIPRRDVVSWNSMIKAYERAGMVAEVEGMFRSMVAEGTVAPNG

SEQ ID NO: 46870 - DNA, 692 bp, Panicum virgatum
  misc_feature: Ceres CLONE 2033036
  misc_feature: Encodes the peptide sequence at SEQ ID NO. 46871
agaggatcaaggctgtgaggcagatgattatggctcccacacttgaactgaggcagaaggcactagatcgtcttttgccttatcagaggtctgactttgaaggaattttccgtgctatggatgggcttccagtgacaattcggctactggaccccccacttcatgagtttcttcctgaagggaatgtcgaagacattgtgagtgaattgtgtgctgaaactggagccgatcaggaggaagcccttgcaagaatagaaaaactttcagaagtaaatccaatgcttggtttccgtgggtgcaggcttggtatatcgtatcctgaattaacagaaatgcaagctcgtgccatctttgaagctgctatagcgatgtccaaccaaggtgttcaagtttttccagagataatggttcctcttgttggaacacctcaggaactggggaatcaagtggcccttatccgtcaaactgctaacaatgttttcactgctatgggtaaaaccattgagtacaaaattggaactatgattgaaattcccagggcagctctagtggctgatgagatagcagagcaggctgaattcttctcttttgggacgaacgaccttacacagatgacatttggctacagcagggatgatgtggggaagtttctccccatttatctttctcagggtatcctccaacatgatccc

SEQ ID NO: 46871 - protein, 229 aa, Panicum virgatum
  misc_feature: Ceres CLONE 2033036
  misc_feature (1)..(229): Pfam Name: PEP-utilizers_C Pfam Description: PEP-utilising enzyme, TIM barrel domain
  misc_feature: SWISSPROT Homolog: EC 2.7.9.1 Pyruvate, phosphate dikinase
RIKAVRQMIMAPTLELRQKALDRLLPYQRSDFEGIFRAMDGLPVTIRLLDPPLHEFLPEGNVEDIVSELCAETGADQEEALARIEKLSEVNPMLGFRGCRLGISYPELTEMQARAIFEAAIAMSNQGVQVFPEIMVPLVGTPQELGNQVALIRQTANNVFTAMGKTIEYKIGTMIEIPRAALVADEIAEQAEFFSFGTNDLTQMTFGYSRDDVGKFLPIYLSQGILQHD

SEQ ID NO: 46872 - DNA, 658 bp, Panicum virgatum
  misc_feature: Ceres CLONE 2033037
  misc_feature: Encodes the peptide sequence at SEQ ID NO. 46873
gtccgccagtccgcctcagctctctctgccttgcccgtcgctggcctcccgctcccttgccgagcccacggctcgcaggtcagctttggtaattgcccccccccccccacccccccttattatcacaatggcagggtcacttattgctcgctctcctgaagtggatccgaagatagagaagcctgatgatatggttactggtggtgttcttgcaagttttcagaatttcctacgcaagtgcctcatagctgtcatctcatatggcccaatgcccaagcacatagcttttattatggacggtaaccgcagatatgctaaattcagaagcatccagcatggagctggtcacagggtgggtttctctgctcttattgcaaatctgctgtactgctatgaaatgggtgtgaggtacatcacggtgtatgcatttagcattgacaattttaaaagggacccaagtgaggtgcagtccttgatgcagttaatggaggaaaaaatcaatgagttattagacaaccggagtgtgatcaacaagattaactgcaagatcaacttctggggaaatttggacctgttagctgagccagtgaggttagcagctcagaagctgatggcaagcacggctggaaacacaggggtagttctctctgtctgcatg

SEQ ID NO: 46873 - protein, 176 aa, Panicum virgatum
  misc_feature: Ceres CLONE 2033037
  misc_feature (55)..(176): Pfam Name: Prenyltransf Pfam Description: Putative undecaprenyl diphosphate synthase
  misc_feature: SWISSPROT Homolog: EC 2.5.1.31 Di-trans,poly-cis-decaprenylcistransferase
MAGSLIARSPEVDPKIEKPDDMVTGGVLASFQNFLRKCLIAVISYGPMPKHIAFIMDGNRRYAKFRSIQHGAGHRVGFSALIANLLYCYEMGVRYITVYAFSIDNFKRDPSEVQSLMQLMEEKINELLDNRSVINKINCKINFWGNLDLLAEPVRLAAQKLMASTAGNTGVVLSVC

SEQ ID NO: 46874 - DNA, 697 bp, Panicum virgatum
  misc_feature: Ceres CLONE 2033045
  misc_feature: Encodes the peptide sequence at SEQ ID NO. 46875
atgtcgaaggcgagcagcccgccggctccaccccgcttcgcgcgcgcacgcaagagctccgtgggctcgcggtgagcacgccggccagcgcggcgcggcgcatggcggagcacctcctctcgacggccgcgcaccgcaccatgccggggaactacgtccggccggaggcgcagcgcccgcgcctcgccgaggtcgtctccggcgcgcccatccccgtcgtcgacctggcgtgccccgatcgcgccgccgccgccgtcgccgccatcggcgccgcctgctgctcgcacggcttcttccaggtcctgaaccacgggatagacgacgggctgatcgcggaggtgatggccgtggcgcgcgagttcttccggctgcccgcggaggagaaggccaagctctactccgacgaccccaccaggaagattcggctgtccaccagcttcaacgtgcgcaaggagacggtgcacaactggcgtgactacctccggctgcactgccaccccctcgaccagttcgtgcccgattggccgtccaacccgcccgacttcaaggagaccattagcagctactgcagggaggtccgggcgctggggttcaggctgtacgcggcgatctcggagagcttgggcctggaggcgagctacatggaggagacgctgggggagcaggagcagcacatggccgtcaacttctacccggc

SEQ ID NO: 46875 - protein, 198 aa, Panicum virgatum
  misc_feature: Ceres CLONE 2033045
  misc_feature: SWISSPROT Homolog: EC 1.14.11.11 Hyoscyamine (6S)-dioxygenase
MAEHLLSTAAHRTMPGNYVRPEAQRPRLAEVVSGAPIPVVDLACPDRAAAAVAAIGAACCSHGFFQVLNHGIDDGLIAEVMAVAREFFRLPAEEKAKLYSDDPTRKIRLSTSFNVRKETVHNWRDYLRLHCHPLDQFVPDWPSNPPDFKETISSYCREVRALGFRLYAAISESLGLEASYMEETLGEQEQHMAVNFYP

SEQ ID NO: 46876 - DNA, 749 bp, Panicum virgatum
  misc_feature: Ceres CLONE 2033051
  misc_feature: Encodes the peptide sequence at SEQ ID NO. 46877
ctctccccatctccacagcagccgccgcgcgctgctccctcctctccccttcggcgccggcatcacctccgcggccaccaggcaacagcactctcttctgtgcccacttgtgaaactatcttgtggggagatggcggtttctttcgctaacctcaactctgaggcagggcttaaaaagcttgacgactaccttctcactcgcagctacattactggttaccaagcttccaaggatgacttggctgtctactcctcattttctgctgctccctcatccaagtatatcaacgtcacaaggtggttcagtcacattgatgcactcttgaggctgagtggagttactgcagagggccaaggtgtcaaggttgaatcatctgctgttccatcagcatccacacctgatgttgctgacacagtgactgcacctgctgatgacgacgacgatgatgatgttgacctttttggcgaggagaccgaagaggagaagaaggctgctgaagagcgtgctgcagctgtcaaggcttctggcaagaagaaagaatctgggaagtcgtcagttttgcttgatgtgaagccatgggatgatgagactgacatggccaagcttgaggaagcagtaaggaatgtcaagatggaaggactgctctggggtgcatccaagcttgtcccagttgggtatggcatcaagaagcttcagatcatgttgactatggttgatgaccttgtctctgttgacactctgatcgagg

SEQ ID NO: 46877 - protein, 206 aa, Panicum virgatum
  misc_feature: Ceres CLONE 2033051
  misc_feature (140)..(206): Pfam Name: EF1_GNE Pfam Description: EF-1 guanine nucleotide exchange domain
  misc_feature: SWISSPROT Homolog: EC 6.1.1.16 Cysteine--tRNA ligase
MAVSFANLNSEAGLKKLDDYLLTRSYITGYQASKDDLAVYSSFSAAPSSKYINVTRWFSHIDALLRLSGVTAEGQGVKVESSAVPSASTPDVADTVTAPADDDDDDDVDLFGEETEEEKKAAEERAAAVKASGKKKESGKSSVLLDVKPWDDETDMAKLEEAVRNVKMEGLLWGASKLVPVGYGIKKLQIMLTMVDDLVSVDTLIE

SEQ ID NO: 46878 - DNA, 738 bp, Panicum virgatum
  misc_feature: Ceres CLONE 2033058
  misc_feature: Encodes the peptide sequence at SEQ ID NO. 46879
ggagagaagtttcttgaaagaatgtgaagcactgagaagcatccagcatagaaatctccttcccatcgtaactgcttgcttcacggtagacaacacaggccgtgtttttaaagctttagtttatgaattcatggctaatgggaacctggacaaatggttacatcccaaaggggacggaaaagctcagaaaccactgagcttgactcaaagattaagcatagctgttaacatagctgatgcattggactatttacactatgactgcggaaggaccaccatccattgtgatctgaagcctagcaatattcttctggatgatgatatgaatgctcttttgggagacttcggcattgcaagtttctaccaagattctttgtctggaccagcgggtttaataagttcatcagttggtgtgaaggggactatcggatacattgctccagaatacgcgggaggtggtcgccatgcatcgccttctgacgatgtttatggttttgggataatactgctggaaatgatgactggaaggagaccaacagatccaacgttcaaggatggagtcagcatcgtcaactttgtggatgccagctttccacatgaaatatttcacgttatcgatgctcacctgacagaagaatgcaagaactttgctgaagcaaagacgacggcatcagaaagtccggttcatcaatgcttggtctccgtgctgaaagtagcactttcctgtacgaaaccagt

SEQ ID NO: 46879 - protein, 245 aa, Panicum virgatum
  misc_feature: Ceres CLONE 2033058
  misc_feature (1)..(235): Pfam Name: Pkinase Pfam Description: Protein kinase domain
  misc_feature: SWISSPROT Homolog: EC 2.7.11.1 Non-specific serine/threonine protein kinase
ERSFLKECEALRSIQHRNLLPIVTACFTVDNTGRVFKALVYEFMANGNLDKWLHPKGDGKAQKPLSLTQRLSIAVNIADALDYLHYDCGRTTIHCDLKPSNILLDDDMNALLGDFGIASFYQDSLSGPAGLISSSVGVKGTIGYIAPEYAGGGRHASPSDDVYGFGIILLEMMTGRRPTDPTFKDGVSIVNFVDASFPHEIFHVIDAHLTEECKNFAEAKTTASESPVHQCLVSVLKVALSCTKP

SEQ ID NO: 46880 - DNA, 661 bp, Panicum virgatum
  misc_feature: Ceres CLONE 2033086
  misc_feature: Encodes the peptide sequence at SEQ ID NO. 46881
caaactagcttaaacaacaatactcttgaggatgaaaccggaactgaagatgcaatgcagtttttcctgactaacgagaggttcccagaccaacgcatgaagatagaaatggatcaacccattacagtgaaaggtccgctgaggcgtctgcatgtgattgtgtgttggcaggacgatggactggagcaatacaatcttggttctttggattctcttccagagatttacaaagccgtgttattttcaaggagaccgcaggacacatgttctctatatgcatgcctggaagcttttatcaaggaagaaccattgggcccagaagacatgtggtattgcccaggttgtaaagagcatcggcaggctagtaagaagctagacctttggaggttacctgagatccttataatacaccttaaaaggttttcgtacagccgctacaccaaaaacaagctggacacttttgtggacttcccgattcatgatcttgacctgtcaaagtatatcggtcacagatgccaacagattccccacaattaccgactttatgctatcagcaatcactatggaagcatgggaggtggtcactatacagcttatgtttatgacgaaaggaaaaaagggtggtatgactttgatgatcgtcatgtgggtcctatagctg

SEQ ID NO: 46881 - protein, 220 aa, Panicum virgatum
  misc_feature: Ceres CLONE 2033086
  misc_feature (63)..(220): Pfam Name: UCH Pfam Description: Ubiquitin carboxyl-terminal hydrolase
  misc_feature: SWISSPROT Homolog: EC 3.1.2.15 Ubiquitin thiolesterase
QTSLNNNTLEDETGTEDAMQFFLTNERFPDQRMKIEMDQPITVKGPLRRLHVIVCWQDDGLEQYNLGSLDSLPEIYKAVLFSRRPQDTCSLYACLEAFIKEEPLGPEDMWYCPGCKEHRQASKKLDLWRLPEILIIHLKRFSYSRYTKNKLDTFVDFPIHDLDLSKYIGHRCQQIPHNYRLYAISNHYGSMGGGHYTAYVYDERKKGWYDFDDRHVGPIA

SEQ ID NO: 46882 - DNA, 727 bp, Panicum virgatum
  misc_feature: Ceres CLONE 2033088
  misc_feature: Encodes the peptide sequence at SEQ ID NO. 46883
  misc_feature (585)..(585): n is a, c, t, g, unknown, or other
gtgtttgcttgctctccgctgccgtctcccaccgccgtcgccatgcctttccagttccagttcccatggctcaagaaccccaccaccaccaacaccgccgccggttcctccaaccccaaccccagccctagccctagccccagcatcccaaaccccttcctccccatccaagcccacctcacctccttcctctcctcccttccccgggccctcccgccgccgccgccctgggctcgcatcccctccccctccccctccccctcccgggcctcggtcacgcccctaccgtccgccgagatcgaggagcggctcgccggggtgcccgtgtacgcgctcgccaacgccgcccatgagatcgtgctcgtgtcgtccgcccgcgctggagcgcagcacgggggcgagggcgcgaggccgccgccggctctcgggcttctgtgcttccggaaggaggatgccgacgcgctgctggagcagatggagggcgacatgcgcgccggctccagcgtcgtgcccgtggcgctgaacaaggttatccaactaaagtctgatggtgtggcgtttagattccttcctgattcatctcangtggctaatgcaattaagttgatgcaagatgaaaggctttatgccagagagggatttccaggggttccagtttttcagtcaaggagcttggtcctgatgagtgacaacaagagatatcgtccagttttcttcaaaaaggagg

SEQ ID NO: 46883 - protein, 228 aa, Panicum virgatum
  misc_feature: Ceres CLONE 2033088
  misc_feature (21)..(228): Pfam Name: Tic22 Pfam Description: Tic22-like family
  misc_feature (181)..(181): Xaa is any aa, unknown, or other
MPFQFQFPWLKNPTTTNTAAGSSNPNPSPSPSPSIPNPFLPIQAHLTSFLSSLPRALPPPPPWARIPSPSPSPSRASVTPLPSAEIEERLAGVPVYALANAAHEIVLVSSARAGAQHGGEGARPPPALGLLCFRKEDADALLEQMEGDMRAGSSVVPVALNKVIQLKSDGVAFRFLPDSSXVANAIKLMQDERLYAREGFPGVPVFQSRSLVLMSDNKRYRPVFFKKE

SEQ ID NO: 46884 - DNA, 682 bp, Panicum virgatum
  misc_feature: Ceres CLONE 2033098
  misc_feature: Encodes the peptide sequence at SEQ ID NO. 46885
gccaaccgagaaagatatccttagaaatagatcagtcggcctcgctcgccgggtccgcggtcagctccctcgacgccgtcggcagcctccgcatcggcggcagcggcgactggggcggggaagtccgccgcctctgcgaaaggctcggtctctccggacccgacgacttcgccatctcgattgccgactgggaggcgcacaaggccctgcgcttctgcgcctctgctagctccccgctccttcacgagggtgccgaggaacacgattggcctgagggcaccgtacctgagctactggtggcacgcggcggccgaattgaagctccagagcggccggcatggctggatccgccggagctcacccggccaaatgtgaagagagcagctggggacggaggaatcaagggcatgcgcccgcagccggtgctcaagccgccgccctcgagggcgctgccggttgtctgctgggcggggtccacgtgggatctcctgcggtcgttcgcgccggatgaggaacaacacgccccggtgagcagatctggccgtggtttgggataccagtatgcggtagaaaaggaagaggaggacgatgcgagcacgaccaccgaatccaggatcttcatctcaccgaacgggaggattaggaggaagatccggtcatggaaccgaagggcgctcctggg

SEQ ID NO: 46885 - protein, 226 aa, Panicum virgatum
  misc_feature: Ceres CLONE 2033098
  misc_feature: SWISSPROT Homolog: EC 2.7.11.25 Mitogen-activated protein kinase kinase kinase
QPRKISLEIDQSASLAGSAVSSLDAVGSLRIGGSGDWGGEVRRLCERLGLSGPDDFAISIADWEAHKALRFCASASSPLLHEGAEEHDWPEGTVPELLVARGGRIEAPERPAWLDPPELTRPNVKRAAGDGGIKGMRPQPVLKPPPSRALPVVCWAGSTWDLLRSFAPDEEQHAPVSRSGRGLGYQYAVEKEEEDDASTTTESRIFISPNGRIRRKIRSWNRRALL

SEQ ID NO: 46886 - DNA, 755 bp, Panicum virgatum
  misc_feature: Ceres CLONE 2033102
  misc_feature: Encodes the peptide sequence at SEQ ID NO. 46887
atcgcacgcatcccacctgccctgccctccctcgtcgtcttcctcgcccccgctcccagctagagacaccgtaccgccaggtttttgctttatgctagttcatgtgtccgcagacaatggactgattgctggcctgcctctgtgattcaccatgggaagcagatggagctgatacaccgtctaagacaagcaaggggtctgccccacaggagcaacagccacctgctactacatttgctgcaacaccagctgtttatccagattggtccagcttccaggcatatcctccaatcccaccacatgggttcttcccttcacctgtggcatcaagtccacagggtcatccttacatgtggggagctcaacctatgatcccaccatatggaacaccgccgccgccatacgtcatgtaccctcctggagtatatgctcacccgtctatgcccccgggtgcacatccattcaccccttatgccatgacttctccaaatggcaatgctgatgctactggaactactgcagcaggtggtgatactgacgggaagccctctgaaggcaaagataaaagtccaacaaaaagatccaaaggaagtttacgtagcttgaacatgcttactgggaagaatcccaccgaacatggtaagacctcacgagcatcagctaatggagccacttctcaaagtgcggaaagtgcgagtgaaagctcaagtgaagggagcgaaggaaattctcagaatgatccacatcacaatgaa

SEQ ID NO: 46887 - protein, 134 aa, Panicum virgatum
  misc_feature: Ceres CLONE 2033102
  misc_feature (1)..(131): Pfam Name: MFMR Pfam Description: G-box binding protein MFMR
  misc_feature: Functional homolog of the protein sequence given in SEQ ID NO 51160
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MWGAQPMIPPYGTPPPPYVMYPPGVYAHPSMPPGAHPFTPYAMTSPNGNADATGTTAAGGDTDGKPSEGKDKSPTKRSKGSLRSLNMLTGKNPTEHGKTSRASANGATSQSAESASESSSEGSEGNSQNDPHHN

SEQ ID NO: 46888 - DNA, 674 bp, Panicum virgatum
  misc_feature: Ceres CLONE 2033106
  misc_feature: Encodes the peptide sequence at SEQ ID NO. 46889
acggcacctcccctcgctctccgccctccgccgtctctgcccgccgcggcggcggcggctgctgctcccccggctgtcaccggacgcgcccccgttacagacaactatgaggagatacagccccccatatcgcagcccccccaggaggggatatggtggcagaggaagaagccccccacctaggaggggatatggaggacggaaggagggtactggaagtcttttagtccgcaatatcccattaagcgtcagagcggaggatcttcgagttccttttgaaaggtttggtcctgtccgggatgtttacattccaaaggactattatagtgggtaagtgttactaaatcatctagtcttgtggcttaatgctgaaaaagggtactttgttgtttcgatattgactggaatgcaaatagattgacgcctgtctactttttggctataataaacatcaaaaccatttttagaggcatgacttaaacgaataaacaacgtatatttaacaaagtgagcatcctccagttgagtgcaacagcaactttgcgatgtgtttggtgcgtttaagcgctgtgaccgaactgcatgcaccaaactttacaaaatgcccctgttattttttgtccattgatggatggcattattcgttatctatcaatataattatataatgcatg

SEQ ID NO: 46889 - protein, 75 aa, Panicum virgatum
  misc_feature: Ceres CLONE 2033106
  misc_feature: Functional homolog of the protein sequence given in SEQ ID NO 50855
  misc_feature: Useful for making plants with altered terpenoid content
MRRYSPPYRSPPRRGYGGRGRSPPPRRGYGGRKEGTGSLLVRNIPLSVRAEDLRVPFERFGPVRDVYIPKDYYSG

SEQ ID NO: 46890 - DNA, 682 bp, Panicum virgatum
  misc_feature: Ceres CLONE 2033114
  misc_feature: Encodes the peptide sequence at SEQ ID NO. 46891
atcgatcgagcccacactgcactagctttctctcttgctcttccgagctccaagcgaaaagatggagtcgctagcacggttgcttctgctggtggccgcggccacgggcgccctggccgcgacgccgccccaccccgccaagggcctgcgcgtgcggctgacgcacgtcgacgcgcacggcaactactcgcggctgcagctgctgcagcgggcggcgcggcggagccaccaccgcatgtcgaggctcgtcgcgcgggccaccggcgtgccgatgtcgagcaaggccgtcgcgcggggcggcgacctgcaggtgccggtgcacgcgggcaacggcgagttcctgatggacctggccatcgtggacacaggcagcgacctggtgtggacgcagtgcaagccgtgcgtggagtgcttcaaccagagcacgccggtgttcgatcccgcgtcctcctccacctacgcccccgtgccgtgctccagcgacctgtgcggcgacctgcccacctccagctgcacgtcgtcggcggcgtcggccgggtgcgcgtacgcctacacctacggcgacgcctcgtcgacgcgcggggtgctggccaccgagaccttcacgctggccaagtccaagctccccggcgtggcgttcggctgcagcgacaccaacgagggcgaacggctcgcgcagggc

SEQ ID NO: 46891 - protein, 206 aa, Panicum virgatum
  misc_feature: Ceres CLONE 2033114
  misc_feature: SWISSPROT Homolog: EC 3.4.23.12 Nepenthesin
MESLARLLLLVAAATGALAATPPHPAKGLRVRLTHVDAHGNYSRLQLLQRAARRSHHRMSRLVARATGVPMSSKAVARGGDLQVPVHAGNGEFLMDLAIVDTGSDLVWTQCKPCVECFNQSTPVFDPASSSTYAPVPCSSDLCGDLPTSSCTSSAASAGCAYAYTYGDASSTRGVLATETFTLAKSKLPGVAFGCSDTNEGERLAQ

SEQ ID NO: 46892 - DNA, 752 bp, Panicum virgatum
  misc_feature: Ceres CLONE 2033118
  misc_feature: Encodes the peptide sequence at SEQ ID NO. 46893
gttgcctcgatctctctcgtcctctattttctagcggcggcgacgacagggcgagcggcggcgtccttggtaggtcttcgtcgggcgcttcgctgacggccagcaaccggcaggtgactgttctgattctcctggattaagggaatttctcattggagattcatctcgaggctggatttcataattttatggcctttgactgcaacaaggcaagaggagtttcttcgcctcataatcgctccaacatttgcactgagggtactatcatccaggcaaatcccttatctcactactggaaggctaaaggtttgaagaaccgcaacaaattagggaaccagaagcccacttatggatcaattccaagagacactaatacaaataaaaatgatgaagcgagcggtgaagccattgcctcgacctgtggtatcaggtgcttcaccgatttgccagctgcattggtctgtgaggtccttgcgcgccttgatgccaaggagcttggaattgtatcttgtgtctccacccttctacatactttagcctcagatcatcaaggatggaagaaattgtactgtgaaagatgggggcttccaaatctccccaccaccctaaacgggcctgtggttccaggtggtcccttagacgggaagtcctggagaacattttttgtggagcgggagtttcgaagtaaatcattcatggggaaaattcatgtggatgttcttcgtggccacaatgaggatgtacgtgcccgt

SEQ ID NO: 46893 - protein, 187 aa, Panicum virgatum
  misc_feature: Ceres CLONE 2033118
  misc_feature (81)..(128): Pfam Name: F-box Pfam Description: F-box domain
MAFDCNKARGVSSPHNRSNICTEGTIIQANPLSHYWKAKGLKNRNKLGNQKPTYGSIPRDTNTNKNDEASGEAIASTCGIRCFTDLPAALVCEVLARLDAKELGIVSCVSTLLHTLASDHQGWKKLYCERWGLPNLPTTLNGPVVPGGPLDGKSWRTFFVEREFRSKSFMGKIHVDVLRGHNEDVRA

SEQ ID NO: 46894 - DNA, 704 bp, Panicum virgatum
  misc_feature: Ceres CLONE 2033123
  misc_feature: Encodes the peptide sequence at SEQ ID NO. 46895
atccactttgctcgcctccctcctacgcttcgtgcagccgccgccacctcctcgtccgcgccttgccacgcttctccgtctcaggttgcagcctgttaacataaatggctgaagaggacattcagccccttgtctgcgacaatggaactggaatggtcaaggctggctttgctggagatgatgctccgcgtgctgttttccccagtatagttggccgtccacgccacactggtgtcatggttgggatgggacagaaggatgcttacgttggtgatgaggcccaatccaagaggggtatcttgactttgaagtaccccattgagcatggaattgtgagcaactgggatgatatggaaaagatttggcaccacaccttctacaatgagctccgtgtagcaccagaagagcatccagttcttcttacagaggctcctctcaaccctaaggcaaacagggaaaagatgacacagatcatgttcgagaccttcagtgttccagccatgtatgttgccatccaagccgtcctttccctatatgctagcggtcgtaccactggtattgtcatggattccggtgatggtgtcagccacaccgtcccaatctacgaaggttacgctctcccacatgccattctccgtctcgaccttgctggcagggatctcactgattccctgatgaagatcctgactgagaggggttactca

SEQ ID NO: 46895 - protein, 199 aa, Panicum virgatum
  misc_feature: Ceres CLONE 2033123
  misc_feature (3)..(199): Pfam Name: Actin Pfam Description: Actin
  misc_feature: SWISSPROT Homolog: EC 2.7.10.2 Non-specific protein-tyrosine kinase
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
MAEEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVMDSGDGVSHTVPIYEGYALPHAILRLDLAGRDLTDSLMKILTERGY

SEQ ID NO: 46896 - DNA, 687 bp, Panicum virgatum
  misc_feature: Ceres CLONE 2033125
  misc_feature: Encodes the peptide sequence at SEQ ID NO. 46897
gtctcttcgttggcagacccgccgccgccggtcgcgtcgaggatcctggcgacggcgggcgcgcgctcaggtgactcagcgtggcgacgctggcggcgcgcgaacagagcctgacggctcggcgcggcagggcgtggctagaggcggaggtgcggcgcgcgtgcgagtccggcaggaggctcgacccgacggttccgcaggcggcgatgagcgacgagccgccgccgaaacctacgctggtgttcacgtacggcgcgctgaagcgcgacttctccaaccacccgctgctgcaggagctggctttgagcggggacgcctccttcgcgggcgccgccgtgacagcgtggcggctgccgctggtgtgcgggccctaccgcgtgcccttcctcctgaacctccccggcgaggaggaccgcgtggccggggagctctacgccgtgacggcccggggcctggctcgcctggacgagttggagggcgtctccagtgcgcactacgagcgcctgcccatcgccgttgacctcgccgagggcggctgcgcgagggtggacggcgtcgtggcctactacgcgcaccgggactacgctgccgagatgtggctgcgcagcagggggaaggggtacccggagtactgcaacgccgtggcaggggctacatgcggtgcaaggacagaccttcctctagcag

SEQ ID NO: 46897 - protein, 160 aa, Panicum virgatum
  misc_feature: Ceres CLONE 2033125
  misc_feature (12)..(122): Pfam Name: AIG2 Pfam Description: AIG2-like family
MSDEPPPKPTLVFTYGALKRDFSNHPLLQELALSGDASFAGAAVTAWRLPLVCGPYRVPFLLNLPGEEDRVAGELYAVTARGLARLDELEGVSSAHYERLPIAVDLAEGGCARVDGVVAYYAHRDYAAEMWLRSRGKGYPEYCNAVAGATCGARTDLPLA

SEQ ID NO: 46898 - DNA, 728 bp, Panicum virgatum
  misc_feature: Ceres CLONE 2033134
  misc_feature: Encodes the peptide sequence at SEQ ID NO. 46899
gcatcccaccgcccactcactccctcccgcacccgacccgtcgcaatggccgccgcggccgcgatctccgcgcccccagggcctccccgcctcgcgctccacctccacccctccccctccccctccaccacctccccgctccccatgcgcgcgctccccgccctgcgccgccgcctccgcccgctcaccaccgccgtccacgccgtcaagcaggacgcggccgtctggacgcccgcgcccgtctccgcggtcggcgcggccaccgccgacggctccatcttccacgtcgccgtcgacctctccgacgccgcggacctcgcggagtcctacacgtcgccagggcagtacctccaaatccgcgtgccctccggcggcggggaggagatcaagccggctttcatggccgtcgcctcgccgcccggtgccggggcgcggttcgagctcctcgtcaagtccgtgccggggaccaccgcggagcgcctctgcgggctccgcgacggggacgtggtggagctcggtgcggtcatggggaaggggttccccctcgagaggataacgctgccggatgccgcgcagaccgtgctcatcttcgccgccgggacggggatcagtactattcgttcacttgtggagtttggttttggtgccaatgaaagagccgatgtgagactttattatggtgccagaagtctgaagactatggcatatcaggataggtttaggaattg

SEQ ID NO: 46899 - protein, 227 aa, Panicum virgatum
  misc_feature: Ceres CLONE 2033134
  misc_feature (63)..(167): Pfam Name: FAD_binding_6 Pfam Description: Oxidoreductase FAD-binding domain
  misc_feature: SWISSPROT Homolog: EC 1.18.1.2 Ferredoxin--NADP(+) reductase
MAAAAAISAPPGPPRLALHLHPSPSPSTTSPLPMRALPALRRRLRPLTTAVHAVKQDAAVWTPAPVSAVGAATADGSIFHVAVDLSDAADLAESYTSPGQYLQIRVPSGGGEEIKPAFMAVASPPGAGARFELLVKSVPGTTAERLCGLRDGDVVELGAVMGKGFPLERITLPDAAQTVLIFAAGTGISTIRSLVEFGFGANERADVRLYYGARSLKTMAYQDRFRN

SEQ ID NO: 46900 - DNA, 711 bp, Panicum virgatum
  misc_feature: Ceres CLONE 2033143
  misc_feature: Encodes the peptide sequence at SEQ ID NO. 46901
ggcgagtttgactgggcgcttgagaaaaagaaaagaaaaggcttgtatttggagcccccggacaaatttgggaggaaatacaattttggaggtgctcgtggcttcgaatctccgccaattcgcgcatctcctccagcagattgccgcagatcttgctgcgcacagctactggattgatgcaggtgtattgggttcttgcacagtggttggtcttgggctcttctgttcccgctcaagagtcaagaccaaccgactgctggcctgaagtcgaagatgagtgctgacccaagtacccaagatgcgatggaggaggaagccctcaaagcaaagcatgcggcagagcgcaagttccatgcacggaacatcaagggtgccaagaggtcagcgatcaaggcacataacttgtgcccaacacttgagggcatatcccagatgatctcgacgcttgacgttcaccttgcgtctgagtcgaagattgatggggagagtgattggtacaggatactgtctctcgctgcctgggctgatgaggaggaggtgaagaaacagtacagaaagctggctctccagttgcacccagacaagaacaagtctgttggtgcagaggctgcgttcaaacttatctcggaagcttggagtgtgttgtccgacaagagcaggaagatgttgtatgatcagaggaagagagatcattcagcaatgaatgggacc

SEQ ID NO: 46901 - protein, 145 aa, Panicum virgatum
  misc_feature: Ceres CLONE 2033143
  misc_feature (73)..(134): Pfam Name: DnaJ Pfam Description: DnaJ domain
  misc_feature: SWISSPROT Homolog: EC 2.7.11.1 Non-specific serine/threonine protein kinase
MSADPSTQDAMEEEALKAKHAAERKFHARNIKGAKRSAIKAHNLCPTLEGISQMISTLDVHLASESKIDGESDWYRILSLAAWADEEEVKKQYRKLALQLHPDKNKSVGAEAAFKLISEAWSVLSDKSRKMLYDQRKRDHSAMNG

SEQ ID NO: 46902 - DNA, 662 bp, Panicum virgatum
  misc_feature: Ceres CLONE 2033148
  misc_feature: Encodes the peptide sequence at SEQ ID NO. 46903
cccaccccccggcgaatattcgacgaggaagccgcataacccgttccggctcccgttctcccttacccccggcgatcgatggcgggggaggaggcggagaggttagcggcggcggcggcggcggcgtggggggaggcggaggagggggaggggaagcagcgtggcgcgggggcgaagaagaggaagcgctacgggctcgtggagtaccgggcgctgccgggctacctgcgggacaacgagtacatccaccggcactaccgctgcgagtggccgctcccgcaggtgctgctctccgccttctccatccacaacgagaccctcaacgtctggacgcatttgattggatttttcatcttcctagctctgaccatatacacggcaactcaagttccaaatgtagtagacatccagagcctacagcacttgccggatgtgctgagaaatgctgatattcataagatccaggcggagcttctgtcatgccttccatcattacctcacctttctgatttacaaaagctgaaggatgagctgaagagctcgtggaattcaatggaagttcttccatctctgtctcgttggcgtctcttggagttactctcaaattgcttgccccaaagatttagccataccaatgaaacaagtttatctgttcttcaaag

SEQ ID NO: 46903 - protein, 194 aa, Panicum virgatum
  misc_feature: Ceres CLONE 2033148
  misc_feature: Functional homolog of the protein sequence given in SEQ ID NO 51190
  misc_feature: Useful for making plants with altered cell wall content and/or composition
MAGEEAERLAAAAAAAWGEAEEGEGKQRGAGAKKRKRYGLVEYRALPGYLRDNEYIHRHYRCEWPLPQVLLSAFSIHNETLNVWTHLIGFFIFLALTIYTATQVPNVVDIQSLQHLPDVLRNADIHKIQAELLSCLPSLPHLSDLQKLKDELKSSWNSMEVLPSLSRWRLLELLSNCLPQRFSHTNETSLSVLQ

SEQ ID NO: 46904 - DNA, 724 bp, Panicum virgatum
  misc_feature: Ceres CLONE 2033150
  misc_feature: Encodes the peptide sequence at SEQ ID NO. 46905
aaaatttactgctcgattcgtatggaaacctgaaggtctccgactttgggctgagcgctctatctcagcagatcaagcatgtttcttctctcttcaatcttgtttaggatgatggattgctgcatacaacttgtggaactccgaactacgttgcaccagaggtccttgaagatcaaggttatgacggcgcaatggctgatttgtggtcatgtggagttatcctgtttgttctgctagcagggtatttgccttttgaggactctaatcttatgatgttgtataagaaaatatcaaatgcagaatttacatttccaccgtggacgtcttttcctgcgaagaggttgttaacaagaatccttgatccaaatccaatgacggtatgccagatcacaaaagctgcttgaaaagaaaaatactagcgaaataatcttaagttaatggaaatatggaatagaacaaatctgtagtcaccatacaaatgcatcacctagtaagctgatagataactgatatcattgataaggatcaacgaaatgatattcccactgatcaagagtttgtcgtgtaagtcagattgacacaaatgtacttactagtacgcaaacggccactatgagatgcagttgagggaaaaaaaaatcttttaggaaagttataggcaattcatataaccatattcaaaatgataccctttgtgtgtgtaaagaatttgcacttccagtca

SEQ ID NO: 46905 - protein, 70 aa, Panicum virgatum
  misc_feature: Ceres CLONE 2033150
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MADLWSCGVILFVLLAGYLPFEDSNLMMLYKKISNAEFTFPPWTSFPAKRLLTRILDPNPMTVCQITKAA

SEQ ID NO: 46906 - DNA, 609 bp, Panicum virgatum
  misc_feature: Ceres CLONE 2033151
  misc_feature: Encodes the peptide sequence at SEQ ID NO. 46907
atggtcagtgatcgcttggacgtagtcatacggcgttcaaaaaaaaaaaatccaatggctcaatatggtgataatatcaagtacgaagaggacttcgtagtgaattcacgaggaaacaggctcttcacctgcaggtggacgccgaaggcattggagcccagagctctgatctttatctgccacggatacggagctgagtgtagcatatctatgggagacaccgctgctcgattagtacactctggatttgctgtctacggaatcgaccatgagggccatggtaaatcttcaggatcgaaaggctacatatcgaacttcagcgctgtcgtcaaggactgttctgaccatttcaagagtgtctgcgagaagcgggagaacaagtcaaagaagaggttcctctacggcttctccatgggaggaaccgtggtgcttcagctccataggaaggatcctctctactgggacggtgccgtgttgcttgcccctatgtgcaagatctttgacggcatgcgtccccacccgatcgtcgtcagcgcactgaagatgatcagcaccattgcgcctagctggagggtcatccctgccacggacatgattgacaaagtctgc

SEQ ID NO: 46907 - protein, 184 aa, Panicum virgatum
  misc_feature: Ceres CLONE 2033151
  misc_feature: SWISSPROT Homolog: EC 3.1.1.23 Acylglycerol lipase
MAQYGDNIKYEEDFVVNSRGNRLFTCRWTPKALEPRALIFICHGYGAECSISMGDTAARLVHSGFAVYGIDHEGHGKSSGSKGYISNFSAVVKDCSDHFKSVCEKRENKSKKRFLYGFSMGGTVVLQLHRKDPLYWDGAVLLAPMCKIFDGMRPHPIVVSALKMISTIAPSWRVIPATDMIDKV

SEQ ID NO: 46908 - DNA, 650 bp, Panicum virgatum
  misc_feature: Ceres CLONE 2033155
  misc_feature: Encodes the peptide sequence at SEQ ID NO. 46909
atcgagcaccctccaatcttcaaggcgtcgcagcaggcaaggcatcgatcgatcaatcaccagcagcgcgtgccgcgtagagagatcgagagagagagagagagagaggagtctcaccggagaagggaggaatcgtcatcgccaccgccaccgccatgggcaaggtccgctccttcttctcccgcagcggcaagcgcggcgccggcccgtcctcgccgtcctcctccgcggcgggcagcgcgccgtcgtcgccgtcaccgaggaagtcgtcggcgtcggcgccggcggccccggcggcggagaccaaggacgagatggagcgcgtgttccgcaagttcgacgcgaacggcgacgggcggatctcgcggtcggagctggcggcgctgttcgagggcgtgggccacgcggccacggacgacgaggtgtcgcgcatgatggaggaggccgacgcggacggcgacggcgccatcagcctgcccgagttcgccgcgctcgtgcgctccgccgacgccgacgccgacgccgtcgaggaggacctgcgccacgccttcatggtcttcgacgccgacggcaacggcctcatcacgcccgccgagctctcgcgcgtcctgcgcggcctcggggaggccgccaccgtcgcccagtgccgc

SEQ ID NO: 46909 - protein, 164 aa, Panicum virgatum
  misc_feature: Ceres CLONE 2033155
  misc_feature (53)..(81): Pfam Name: efhand Pfam Description: EF hand
  misc_feature (89)..(117): Pfam Name: efhand Pfam Description: EF hand
  misc_feature (127)..(155): Pfam Name: efhand Pfam Description: EF hand
  misc_feature: SWISSPROT Homolog: EC 2.7.11.1 Non-specific serine/threonine protein kinase
MGKVRSFFSRSGKRGAGPSSPSSSAAGSAPSSPSPRKSSASAPAAPAAETKDEMERVFRKFDANGDGRISRSELAALFEGVGHAATDDEVSRMMEEADADGDGAISLPEFAALVRSADADADAVEEDLRHAFMVFDADGNGLITPAELSRVLRGLGEAATVAQC

SEQ ID NO: 46910 - DNA, 676 bp, Panicum virgatum
  misc_feature: Ceres CLONE 2033157
  misc_feature: Encodes the peptide sequence at SEQ ID NO. 46911
aggcatcatccatccatcgttcatcatcattcatcgatcaagcgcacgcacacacacaaccacaaccacaacgagagagtttaattagtttaattttctggagaggaagctagctaagggatgagcatgtcgtcggcgttcatgatgagcagcaagcagcagcagcagcaggcggcgccgaataataagcggcgggcgtacgtgacgttcctggccggcgacggcgactactggaagggcgtggtggggcttgccaagggcctgcgccgggtgcggtcggcctacccgctggtggtggccgtgctccccgacgtgccggaggagcaccgccgcaagctgcgcggccagggctgcgtcgtccgcgagatccagccggtgtacccgcccgagagccagacgcagttcgccatggcctactacgtcatcaactactcaaagctaagaatatgggagttggtggagtacgagcgcatggtgtaccttgacgctgacatccaggtgttcgacaacatcgaccacctgttggacctggacaagggccgcttctacgcggtgatggactgcttctgcgagaagacgtggagccacaccccgcagtacaagatcggctactgccagcagtgcccggagcgcgtgccctggccggagcagcagctcggccccccgccgccgccct

SEQ ID NO: 46911 - protein, 185 aa, Panicum virgatum
  misc_feature: Ceres CLONE 2033157
  misc_feature (28)..(185): Pfam Name: Glyco_transf_8 Pfam Description: Glycosyl transferase family 8
  misc_feature: SWISSPROT Homolog: EC 2.4.1.186 Glycogenin glucosyltransferase
  misc_feature: Functional homolog of the protein sequence given in SEQ ID NO 50308
  misc_feature: Useful for making plants with altered carbohydrate content
  misc_feature: Functional homolog of the protein sequence given in SEQ ID NO 50310
  misc_feature: Useful for making plants with modulated water use efficiency
  misc_feature: Functional homolog of the protein sequence given in SEQ ID NO 51726
  misc_feature: Useful for making plants with altered cell wall content and/or composition
MSMSSAFMMSSKQQQQQAAPNNKRRAYVTFLAGDGDYWKGVVGLAKGLRRVRSAYPLVVAVLPDVPEEHRRKLRGQGCVVREIQPVYPPESQTQFAMAYYVINYSKLRIWELVEYERMVYLDADIQVFDNIDHLLDLDKGRFYAVMDCFCEKTWSHTPQYKIGYCQQCPERVPWPEQQLGPPPPP

SEQ ID NO: 46912 - DNA, 638 bp, Panicum virgatum
  misc_feature: Ceres CLONE 2033159
  misc_feature: Encodes the peptide sequence at SEQ ID NO. 46913
ttcgagagagctaatggtgagtcctcacatgtccttcgaatatttgatgacgaagcccaggcaatgcagtcagctcgcagctcctcacgtatgcttgaagaagcttacgatacaggtgtcgctatccttcacaaatatgcagaccaaagggaccgacttaagagtgctcaaaggaaagctttggatgtcctgaacactgttggtctatcaaactctgttttgaagcttatcgagaggcggcaccgcgtggacaaatggatcgcatatgctggcatgatcataaccatagttgtgatgattgctttttggcggttgacgcattagtgctgcactcttttatctttggagatatggtatgtgcatatcagggaaatatgccagatacacagatggtgagagtttgagcttgctcttgttggtcctatgtatgcaccattttggcctgttgatggcctcacaagtgtaaaagcagatccttcacagcatcgttaccggtcaacgcaagcatcggatgtggcttaagtattcaaattccttccttgtatgcacaccactgtgtagccattgctaagactttcatgtaagtgcccatgtttgtggctaacgcaaaagtacagtgccactgtctatttctgtac

SEQ ID NO: 46913 - protein, 107 aa, Panicum virgatum
  misc_feature: Ceres CLONE 2033159
  misc_feature: Functional homolog of the protein sequence given in SEQ ID NO 51727
  misc_feature: Useful for making plants with modulated nitrogen use efficiency
FERANGESSHVLRIFDDEAQAMQSARSSSRMLEEAYDTGVAILHKYADQRDRLKSAQRKALDVLNTVGLSNSVLKLIERRHRVDKWIAYAGMIITIVVMIAFWRLTH

SEQ ID NO: 46914 - DNA, 682 bp, Panicum virgatum
  misc_feature: Ceres CLONE 2033169
  misc_feature: Encodes the peptide sequence at SEQ ID NO. 46915
acttgcaaaatgcatcctttttcacctttgtggctttgcatcacagcaggtggcggttgaagcatcaccggctgtagcaagttcttgacagttctgtagcagactttgatatggaagtacttcctcctaccttgtcatctgcttgtgagcaaccacttctgtacgatggcacaaccagattctacatgtcgtacgtttgcccttatgcgcaacggacatggatcacaaggaattacaagggtttgcaggaggagatcgagctagttcccatggacatggcagataagcctgcatggtacaagaaggtttaccccaagaaccaggtgccagccttggagcacaacaagaagatcataggagagagcttggatctgatcaggtacatagataccaacttcgacggccctaagctgatcacaaatgatcctcaaaagcaaaggtttgcagaagaactgctgggatattcagatgctttcaacagggcaatgctcgacggactgagatccaaggggccagtgactgctgaagctgttgctgcactggacaaaatagacagctccctgtcgaaatttgattatggacctttcttcctaagtcaattcagtctggtggacattgcatatgcaccattcatcgacggatttcagatattttttgctggcataaagaattacgacatcac

SEQ ID NO: 46915 - protein, 190 aa, Panicum virgatum
  misc_feature: Ceres CLONE 2033169
  misc_feature: SWISSPROT Homolog: EC 2.5.1.18 Glutathione transferase
MEVLPPTLSSACEQPLLYDGTTRFYMSYVCPYAQRTWITRNYKGLQEEIELVPMDMADKPAWYKKVYPKNQVPALEHNKKIIGESLDLIRYIDTNFDGPKLITNDPQKQRFAEELLGYSDAFNRAMLDGLRSKGPVTAEAVAALDKIDSSLSKFDYGPFFLSQFSLVDIAYAPFIDGFQIFFAGIKNYDI

SEQ ID NO: 46916 - DNA, 613 bp, Panicum virgatum
  misc_feature: Ceres CLONE 2033176
  misc_feature: Encodes the peptide sequence at SEQ ID NO. 46917
ttatgcagcgcattcacaactatcactctgcaacaaaaatagtacaaggatatcaagcttgatatacctttgttcgtccaatggaagatattagcaatatattccacaatgatctactcccatctctaggagcaagagcaaaccaatctatcaagttgaagaaattcatcatttctccttatgatccgcgttacagaatctgggagatgttcttgcttgttcttgttgtttcctcagcatggatctgcccatttgaactagcatttctgagacatctctcatgggaactttttcttgttgagactattgtcgatagcatcttcgcaatcgatatcattctcactttttttatagcatatctggatcagaaatcgtatcttctagtggataatccaaaaaggattgcagctagatatatctcctcgtggttcatatttgacgtttgttcaacaattccatatcaaccattcgggctactatttaaaaaacatgcaaatggccttgcctataggatgcttgacatgcttcggttatggcgcctccgacgcctcagtgctttatttgccaggctcgaaaaggatatcagattgaattactactggataagatgcat

SEQ ID NO: 46917 - protein, 177 aa, Panicum virgatum
  misc_feature: Ceres CLONE 2033176
  misc_feature: The sequence is a functional homolog of SEQ ID NO 1838 in the 10/374,780 US patent application
MEDISNIFHNDLLPSLGARANQSIKLKKFIISPYDPRYRIWEMFLLVLVVSSAWICPFELAFLRHLSWELFLVETIVDSIFAIDIILTFFIAYLDQKSYLLVDNPKRIAARYISSWFIFDVCSTIPYQPFGLLFKKHANGLAYRMLDMLRLWRLRRLSALFARLEKDIRLNYYWIRC

SEQ ID NO: 46918 - DNA, 658 bp, Panicum virgatum
  misc_feature: Ceres CLONE 2033184
  misc_feature: Encodes the peptide sequence at SEQ ID NO. 46919
gcgcgtggtctcgtcccgttccagaacactcccgtgcaggtgcgcgcgctctactggcatggcgagcggcggcggcggcgctgcggcgcggatggacccggaggcggcgacggagctggtgcgaaagggctccacgctcctcctgctcgacgtccctcagcgcacgctcttcggaatcgatacgcaggtgttctctgtcgggcccaagttcaaagggatgaagatggtgcctccggggccccatttcgtctactactgctcctccagcaggagtgggaatgagtttgcgcctactgtcggtttctttcttattactcaaccatctgaggtgattgttcgaaagtgggatgcacaagaggagaggttaatcaaattgtcagaagaggaggaaatcagatactctgaagcagtaaggcgctttgagtttgatgatcagcttggaccatacaatttggattcttacggagattggaaacaactttcaagctacttgtcacagagtgccattgagcgtcttgaaccaattggaggggaaattacaattgcgttggagtcatcatggatggataaagctccccaaagtgacatggagagacgcttgatggaacaattgagagagagcaagtttacaaaaaccgctcctgtgcaagctgagcgg

SEQ ID NO: 46919 - protein, 199 aa, Panicum virgatum
  misc_feature: Ceres CLONE 2033184
  misc_feature (12)..(199): Pfam Name: AAR2 Pfam Description: AAR2 protein
MASGGGGAAARMDPEAATELVRKGSTLLLLDVPQRTLFGIDTQVFSVGPKFKGMKMVPPGPHFVYYCSSSRSGNEFAPTVGFFLITQPSEVIVRKWDAQEERLIKLSEEEEIRYSEAVRRFEFDDQLGPYNLDSYGDWKQLSSYLSQSAIERLEPIGGEITIALESSWMDKAPQSDMERRLMEQLRESKFTKTAPVQAE

SEQ ID NO: 46920 - DNA, 727 bp, Panicum virgatum
  misc_feature: Ceres CLONE 2033227
  misc_feature: Encodes the peptide sequence at SEQ ID NO. 46921
ctctggttctgctctcccacacatctttcctatcgataggcgaggggcgacgacgcaaaggcgagtggcgccgcccctgccagttcttcgtctcgtcgccggccgacaaggtatcaaagcttgccatcgtgctcaacctcatccaagcgggggtcatcggtgaagaattgctttagcttccgtgctcatttaaggaaagagggttcacgctggataaggtctgagcctttcttgtcagcaaatagtgcaaagttcgtcagcaagaggacatccttttcagttgcaacagagccgcctcctgctgcaaccgaaaaaccagagatggatgctcccaaggaaatattcttgaaagattacaggaaacctgattatttgtttgacaaggtggatttgcaatttcaacttggtgaagaaaagacaatagttacatctaaaatagttgtatctcctggtgttgaaggaagcatctcagctccactagttcttcatggttgtgacctgaagctgttgtcaatcaaagttaatggcaccgagctaaagggcgaagagtataccgttgattcacgccatctgacggtttcaacaccgcctgctggtgtattcaacttggaaattgttacggaaatatatcctcagctaaacacatctttggaggggctgtacaagtcaactggtaacttctgcactcagtgtgaagcagaagggttccggaagattacttactttc

SEQ ID NO: 46921 - protein, 135 aa, Panicum virgatum
  misc_feature: Ceres CLONE 2033227
  misc_feature: SWISSPROT Homolog: EC 3.4.11.2 Membrane alanyl aminopeptidase
MDAPKEIFLKDYRKPDYLFDKVDLQFQLGEEKTIVTSKIVVSPGVEGSISAPLVLHGCDLKLLSIKVNGTELKGEEYTVDSRHLTVSTPPAGVFNLEIVTEIYPQLNTSLEGLYKSTGNFCTQCEAEGFRKITYF

SEQ ID NO: 46922 - DNA, 696 bp, Panicum virgatum
  misc_feature: Ceres CLONE 2033241
  misc_feature: Encodes the peptide sequence at SEQ ID NO. 46923
aaagggtaaagcgggtcgcgcgagtgccccctctccccctgcttttgctccaatcgcggcgccgccccgcgcgagatccgccccgcgtgccccgccgccagcgccgccgccgagatagaggtgccgtccccagcatcgtgttcaacggagagttgttgatttggatacctgatccaattgaggtggattgagtgatttgaccgtttcaacatcccgccgtgcctgcttcctttgatcaggataagaggcttggccggttccagagatgatgccattgtgattggggatggattctgctagaagttggttccagaagttccagccgagggacaaatcgaagtctcctgcagtggctgccagccatggaaaggatccaggaaagcccccgatggatgacgccccttctagtgccacaaaacagagggttgctgcggcaaagcagtacattgagaaccactacaagacccagatgaagtccctgcaagataggaaagagaggcgctggatgttggagagaaaattacaagatgctgaagttcctgtagaagagcaaaataatattttgaagcatttggaaaaaaaggagactgaatacatgcgtttgcagagacacaagatgggagttgaagatttcgaacttttgactattattgggagaggtgcatttggagaggtgcgtctttgtagagagaagac

SEQ ID NO: 46923 - protein, 136 aa, Panicum virgatum
  misc_feature: Ceres CLONE 2033241
  misc_feature: SWISSPROT Homolog: EC 2.7.11.1 Non-specific serine/threonine protein kinase
MDSARSWFQKFQPRDKSKSPAVAASHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREK

SEQ ID NO: 46924 - DNA, 681 bp, Panicum virgatum
  misc_feature: Ceres CLONE 2033243
  misc_feature: Encodes the peptide sequence at SEQ ID NO. 46925
acaccgatcactcgctgctcccctccctcgccggagcccagggatggcggcagcagctgctcccgccgccgcgatcgcgtgatggaagccgacgccgccgctctccgccgatggacgaagccggaagggcatccgctcccgcggcggtgacggtctccgccaccgccgcacccgcgcaccccccgccctccgccacggccgccgccgctgccgccaccgacacgtcctcccccgacccctccgcgctctatggagaggggatgtgggaacagatggccatgagcagcggtgccacaatgcaacctgggccatatcctgagcggccgggtgaaccggactgcacatactatctcagaactggattgtgtagatttggcatgagctgtaggttcaatcaccctccggataggaatctggctattgcctctgccagaatgaagggagaatatcctgagagagtgggacaaccagaatgtcagtattatctgaagacaggaacatgcaagtttggccctacatgcaaatttcaccatcccagggaaaaggctggaattgcaggaagggtgcagctaaacacattatgatatccactccgcccgaacgaataagagtgtgcatattatttaaaaacaggacagtgtaaatatgcgaatacttgtaaattccaccatccagaacttt

SEQ ID NO: 46925 - protein, 157 aa, Panicum virgatum
  misc_feature: Ceres CLONE 2033243
  misc_feature (72)..(98): Pfam Name: zf-CCCH Pfam Description: Zinc finger C-x8-C-x5-C-x3-H type (and similar)
  misc_feature (117)..(143): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
MDEAGRASAPAAVTVSATAAPAHPPPSATAAAAAATDTSSPDPSALYGEGMWEQMAMSSGATMQPGPYPERPGEPDCTYYLRTGLCRFGMSCRFNHPPDRNLAIASARMKGEYPERVGQPECQYYLKTGTCKFGPTCKFHHPREKAGIAGRVQLNTL

SEQ ID NO: 46926 - DNA, 759 bp, Panicum virgatum
  misc_feature: Ceres CLONE 2033263
  misc_feature: Encodes the peptide sequence at SEQ ID NO. 46927
atcttcacaacaaggtaagcatagtcagtcaggagcctacactctttaactgcaccatcgaagagaacattgcttatggattagagggcaaaactaactttgctgatgttgagagcgcagcaaaaatggcgaacgcacacaacttcatatgcagctttccggaccaatacaagaccgtagttggcgagcgagggatcaggttatccggggggcagaagcagaggatcgctattgctagagctttgcttatgaacccacgagtgcttctcctggatgaggctaccagtgccctggacgccgagagtgaatatcttgtccaggacgcaatggactcgttgatgaaggggagaaccgttcttgtgatagctcaccggctctcgaccgtgaagagtgccgacaccgtcgccgtcatctccgacggccaaattgtggagagcggcacgcacgacgagctcctcgcccgcgacggcatctacaccgccttggtgaagaggcagctgcaagggccgaagttcgaggccaccagcagcatcagtgaggcaggcgaaatacaagccgaacccagcagcaatgggcaatagcccttcgcgctgataggtgccctggccccctccaagttagtcaggccacagttgattcgaaccccactgaattatatgtaaccctgatcctgatgtatgccacactatgaaacattttagatgtcacacgacgctacagaatgttgcaggagtaaagggtagtcctacatgattagtt

SEQ ID NO: 46927 - protein, 192 aa, Panicum virgatum
  misc_feature: Ceres CLONE 2033263
  misc_feature (2)..(140): Pfam Name: ABC_tran Pfam Description: ABC transporter
  misc_feature: SWISSPROT Homolog: EC 3.6.3.44 Xenobiotic-transporting ATPase
  misc_feature: The sequence is a functional homolog of SEQ ID NO 3 in US patent 7041874
LHNKVSIVSQEPTLFNCTIEENIAYGLEGKTNFADVESAAKMANAHNFICSFPDQYKTVVGERGIRLSGGQKQRIAIARALLMNPRVLLLDEATSALDAESEYLVQDAMDSLMKGRTVLVIAHRLSTVKSADTVAVISDGQIVESGTHDELLARDGIYTALVKRQLQGPKFEATSSISEAGEIQAEPSSNGQ

SEQ ID NO: 46928 - DNA, 684 bp, Panicum virgatum
  misc_feature: Ceres CLONE 2033264
  misc_feature: Encodes the peptide sequence at SEQ ID NO. 46929
gaagaacaaatctgccgacgggcagcccggcctcctgcagttcggctccagcacttccgagattcttgagactgcatttaagaaggaaacagttggtctcgtcacgagagagcagtatgtggaaaagagggttaacatccgaaccaagatcgaggaggaagagaaagagaaacttcagaagttacaacaagaagaagaagaattacaaatgcagaaaaggaaaaagaggagagtgaagggtgatccacgattatctttctgtgacgacattgagaatggaagtgatgaagatgattttgagaatcaagaaactcaaaagaaaaatggccctatcaaacttggaaaagatccaactgtcgagacaagttttctaccagacagagagagggaggcagaggaacaggcagaacgagaacgactgaagaagcagtggttgcgtgagcaggagttgatcaaaaatgaacctctctcaattacctacagttactgggatgggactgggcacaggagagttatccaggttcgtaaaggtgacactattggagaattcctaagggctgttcaacagcaacttgcccctgagttccgtgaagtacggacaacgtcagttgagaaccttctttatgtgaaggaggatcttatcattcctcatcaacacagcttctatgaatttaattattaaca

SEQ ID NO: 46929 - protein, 226 aa, Panicum virgatum
  misc_feature: Ceres CLONE 2033264
  misc_feature (73)..(225): Pfam Name: XAP5 Pfam Description: XAP5 protein
KNKSADGQPGLLQFGSSTSEILETAFKKETVGLVTREQYVEKRVNIRTKIEEEEKEKLQKLQQEEEELQMQKRKKRRVKGDPRLSFCDDIENGSDEDDFENQETQKKNGPIKLGKDPTVETSFLPDREREAEEQAERERLKKQWLREQELIKNEPLSITYSYWDGTGHRRVIQVRKGDTIGEFLRAVQQQLAPEFREVRTTSVENLLYVKEDLIIPHQHSFYEFNY

SEQ ID NO: 46930 - DNA, 694 bp, Panicum virgatum
  misc_feature: Ceres CLONE 2033272
  misc_feature: Encodes the peptide sequence at SEQ ID NO. 46931
atcgatttcctctgttcctcaacgcgtgcgtgctctgacccagcaactctgctgctaggatcggagtagattttttgttcgtcccgtttcttttttctcgaccagatcgccatggctgggaagggcgacgggccggcgatcggcatcgaccttggcacgacctactcgtgtgtcggcgtgtggcagcatgaccgcgtcgagatcatcgccaacgaccagggcaaccgcaccacgccgtcctatgtggccttcacggacaccgagaggctcatcggcgacgccgccaagaaccaggtcgccatgaaccccatcaacaccgtcttcgatgcgaagcggctcatcggccgtcggttctcggacgcggcggtgcagagcgacatgaagcactggccgttcaaggtggtccccggccccgccgacaagcccatgatcggcgtccagttcaagggcgaggagaagcagttctctgccgaggagatctcctccatggtgctgaacaagatgaaggagacggccgaggcctacctcggcaccacgattaagaacgccgtggtcaccgtccccgcctacttcaacgactcgcagcgccaggccaccaaggacgccggcgtcatctccggcctcaacgtcatgcgcatcatcaacgagccgaccgccgccgccatcgcctacgggctcgacaagaagtcgagca

SEQ ID NO: 46931 - protein, 194 aa, Panicum virgatum
  misc_feature: Ceres CLONE 2033272
  misc_feature (9)..(194): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGDGPAIGIDLGTTYSCVGVWQHDRVEIIANDQGNRTTPSYVAFTDTERLIGDAAKNQVAMNPINTVFDAKRLIGRRFSDAAVQSDMKHWPFKVVPGPADKPMIGVQFKGEEKQFSAEEISSMVLNKMKETAEAYLGTTIKNAVVTVPAYFNDSQRQATKDAGVISGLNVMRIINEPTAAAIAYGLDKKSS

SEQ ID NO: 46932 - DNA, 699 bp, Panicum virgatum
  misc_feature: Ceres CLONE 2033276
  misc_feature: Encodes the peptide sequence at SEQ ID NO. 46933
tcctttgcacccctagtactgatcctcctccccgcgctcttcgcaagacatagaagaatcccctactactagtactactactactactactcatgcatgagcaccgcctcctcgcgccgcatatgaatcagacatgaataggggccacagcagcagctcctcgaagctcatcaacgagaagcttgaggaacaccggatctccaccgccaagcactgcccccactgcggcgagaaaatcgacagcaagccggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgaccagggatggcctgagcaagcacttcttccaccggccatcaaaggcctatacgacgggcacgaggaagaggaggaagatacagacggagtgcgacgtccacaagggcgagacgaggtggcacaagaccggaaagacgcggccggtaatggtgaacggccggcagaaggggtgcaagaagattctggtgctgtacaccaacttcggcaagcaccgcaagccggagaagacgaactgggtgatgcaccagtaccacctcggcgacct

SEQ ID NO: 46933 - protein, 188 aa, Panicum virgatum
  misc_feature: Ceres CLONE 2033276
  misc_feature (44)..(187): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 1713 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Functional homolog of the protein sequence given in SEQ ID NO 50710
  misc_feature: Useful for making plants with altered carbohydrate content
  misc_feature: The sequence is a functional homolog of SEQ ID NO 562 in the 11/435,388 US patent application
MNRGHSSSSSKLINEKLEEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGD

SEQ ID NO: 46934 - DNA, 645 bp, Panicum virgatum
  misc_feature: Ceres CLONE 2033280
  misc_feature: Encodes the peptide sequence at SEQ ID NO. 46935
accagcagcagcagcagctcactctcgcctcgcctccgcggcacggggagccatgcagcccgacgccaactccccctcgctccgcctcgcccgcgtcgccgcgcacctcaacccgcagcgcccgcagatggaggaggagggcgcgccggcgctgaggcccgcggcgtgccgcgccaagggcggcgcgccggggttcaaggtcgccatcctgggggcggcgggagggatcggccagccgctgtcgatgctcatgaagatgaacccgctcgtgtccgtgctgcacctctacgatgtcgtcaacacgcccggggtcaccgccgatgtcagccacatggacaccggcgccgtggttcggggcttccttggggcacaacagcttgatgcagcacttacaggaatggaccttgttatcatacccgctggcctccctaggaaacctggaatgacaagggatgatttattcaacaagaatgccgcgattgttcgcatactttgtgaaggagttgccagatgctgtcctgatgcgattgtgaatttgatcagcaacccagtgaactcaactgtacccattgctgctgaggtttttaagaaagctggaacatataatcccaagcgtctccttggagtcacaacacttgatgttgt

SEQ ID NO: 46935 - protein, 197 aa, Panicum virgatum
  misc_feature: Ceres CLONE 2033280
  misc_feature (48)..(191): Pfam Name: Ldh_1_N Pfam Description: lactate/malate dehydrogenase, NAD binding domain
  misc_feature: SWISSPROT Homolog: EC 1.1.1.37 Malate dehydrogenase
MQPDANSPSLRLARVAAHLNPQRPQMEEEGAPALRPAACRAKGGAPGFKVAILGAAGGIGQPLSMLMKMNPLVSVLHLYDVVNTPGVTADVSHMDTGAVVRGFLGAQQLDAALTGMDLVIIPAGLPRKPGMTRDDLFNKNAAIVRILCEGVARCCPDAIVNLISNPVNSTVPIAAEVFKKAGTYNPKRLLGVTTLDV

SEQ ID NO: 46936 - DNA, 709 bp, Panicum virgatum
  misc_feature: Ceres CLONE 2033337
  misc_feature: Encodes the peptide sequence at SEQ ID NO. 46937
agagcgcggtcgagagagagcggccatcggcgagcctgacctgacgggagggtcccctacctcgccggcggcggagccgagatggtggctgcggagggcaataggtggcggttcgccatggtgtgctcgtccaacatgaaccggagcatggaggcgcactcgcagctggggcgcgcggggctcgacgtcgagtcctacggcaccggcacccacgtcaagctccccgggccctccctccacgagcccaacgtctacgacttcggcaccccctacggcgccatctacgacgatctccgccgcaaggaccccgacctgtacaagaggaacgggctgctgccaatgctgaagaggaacacctcggtgaagctggcacctcagcggtggcaggacaatgctggcgatggagtgtttgatatgataatgacctttgaggagagggtctttgacttggtcgttgaagatatgaataaccgcgagccaaagctgatgaagagcgtgctgataatcaatatggatgtcaaagataaccacgaagaagctggtgttggggcaaagcttgctgtagagttgtgccagaagcttgaagcaattgatggtgactgggaggaaattatcgatgacctgattactggattcgagaagcagcacaagcggaggcttgcatacagcattgcattctactaacttgtatagctcctgtgtgggacac

SEQ ID NO: 46937 - protein, 200 aa, Panicum virgatum
  misc_feature: Ceres CLONE 2033337
  misc_feature (7)..(200): Pfam Name: Ssu72 Pfam Description: Ssu72-like protein
  misc_feature: SWISSPROT Homolog: EC 3.1.3.16 Phosphoprotein phosphatase
MVAAEGNRWRFAMVCSSNMNRSMEAHSQLGRAGLDVESYGTGTHVKLPGPSLHEPNVYDFGTPYGAIYDDLRRKDPDLYKRNGLLPMLKRNTSVKLAPQRWQDNAGDGVFDMIMTFEERVFDLVVEDMNNREPKLMKSVLIINMDVKDNHEEAGVGAKLAVELCQKLEAIDGDWEEIIDDLITGFEKQHKRRLAYSIAFY

SEQ ID NO: 46938 - DNA, 746 bp, Panicum virgatum
  misc_feature: Ceres CLONE 2033347
  misc_feature: Encodes the peptide sequence at SEQ ID NO. 46939
cgcaacccaccgccaggaaggctcgcggctccccgtcgaccccgagcgtccggccgcgcggcccctccatgcgccgctgatcgcgcgcgtgagcgatcaagccagctaccccaggggaaggatcagagcgcgggcggcgcagctcacctcagctctgccgccgccggccggccggcagctaggtagctagcagccatgtacgcggcgaaccactggggcgggtcgttcgagatcgccgacggggcggcggaggacgaccacagccgcaacatggacctggaccgcggcgcgctgtcgcggcagcagcaccacgagctggacgagacgcagcagagctggctgctcggcccgccggaggccaagaagaaggacaagtacgtcgacctcggctgcgtcgtcgtcaagcgcaagctcctgtggtgggccttctggtgcgtcgtcggcgccttcgtcctcatcggcctccccatcatcatcgccaagtccatcccccacaagaaacacggcccgccgccgcccgaccagtacaccgaggcgctccacaaggcgctccgcttcttcaacgcccagaaatccggccggcttccgaagaacaacggcgtcccgtggcgcgggaactccggcctgtcggacggctccgacgccaaggatgtcaagggcggcctcgtcggcggctactacgacgccggcgacaacatcaagttccacttcccgatgggcttctccatgacgatgctcagctggtc

SEQ ID NO: 46939 - protein, 183 aa, Panicum virgatum
  misc_feature: Ceres CLONE 2033347
  misc_feature: SWISSPROT Homolog: EC 3.2.1.4 Cellulase
  misc_feature: Functional homolog of the protein sequence given in SEQ ID NO 50501
  misc_feature: Useful for making plants with altered carbohydrate content
  misc_feature: Functional homolog of the protein sequence given in SEQ ID NO 50500
  misc_feature: Useful for making plants with altered cell wall content and/or composition
MYAANHWGGSFEIADGAAEDDHSRNMDLDRGALSRQQHHELDETQQSWLLGPPEAKKKDKYVDLGCVVVKRKLLWWAFWCVVGAFVLIGLPIIIAKSIPHKKHGPPPPDQYTEALHKALRFFNAQKSGRLPKNNGVPWRGNSGLSDGSDAKDVKGGLVGGYYDAGDNIKFHFPMGFSMTMLSW

SEQ ID NO: 46940 - DNA, 693 bp, Panicum virgatum
  misc_feature: Ceres CLONE 2033351
  misc_feature: Encodes the peptide sequence at SEQ ID NO. 46941
gggcatacgaatatagcatgcgatagattgacttacatattacatacaaaatctaggcaacatgcatgtcatatttaaatcatacattttgttttcatgcaacagtttacaaaagaacttacattgcagcaagcacccattaatgaactgtatgcaattgttccaacgtgtaaaccttttgctcttgcatctttcattatctcactcccccgttagtctaatttgtcagtatccatatatgtgttcaatttgtctgtgcagagtcagatcattaccggtgatcgtgttcctgccgcctctggtttctgtgcgagagctcttccgatgaggggtttctccacggtgggaaatgctgaggttgcttcagacgatgaggattccagctctccagcggttgctcaccccccacggattaagttcaagaggctcgataagactgccaggcacatcatgaatatcttgaacaaagaggcagttgaaaaggtccgctctgagagggagattcctgatgtacaacctggatgtatcattcaaatgagattgcaagttcctgagaacaaacggcgagaatctacattgaaagggattgtgataggaaggcgtaatgctgggatcaatacaactttcagacttcgtagattagtagctggtattggagttgagtctgtcttttcactctactcaccgaacatc

SEQ ID NO: 46941 - protein, 122 aa, Panicum virgatum
  misc_feature: Ceres CLONE 2033351
  misc_feature (43)..(122): Pfam Name: Ribosomal_L19 Pfam Description: Ribosomal protein L19
MRGFSTVGNAEVASDDEDSSSPAVAHPPRIKFKRLDKTARHIMNILNKEAVEKVRSEREIPDVQPGCIIQMRLQVPENKRRESTLKGIVIGRRNAGINTTFRLRRLVAGIGVESVFSLYSPN

SEQ ID NO: 46942 - DNA, 726 bp, Panicum virgatum
  misc_feature: Ceres CLONE 2033399
  misc_feature: Encodes the peptide sequence at SEQ ID NO. 46943
aaaccgcaagaaaaccgagcagcaacgtaattcccgtttctgccctccgccgtctcccctccccttaccctccccaactcgccgtcgccgcgcgcgcacgcacggaaccgccgtgctatcatcgccggcggcaaccaccacgtgcggggtggaatcaatcttgaagcaacctcgcggaagagaaaggaaaaagaaaagagagaaataggaggaccgcgagaagcaacagcaagcaggagcgtggggggtaggtgggaaacggagcagaggtagcccaattcgccgcctcgccggccgctgacctcgccgccggcggggtcccctctgccggagccgacggatccctgcccctctctgatccgagcctgatcagcccatgggaactccagttaacatcatcgttggttctcatgtttgggtagaagacccaactctagcttggatagatggggaggttgttagcataaaaaacaatgaagtacatgtgcaaacatcaaatgggaaaaaggttaccatagacagatcaaaagtttttcccaaggatatggaagctccacctggaggagttgatgatatgacaagactgtcatacttacatgaacctggtgttcttcagaatcttgctacccgctatgaactgaatgaaatatatacttacacaggcagcattttgattgctgtaaatccatttcaaaagatgccacatctttatgatacccacatgag

SEQ ID NO: 46943 - protein, 116 aa, Panicum virgatum
  misc_feature: Ceres CLONE 2033399
  misc_feature (10)..(51): Pfam Name: Myosin_N Pfam Description: Myosin N-terminal SH3-like domain
  misc_feature: SWISSPROT Homolog: EC 2.7.11.1 Non-specific serine/threonine protein kinase
MGTPVNIIVGSHVWVEDPTLAWIDGEVVSIKNNEVHVQTSNGKKVTIDRSKVFPKDMEAPPGGVDDMTRLSYLHEPGVLQNLATRYELNEIYTYTGSILIAVNPFQKMPHLYDTHM

SEQ ID NO: 46944 - DNA, 1404 bp, Panicum virgatum
  misc_feature: Ceres CLONE 2033421
  misc_feature: Encodes the peptide sequence at SEQ ID NO. 46945
acgaaaccttggcgcacgcggacaattctaacaccttcagagccccccaaacgtgctacgcccctgctcgcgagcgtccgggggggcaccaccgcaccaccacacccgcgagagcaatggagaccgtcgcggcggcgagctacgccggcgcggccaccggcgccacgcgctccctggcctgctgcgccgccatgtccttctcgcagtcgtacaggcccaaggcgtccaggccgccgacggcgttctacggcgagtcggtgcgggtgaacacggcgcggccgctcgcggcgaggcagaccaaggcggcgagccgcgcggcgctcagcgcgcggtgcgagatcggcgacagcctggaggagttcctgaccaaggcgacgccggacaagaacctcatcaggctgctcacctgcatgggggaggccatgaggacgatcgcgttcaaggtccggacggcgtcctgcggcggcacggcctgcgtcaactccttcggcgacgagcagctcgccgtcgacatgctcgccaacaagctcctcttcgatgctctggagtactcccatgtgtgcaagtatgcgtgctctgaggaagtccccgagctgcaagacatgggtggcccagttgacggtggcttcagcgtcgcgttcgatccccttgacggttccagcattgtcgacacgaacttcaccgtcggaaccatcttcggtgtctggcccggcgacaagctgacgggcgtcaccggcggcgaccaggtcgccgctgcgatgggcatctacggcccccgcacgacctacgttatcgccctcaaggactgccccgggacacacgagttcctcctcctcgacgaaggtaaatggcagcatgtcaaggacaccacctccattggggaggggaagatgttctctcctggtaatttgagggcaacatttgacaaccctgagtacgacaagctcatcaactactacgtcaaggagaagtacacattgcgttacactggaggaatggttccagatgtcaaccagatcatagtgaaggagaagggcatcttcaccaacgtgacgtccccgtccgccaaggccaagctgcggctcctcttcgaggtggcgccgctggggctcctgatcgagaaggccggcgggcacagcagcgacggcaagcagtcggtgctggacaaggtgatcaacgagctcgacgagcgcacccaggtggcctacggctccaagaacgagatcatccggttcgaggagaccctctacggctcgtccaggctcgccgccggcgccaccgtcggcgcggccgcctgagtttttgctgcgatgcgtgcaagccgtgtgccgccattttgaatccatttggtggtgatgcctatacagatgagcttgtagaactctcctgcaaagtaatttttgc

SEQ ID NO: 46945 - protein, 393 aa, Panicum virgatum
  misc_feature: Ceres CLONE 2033421
  misc_feature (67)..(380): Pfam Name: FBPase Pfam Description: Fructose-1-6-bisphosphatase
  misc_feature: SWISSPROT Homolog: EC 3.1.3.37 Sedoheptulose-bisphosphatase
  misc_feature: Functional homolog of the protein sequence given in SEQ ID NO 50986
  misc_feature: Useful for making plants with modulated biomass
  misc_feature: Functional homolog of the protein sequence given in SEQ ID NO 51728
  misc_feature: Useful for making plants with modulated light quality response
METVAAASYAGAATGATRSLACCAAMSFSQSYRPKASRPPTAFYGESVRVNTARPLAARQTKAASRAALSARCEIGDSLEEFLTKATPDKNLIRLLTCMGEAMRTIAFKVRTASCGGTACVNSFGDEQLAVDMLANKLLFDALEYSHVCKYACSEEVPELQDMGGPVDGGFSVAFDPLDGSSIVDTNFTVGTIFGVWPGDKLTGVTGGDQVAAAMGIYGPRTTYVIALKDCPGTHEFLLLDEGKWQHVKDTTSIGEGKMFSPGNLRATFDNPEYDKLINYYVKEKYTLRYTGGMVPDVNQIIVKEKGIFTNVTSPSAKAKLRLLFEVAPLGLLIEKAGGHSSDGKQSVLDKVINELDERTQVAYGSKNEIIRFEETLYGSSRLAAGATVGAAA

SEQ ID NO: 46946 - DNA, 739 bp, Panicum virgatum
  misc_feature: Ceres CLONE 2033426
  misc_feature: Encodes the peptide sequence at SEQ ID NO. 46947
acggcacagatccctctcctctccctttctctctcctcgacccttccgacgcggcaaagcaaaaacacagggaggagagggagagagaaagagggagcaggagcccgaaatccgaactccaaccccaaatcctggtccaatctctcaatcaggggagcctcggggtctgatcgggtcgggggattcgggggcgcagccatgaacgagaaggcgtccgtatccaaggagctcaacgccaagcacaagaagatattagaaggtcttcttcggctgcctgagaacagagaatgcgcagactgcaagtcaaagggtcctcgatgggcgagtgtgaatctagggatctttatatgtatgacatgttctggaattcatagaagccttggggtgcacatatctaaggtaagatctgccaccctggatacatggctgccagagcaagttgcatttattcaatcaatgggaaatgaaaaggcaaacagctattgggaagcagagctgcctcctaactatgatagggttggaatagagaatttcatccgtgcaaaatacgaggacaagagatgggtaccgaggaatggaacgtcacgaccttcctccggtgttcgagatgagaagagccaagagtctccggctagtgctaacaggagtggatatggtcacagatcttcatttgagcaaaaccgtacttcaccagcttcgagcaaaactgcacctgcagcttcaaagatgccctctccag

SEQ ID NO: 46947 - protein, 180 aa, Panicum virgatum
  misc_feature: Ceres CLONE 2033426
  misc_feature (16)..(130): Pfam Name: ArfGap Pfam Description: Putative GTPase activating protein for Arf
  misc_feature: Functional homolog of the protein sequence given in SEQ ID NO 51347
  misc_feature: Useful for making plants with altered terpenoid content
  misc_feature: Useful for making plants with modulated nitrogen use efficiency
MNEKASVSKELNAKHKKILEGLLRLPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSRPSSGVRDEKSQESPASANRSGYGHRSSFEQNRTSPASSKTAPAASKMPSP

SEQ ID NO: 46948 - DNA, 679 bp, Panicum virgatum
  misc_feature: Ceres CLONE 2033431
  misc_feature: Encodes the peptide sequence at SEQ ID NO. 46949
attctcaaggaatctattctgagaacctcttcccacactttccccttcacccttgagaggccatctccaattcatcaccctgctattccttcatactcaggccatcatcatacgagatttgacaatcagcaaggactggtaagaagatgctgaagaaattgttgccaaagactaagagcaaatctgcgatacccacgttggatcggctccatgagactctagaaatgctggagaagaaagagtgtttccttcagaaaaagtgttctgctgaaatagaaaaggctaaggattatacaaaatcgaagaataagaatgctgcaattcagtgtctaaagaaaaagaagctgtacgagacacaaattgaacagctatcaaattttcaattgcgagttcatgaccagattataatgcttgaaagtgcaaaggcaactaccgatactgttgatgctttgcgttctggatcatctgctgtcaaagctattcagcaatcactggacatcgatgatattgagaacgccattgatgaggcaaacggacagacagaaaatatgaggcagatacaagaggcacttgcaacaccagttggtgcttctgctgattttgacgaggatgagctagaagcagagctggaagatctggaggaggaagagctcgacgaagagttgcccgcaccaccagc

SEQ ID NO: 46949 - protein, 177 aa, Panicum virgatum
  misc_feature: Ceres CLONE 2033431
  misc_feature (16)..(177): Pfam Name: Snf7 Pfam Description: Snf7
MLKKLLPKTKSKSAIPTLDRLHETLEMLEKKECFLQKKCSAEIEKAKDYTKSKNKNAAIQCLKKKKLYETQIEQLSNFQLRVHDQIIMLESAKATTDTVDALRSGSSAVKAIQQSLDIDDIENAIDEANGQTENMRQIQEALATPVGASADFDEDELEAELEDLEEEELDEELPAPP

SEQ ID NO: 46950 - DNA, 365 bp, Panicum virgatum
  misc_feature: Ceres CLONE 2033438
  misc_feature: Encodes the peptide sequence at SEQ ID NO. 46951
tgagccacgtcgtacatccgctggccagcaagtctagccacagagtccgatcccgatttgtttcgtttccccatccttgcggccgctccaccgccgccgccctccgctccggccgccgaggtcaccgattcagatccaggacccgagagatggacgcgagcaggcgccagagcgggatccagcagctgctggccgcggagcaggaggcgcagcagatcgtcaatgcggccagggctgctaagtcggcaaggcttaggcaagcgaaagaggagagtgtgaggagtgattggtatgtacattaatgacaggggaggttaagggtagagattgtttgatcagtatatatccgttctgtgccttttatt

SEQ ID NO: 46951 - protein, 50 aa, Panicum virgatum
  misc_feature: Ceres CLONE 2033438
  misc_feature: SWISSPROT Homolog: EC 3.6.3.14 H(+)-transporting two-sector ATPase
MDASRRQSGIQQLLAAEQEAQQIVNAARAAKSARLRQAKEESVRSDWYVH

SEQ ID NO: 46952 - DNA, 571 bp, Panicum virgatum
  misc_feature: Ceres CLONE 2033439
  misc_feature: Encodes the peptide sequence at SEQ ID NO. 46953
actcacccagtcaagcagtcacccacctccaaatctcagcgccgctcccagatccaggatgtcctcctcctccgaccaggacgacgcccccgacggcggcgaggactcgcccctcttccgccgccgcgcccaaggctcctcccccggcgtcgccgacgtccccgtcgcgcagtcgctcatcaaggcggccagcaacgtctgcttctccctcttcgtgctcgccgtcctcgtcgtcaccgtcgtcgccgtcacctatcagccgccggacccctggctccagtcctccgccgccatcaccacctctctctcccgcgtcctccccaactccaccttcctcgtccccgacgactcgctcctccccaccggcgaggacttcaactcctcctccgccgtccccccgcgggcacgcgccgacgccaaccaggacgacgcggccgcggccatcgccgccgcctccgccgccgccgcggccaacgcgacctgcgacccggacgcgccgctcaactgctccgacccgcgcgtgctcgccgcggtcaaggcgttcaacgccaaggccttcttccgcaagtcc

SEQ ID NO: 46953 - protein, 170 aa, Panicum virgatum
  misc_feature: Ceres CLONE 2033439
  misc_feature: Functional homolog of the protein sequence given in SEQ ID NO 50635
  misc_feature: Useful for making plants with modulated light quality sensitivity
MSSSSDQDDAPDGGEDSPLFRRRAQGSSPGVADVPVAQSLIKAASNVCFSLFVLAVLVVTVVAVTYQPPDPWLQSSAAITTSLSRVLPNSTFLVPDDSLLPTGEDFNSSSAVPPRARADANQDDAAAAIAAASAAAAANATCDPDAPLNCSDPRVLAAVKAFNAKAFFRK

SEQ ID NO: 46954 - DNA, 673 bp, Panicum virgatum
  misc_feature: Ceres CLONE 2033440
  misc_feature: Encodes the peptide sequence at SEQ ID NO. 46955
atcactcccaagctgcaattccacactgatgccttgctcgcctaagttattgtctccctaattaagctagagctagctaacaatggccgccgcacctgcacgcaccttctccacgtcctccgtggaccctcttcccgtttcagcttcgctgccggcaaccagaaacaacgaccagcgaggccgcccccgtggccgttccatcatcgcttcggcggcggcgtcgaaaacgctgctgcccagtgatgattttgacctccagctccaggagggcctgacaagcgtgcaaaagactctgcaggaacgtaggaacagcgcccgggagatgatggccaccatcgacaacctcaagcgcctctgcatcgaccactacttccaggaagagatccagagcgccatgggcgcgtgcttggatctcatccacagcgatgatctcttcgatgcgacacttgcattcaagctcgtgagagaggccggccatgatgtttcagcagatgatgttctacggaggttcactaacgacaccggcgagttcaagcttgctcttagcaaagacatcagagggctcctgagcctccacgacatgtcacacctggacatgggagaggagccatcactgcacaaggcaaaggagttctcaagcaagcaccttgcatctgccatcaggtacctggag

SEQ ID NO: 46955 - protein, 196 aa, Panicum virgatum
  misc_feature: Ceres CLONE 2033440
  misc_feature (53)..(196): Pfam Name: Terpene_synth Pfam Description: Terpene synthase, N-terminal domain
  misc_feature: SWISSPROT Homolog: EC 4.2.3.13 (+)-delta-cadinene synthase
MAAAPARTFSTSSVDPLPVSASLPATRNNDQRGRPRGRSIIASAAASKTLLPSDDFDLQLQEGLTSVQKTLQERRNSAREMMATIDNLKRLCIDHYFQEEIQSAMGACLDLIHSDDLFDATLAFKLVREAGHDVSADDVLRRFTNDTGEFKLALSKDIRGLLSLHDMSHLDMGEEPSLHKAKEFSSKHLASAIRYL

SEQ ID NO: 46956 - DNA, 641 bp, Panicum virgatum
  misc_feature: Ceres CLONE 2033449
  misc_feature: Encodes the peptide sequence at SEQ ID NO. 46957
gaaacatcacccaaatccaaagcaaacggaaaaacactcactcccctagtcacctgtctgtccatcgctctagctcagctcccagtcagtgatagctgcaagcgacagcacagccagcgccaccaagagctgggaggaaggttgtagaagatggggaagctctggacgatcctcactcacctccactcccttgcagggtatcttcacaacttcagaccatcactctctccgattgtatctgttcttcagttcctgttctattcctcttttcttttttagctttcagttcagctcagatcaggtgtctgaacttatctgctgatctttttgggttctagcaggccaacggtcatgctcctgtaccccctgtacgcgtcggtgcaggcgatggagagcccatccaagcttgacgacgagcagtggctcgcctactggatcctctactccttcatcacgctcatggagatggtgctcgagtccctcatctactggtaggttcagactgatgactgatgatttcatccacgacatgatcttggcttaatctcctcgttgttttatttttccgttgctacctgaagattttcttgacatgatctttgtaaatagcttatctgaaaatttgcttggaactgattttc

SEQ ID NO: 46957 - protein, 47 aa, Panicum virgatum
  misc_feature: Ceres CLONE 2033449
  misc_feature (2)..(47): Pfam Name: TB2_DP1_HVA22 Pfam Description: TB2/DP1, HVA22 family
MLLYPLYASVQAMESPSKLDDEQWLAYWILYSFITLMEMVLESLIYW

SEQ ID NO: 46958 - DNA, 662 bp, Panicum virgatum
  misc_feature: Ceres CLONE 2033457
  misc_feature: Encodes the peptide sequence at SEQ ID NO. 46959
gctcgctcggtcggccgccttctttccaaacggcgacgacaggggagtggcgccgccttttccagtgcttcgctggccgacaagtaatggcgtcgccaatctctgcaagacgctatcaacaatttgctttagtacataacaatgggcttccaagattttctcaagtaaaagtggcatgcttgggaataaaacaaactagatatccttctgaaaccaacttatcttcatcagcaagtcatggagatgccagcaagctccatcctgcagtcaaaatgtgtggcatcacatcagctagagatgcagaaatggctgtagaggccggagctaaacttataggcatgatactgtggcctaactctaaatgctccgtctcgttatctgaggcaaaagaaatatcaagagttgcacaatcttatggtgccgaatcagttggtgtctttgtggatgatgatgaagatactatcttacgagtgtctgattcatgtgatcttaaccttatccagctccatggagatgaatctcgtgcgttggttcataccctttccaagaataaccgcattgtttatgtactaaatgctgacgaagatggaaaactaatcaactctcctgttttggaatatgcacttgattggttcttagtggacagtgcaaaaggcggaagt

SEQ ID NO: 46959 - protein, 191 aa, Panicum virgatum
  misc_feature: Ceres CLONE 2033457
  misc_feature (61)..(190): Pfam Name: PRAI Pfam Description: N-(5'phosphoribosyl)anthranilate (PRA) isomerase
  misc_feature: SWISSPROT Homolog: EC 5.3.1.24 Phosphoribosylanthranilate isomerase
MASPISARRYQQFALVHNNGLPRFSQVKVACLGIKQTRYPSETNLSSSASHGDASKLHPAVKMCGITSARDAEMAVEAGAKLIGMILWPNSKCSVSLSEAKEISRVAQSYGAESVGVFVDDDEDTILRVSDSCDLNLIQLHGDESRALVHTLSKNNRIVYVLNADEDGKLINSPVLEYALDWFLVDSAKGG

SEQ ID NO: 46960 - DNA, 710 bp, Panicum virgatum
  misc_feature: Ceres CLONE 2033484
  misc_feature: Encodes the peptide sequence at SEQ ID NO. 46961
gatccgcacggcgccctcgcccactcccggtcgcgctcgccctcgccttcggccactcagccccgccgtcggcgtcggcctacctccgcccccgctgcagcagctcgtgctggcggcggtcggaggcaccgctgcacccgtagccggcaagacccaccgccccctccccccgcctggcagccgagatttgatccacttccagtgcttcaattttgacccggccacgaccaagttgtgccgagattcagcgctgtcctcgcacaaccgccgccgccgctgctgctggagatgccgagcccgacgatccggaggctggacgtggcatcgccggtgccggcggacatcgacatcgccaattctgtcgagccgctcccgatcgttgacatcgcggcagagctcggcctcgggcccgagcactacgacctctacggcaagtacaaggccaaggtgttgctgtcggttcttgatgacctcaaggcgcagcaggacgggtactacgtcgtagtgggtggcatcacgccgacgccgctcggggagggcaagtctaccaccaccgtcggcctgtgtcaggctctgggcgcgttccttgacaaaaaggttgtcacttgccttcgtcaaccatcgcaagggcctacctttggaatcaagggaggtgcagctggaggtggctacagcccagttatacccatggatgagttcaaccttcatct

SEQ ID NO: 46961 - protein, 140 aa, Panicum virgatum
  misc_feature: Ceres CLONE 2033484
  misc_feature: SWISSPROT Homolog: EC 6.3.4.3 Formate--tetrahydrofolate ligase
MPSPTIRRLDVASPVPADIDIANSVEPLPIVDIAAELGLGPEHYDLYGKYKAKVLLSVLDDLKAQQDGYYVVVGGITPTPLGEGKSTTTVGLCQALGAFLDKKVVTCLRQPSQGPTFGIKGGAAGGGYSPVIPMDEFNLH

SEQ ID NO: 46962 - DNA, 702 bp, Panicum virgatum
  misc_feature: Ceres CLONE 2033488
  misc_feature: Encodes the peptide sequence at SEQ ID NO. 46963
atcgagacttcgccgctctgtgagagcgctcaagcagtcaagcgtcaggcctgccaagagccgagcagagaaaatggcgggagcgaacttcctgtcgaccgtgcagcctcccgcgcttctcggcgcgcgaggcgttgctgcctcctccgtctcgtcgccggcacgcaggctcgcgaacattcaagtctgctgcaggggcaacgccgaaggtctcgagacggctgctcatgaagagcgtctgcaatttcgtagaagggatttcatcggcggctgcgttgggatcgccatcggtttggaactgattgacggctctacgagattcacaggagtggccactgcagctgatctcatcgagcgtagacaacgctctgaattccaatccagcatcaaagacaccctctacacagccataaaggggaaaccagagctcattccatctttgttgaccttggcactgaacgatgcaatcacatatgacaaggccacaaaaactggaggtgcaaatggatctatcaggctagaaataaacagacctgaaaacagtggactctctgctgcgttggacctgctggttgaagccaaaaaggagatagactcctactccaaaggaggccccatttcatttgctgatctgatacagtttgcagcacaatcagcactgaagagatcatttcttgacgcggccattgccaagtgcgggtg

SEQ ID NO: 46963 - protein, 209 aa, Panicum virgatum
  misc_feature: Ceres CLONE 2033488
  misc_feature: SWISSPROT Homolog: EC 1.11.1.11 L-ascorbate peroxidase
MAGANFLSTVQPPALLGARGVAASSVSSPARRLANIQVCCRGNAEGLETAAHEERLQFRRRDFIGGCVGIAIGLELIDGSTRFTGVATAADLIERRQRSEFQSSIKDTLYTAIKGKPELIPSLLTLALNDAITYDKATKTGGANGSIRLEINRPENSGLSAALDLLVEAKKEIDSYSKGGPISFADLIQFAAQSALKRSFLDAAIAKCG

SEQ ID NO: 46964 - DNA, 680 bp, Panicum virgatum
  misc_feature: Ceres CLONE 2033491
  misc_feature: Encodes the peptide sequence at SEQ ID NO. 46965
tttctccgctcaaaaaaaaactcatccccttctcgcccctccgtcgacacggcagtcggcacgcgcggccatgctcggtcttcgagcccgcgcaggcgcagcggcgctgcgcccgtgcccttccccgtccccctcctccgctcccgcgacctcgcttccgaggttcgggcgcctctccccgcccgccgccctcgcgcctctggcgtctgcaccgccgccgccggcctccctctccgccaggtggaacgcgccctcgcgtctcgggggaaccggaaccggcagcagctccaggcctaccacgagggttttctgcaccgctgccagtagcgctagtcagagagaggggaaagagttgctagtccagcatttgcttgttgctgacaaggatgtcaggcttctggtcgatcttgaaaagagcatcatcgcaggaggggcagacttgagtgatttagctgttgagcactccttatgcccatcaaaggaaaatggtggaatgcttgggtgggttcgaaagggacagatggttccagaattcgaggaggcagcatttagttctcctttgaataaagttgtacggtgtaagacaaaatttgtatggcatttattgcaagttcttgctgagagggatcaatgcattctgcaagacattgacccggaggagcttcacacgaaaatgcaag

SEQ ID NO: 46965 - protein, 203 aa, Panicum virgatum
  misc_feature: Ceres CLONE 2033491
  misc_feature (99)..(183): Pfam Name: Rotamase Pfam Description: PPIC-type PPIASE domain
  misc_feature: SWISSPROT Homolog: EC 5.2.1.8 Peptidylprolyl isomerase
MLGLRARAGAAALRPCPSPSPSSAPATSLPRFGRLSPPAALAPLASAPPPPASLSARWNAPSRLGGTGTGSSSRPTTRVFCTAASSASQREGKELLVQHLLVADKDVRLLVDLEKSIIAGGADLSDLAVEHSLCPSKENGGMLGWVRKGQMVPEFEEAAFSSPLNKVVRCKTKFVWHLLQVLAERDQCILQDIDPEELHTKMQ

SEQ ID NO: 46966 - DNA, 695 bp, Panicum virgatum
  misc_feature: Ceres CLONE 2033500
  misc_feature: Encodes the peptide sequence at SEQ ID NO. 46967
agagcaccagcgcccctgagatcctatcatcggcaccaatcggctagctagctggtcaagcttactgggaaacatgaggctctcggcggctgtgctctgcgccctggtggccgtccaggcggcggtgctcctcgccgccgcgccggcggcgcaggccggcgagctgcaggtcgggtactacggcaagaaatgcaagggcctggagaacatcgtcaagtggcacgtcatcagggcgctcaaggccaaccgccgcaccggcgccgcgctcgtccgtctgctcttccatgactgcttcgtcagggggtgcgatgggtctgtcctcctggacgcgtcctacgacaaccctcacccggagaaggaggcgccggtgaacatcggcctggccgccttcgacctcctggaggagatcaaggccgccgtcgaggacaggtgccctggcgtggtctcctgctccgacctcctcatctacgccgcccgcgacgcgtccagcatcctcagcaacggccacgtccacttcgacgtccccgccggccgcctcgacggcttcgtctccaaggccgaggaggcccaggcggagctcccggactcggccgacgacgtgaagaagctcatcgccaactttgccaggaagaacttcaccgtggaggagctcgtcatcctctccggcgcgcactccatcgggcagggccactgct

SEQ ID NO: 46967 - protein, 207 aa, Panicum virgatum
  misc_feature: Ceres CLONE 2033500
  misc_feature (47)..(207): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51054
  misc_feature: Useful for making plants with altered carbohydrate content
MRLSAAVLCALVAVQAAVLLAAAPAAQAGELQVGYYGKKCKGLENIVKWHVIRALKANRRTGAALVRLLFHDCFVRGCDGSVLLDASYDNPHPEKEAPVNIGLAAFDLLEEIKAAVEDRCPGVVSCSDLLIYAARDASSILSNGHVHFDVPAGRLDGFVSKAEEAQAELPDSADDVKKLIANFARKNFTVEELVILSGAHSIGQGHC

SEQ ID NO: 46968 - DNA, 611 bp, Panicum virgatum
  misc_feature: Ceres CLONE 2033507
  misc_feature: Encodes the peptide sequence at SEQ ID NO. 46969
cacaaagtgacacgggcagccgccgctgggcgtccggcggcggcacactgcggcaggccggcagcaatggctcgcccttcgaagctctacctcgtctgctacaactccctccaagcgctcggatggttcgtcgccctcctccgcctcctgccctgcctcgcctctcccgtctccgtccactccgcgtacgcggtcgccgccccttccgtctccgtccactccgcgtacgcggtcgccggcgacctcatctgcgtcctgcagacctgcgcgattcttgagacggttcacgccacgatcggattggtgcccacagcgccgcttcttgcatttttgcagtggggtgggaggactcacttcgttctcgctgttgttcggcaaatccccgaggttcagagcagtccgtctgtgttcataacgtttatggcttggagcatatctgaggtcatccgctactcccactatgctctgactaccttaaaagtttgtccatcttggctgacttatctcaggtacactgctttcatcccgctgtatccaattggggtcggaccaggagaaatgtggactatgtaccaagccctcccatttgtgaagaagaggaacctctactt

SEQ ID NO: 46969 - protein, 181 aa, Panicum virgatum
  misc_feature: Ceres CLONE 2033507
  misc_feature (65)..(179): Pfam Name: PTPLA Pfam Description: Protein tyrosine phosphatase-like protein, PTPLA
MARPSKLYLVCYNSLQALGWFVALLRLLPCLASPVSVHSAYAVAAPSVSVHSAYAVAGDLICVLQTCAILETVHATIGLVPTAPLLAFLQWGGRTHFVLAVVRQIPEVQSSPSVFITFMAWSISEVIRYSHYALTTLKVCPSWLTYLRYTAFIPLYPIGVGPGEMWTMYQALPFVKKRNLY

SEQ ID NO: 46970 - DNA, 697 bp, Panicum virgatum
  misc_feature: Ceres CLONE 2033510
  misc_feature: Encodes the peptide sequence at SEQ ID NO. 46971
ttaagaaaaaagatggagcatctagatattgaaaacaagaaggataaagataaacttcaacaagaaattgcaattttaaagaaaaggcttgcgcatgcaatggaggaaaagatggaattaaagggaagcatacgggtcttctgccgtgtgcgacccattcttgacaagagcagtagtgaagatggtgcggtttattgcttggagaagggacaatttgttggccgccgtgtttatctggaaacatcatcaggggctataaaagcttttacatgcgatcgagtgttccctcctggagtttcacaaaatgatatctttgttgaaatatcaggattagtgaagagtgcaatggatggcaagaaggtttgcatatttgcttatgggcaggcaggctctggtaaaacatttaccatgttaggtgatgatggaaatgatgcaaagggggtgatcccacgcgctgtggaggaaatttttgagaccattcatattcgagaatctttgggcctagctcaccaccatacagtaaagattgatatgagtgaaatttataacgaagaagtgcgcaatctgagctcaatggcttcgaatgataacgtcgttaaaacaaaaacccaggcgcttggagctttaaaggaagcattgagcaagagggctgttgctaagacttcacgcaatgaaagatcatctcgaagccatttta

SEQ ID NO: 46971 - protein, 232 aa, Panicum virgatum
  misc_feature: Ceres CLONE 2033510
  misc_feature (49)..(232): Pfam Name: Kinesin Pfam Description: Kinesin motor domain
LRKKMEHLDIENKKDKDKLQQEIAILKKRLAHAMEEKMELKGSIRVFCRVRPILDKSSSEDGAVYCLEKGQFVGRRVYLETSSGAIKAFTCDRVFPPGVSQNDIFVEISGLVKSAMDGKKVCIFAYGQAGSGKTFTMLGDDGNDAKGVIPRAVEEIFETIHIRESLGLAHHHTVKIDMSEIYNEEVRNLSSMASNDNVVKTKTQALGALKEALSKRAVAKTSRNERSSRSHF

SEQ ID NO: 46972 - DNA, 232 bp, Panicum virgatum
  misc_feature: Ceres CLONE 2033511
  misc_feature: Encodes the peptide sequence at SEQ ID NO. 46973
tcacagtcgcaggtgcggctgaggcccccaaggaggagaagaaggaagaggagaaggaagagagcgacgatgacatgggtttctccctgttcgactagattatttagctcccataagtggtggtttggtcctattgcggtacttaattttgctgtcttgttgccacgatccagtggcttgtgaaccagtaaactctgttaaattggtacaagcgacccggagttcccagttc

SEQ ID NO: 46973 - protein, 31 aa, Panicum virgatum
  misc_feature: Ceres CLONE 2033511
  misc_feature: Functional homolog of the protein sequence given in SEQ ID NO 50285
  misc_feature: Useful for making plants with altered oil content
  misc_feature: Useful for making plants with modulated biomass
TVAGAAEAPKEEKKEEEKEESDDDMGFSLFD

SEQ ID NO: 46974 - DNA, 711 bp, Panicum virgatum
  misc_feature: Ceres CLONE 2033517
  misc_feature: Encodes the peptide sequence at SEQ ID NO. 46975
aagcaaaactgcaaagtaaaaaaagattcgacaagctaagccacccccataatggagatggagctaagtccagcaacgctcctctttgtcttcctcatttccctgccaattcttgtgaccctgctgagccgcaaatcaactccgacctccaacaagaggcggcctccaggcccgtggaacctccccttgattggaagcctcctccacttcatcaagtcgcatccgccgatggttctccgggacctggccaacaagtatggccctgtgatgtttcttcgaatgggtcaggtcgacactctcgtgatatcctcgccggcggcagcgcaggaggttctccgcgagaaggatgtcatcttcgcgtcgaggccgaccatcgtggcttcggaggtcttctgctacggaaacctcgatatcggcttctcgccatatggcgcctattggcggacgctgcgcaagctctgcacggtggagctcctcagtgcaaagatggtgcgacagttcgctcccatcagggataacgagacgttgtccctcatcagaaatatccaagctgctggccaaggtggtcagcctgtgaccaatctcgcgagcctgctcctagcctgctcgaactccatcacgacaaaggcggccttcggccaggtttgcagcaaggagctccgggaaaagtccctgtggtcgattgctgtgggcatgagcttcagcggaggc

SEQ ID NO: 46975 - protein, 219 aa, Panicum virgatum
  misc_feature: Ceres CLONE 2033517
  misc_feature: SWISSPROT Homolog: EC 1.14.13.68 4-hydroxyphenylacetaldehyde oxime monooxygenase
MEMELSPATLLFVFLISLPILVTLLSRKSTPTSNKRRPPGPWNLPLIGSLLHFIKSHPPMVLRDLANKYGPVMFLRMGQVDTLVISSPAAAQEVLREKDVIFASRPTIVASEVFCYGNLDIGFSPYGAYWRTLRKLCTVELLSAKMVRQFAPIRDNETLSLIRNIQAAGQGGQPVTNLASLLLACSNSITTKAAFGQVCSKELREKSLWSIAVGMSFSG

SEQ ID NO: 46976 - DNA, 663 bp, Panicum virgatum
  misc_feature: Ceres CLONE 2033532
  misc_feature: Encodes the peptide sequence at SEQ ID NO. 46977
atttatggcaatgatcctgcatttggcatgggaatgacttatctaacaagtcctccatctagtccgtatatctcgtctcatcaaggccatgccaggcaaggagagcgactaacccgaattccatctgtggtgaggaacactgctggaggatccatgggatcatggaattcagaaaatggtctgatagataatggttacgggtcctccctgctggaggaattcaaaaccaacaaaaccagatcttttgagctgttagatattgtaggccatgtggtcgaattcagttctgatcagtatgggagtcgctttatacagcagaaactggaaactgcttctattgaagagaagaacctgattttccctgagatccttccccaggcacgtactttgatgactgatgttttcggaaattatgttatacagaagttctttgaatatggaactgaaacacaaacgaagcaactggcaagcctactcaagggctatgtgttacagctgagtcttcaaatgtatggctgccgagtgattcagaaggctttggaagttgttgaagtggaacaacaaacacaaatggctctggagcttgatggatctatcatgagatgtgttcgtgatcagaatggcaaccatgttatccaaaaatgtatagaatgcatccctcag

SEQ ID NO: 46977 - protein, 220 aa, Panicum virgatum
  misc_feature: Ceres CLONE 2033532
  misc_feature (122)..(156): Pfam Name: PUF Pfam Description: Pumilio-family RNA binding repeat
  misc_feature (86)..(120): Pfam Name: PUF Pfam Description: Pumilio-family RNA binding repeat
  misc_feature (158)..(193): Pfam Name: PUF Pfam Description: Pumilio-family RNA binding repeat
  misc_feature: The sequence is a functional homolog of SEQ ID NO 1232 in the 10/666,642 US patent application
IYGNDPAFGMGMTYLTSPPSSPYISSHQGHARQGERLTRIPSVVRNTAGGSMGSWNSENGLIDNGYGSSLLEEFKTNKTRSFELLDIVGHVVEFSSDQYGSRFIQQKLETASIEEKNLIFPEILPQARTLMTDVFGNYVIQKFFEYGTETQTKQLASLLKGYVLQLSLQMYGCRVIQKALEVVEVEQQTQMALELDGSIMRCVRDQNGNHVIQKCIECIP

SEQ ID NO: 46978 - DNA, 706 bp, Panicum virgatum
  misc_feature: Ceres CLONE 2033544
  misc_feature: Encodes the peptide sequence at SEQ ID NO. 46979
agcaaacaaactccgaagcgactgacgatcagaggcgtctttctgagcgcagcagttcgccgacaaatccccactccgaccttcaatcccgatcatcattcaacgacaatgtcgctgatccgccgcagcaacgtgttcgaccccttctccctcgatctctgggaccccttccagggcttccccttcggctccggcagcggcagcctcttcccgcgcatctcctccgactccgacgccgcggcgttcgctggtgcgcgcatcgactggaaggagacccccaaggcccacgtgttcaaggcggacgtgccggggctgaaaaaggaggaggtgaaggtggaggtcgaggacggcaacgtgctccagatcagcggcgagcggagcaaggagcaggaggagaagaacaacaggtggcacagggtggatgtaacgcccctcaattagcaatcaattaggagtgctaaacacaatttgaaaatttaaatggagtcaaaaatatcaagcccacgtgtagcttgctccctctctcccgtgcgtggtcaccgtggccaatttggccacggcgccgctcgcgcacgccacaacgacgcatcgcacgaagcttctcccctgctcacgcgagagccgagccccagcccttttcccctgctgcccagagcgcgcctcgtcgcccggcatgcctgccacgggccttgcacgccgcgctccc

SEQ ID NO: 46979 - protein, 110 aa, Panicum virgatum
  misc_feature: Ceres CLONE 2033544
  misc_feature (52)..(110): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFQGFPFGSGSGSLFPRISSDSDAAAFAGARIDWKETPKAHVFKADVPGLKKEEVKVEVEDGNVLQISGERSKEQEEKNNRWHRVDVTPLN

SEQ ID NO: 46980 - DNA, 666 bp, Panicum virgatum
  misc_feature: Ceres CLONE 2033545
  misc_feature: Encodes the peptide sequence at SEQ ID NO. 46981
aaaagaacccgcggcagggaagaggagaggagggggtcgtgaaaggaagaaaccaaacccagcccaagaacagaacaccaccgttccctcgccggggcgtccatccgcaacgatctgcagccatggcgatggcttacaagatggcgacggaggggatgagcgtgaaggaggagtgccagcgctggttcatggagatgaagtggaagaaggtgcaccgcttcgtggtgttcaagatcgatgagcggtcgcgcgccgtgctggtggacaaggtgggcggccccggcgaggggtacgaggagctcgtcgccgcgctgcccggcgacgactgccgctacgccgtcttcgacttcgacttcgtcaccgtcgacaactgccagaagagcaagatcttcttcatcgcctggtcgccggcggcgtcgaggatccgagccaagatcctgtacgcgacgtcgaagcaaggcctgcggcggctgctggacggggtccactacgaggtgcaggccaccgacccctccgagatgggattcgacgtcatcagaggccgcgcgcaatgaagccgctcccggcctcccctacgcgcgcgtgtgtgtgtgtgtgcgcttgtgcccgtctcctgtcaccactactcactgctgcgtgtctgatcgatcggccggatgctaattg

SEQ ID NO: 46981 - protein, 143 aa, Panicum virgatum
  misc_feature: Ceres CLONE 2033545
  misc_feature (16)..(143): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence
MAMAYKMATEGMSVKEECQRWFMEMKWKKVHRFVVFKIDERSRAVLVDKVGGPGEGYEELVAALPGDDCRYAVFDFDFVTVDNCQKSKIFFIAWSPAASRIRAKILYATSKQGLRRLLDGVHYEVQATDPSEMGFDVIRGRAQ

SEQ ID NO: 46982 - DNA, 652 bp, Panicum virgatum
  misc_feature: Ceres CLONE 2033550
  misc_feature: Encodes the peptide sequence at SEQ ID NO. 46983
atactcaccaaacacgagctctctccccagcggctctgctgaatgaagatggtttcgttatgccatcctgttcgaatcagaacatgcgggaaatttgcgacgaggaatgcagcagccaaggtcttgtgctccatggagacgccaccatcccagagcacaatcaaggttgttatcatcggggccacaaaggaaattgggaggacggcgattgttgcagtcagtaaagccaggggcatggagcttgcaggggcaatcgattcccagggcattggagaggacgcgggacagattagtggcatggaggagccgttggaaattccggtgctcaatgatctcacaatggttctgggctccatagcacaatcgagagcaactggcgtggttgttgatttcagtgaaccttcaactgtttatgacaatgtcaagcaggcagcagcatttggtttaagcagcattgtctatgttccaaagattgagttagatacagtaactgaactttcagcattttgcgagaaggcaagcatgggttgcttggttgcaccaacattatcgattggctcagtgctccttcaacaagctgctatacaggcctcatttcactacagcaatgctgaaattgtggaatcaaaacctaacccatcggacttgccat

SEQ ID NO: 46983 - protein, 203 aa, Panicum virgatum
  misc_feature: Ceres CLONE 2033550
  misc_feature (40)..(169): Pfam Name: DapB_N Pfam Description: Dihydrodipicolinate reductase, N-terminus
  misc_feature: SWISSPROT Homolog: EC 1.3.1.26 Dihydrodipicolinate reductase
MKMVSLCHPVRIRTCGKFATRNAAAKVLCSMETPPSQSTIKVVIIGATKEIGRTAIVAVSKARGMELAGAIDSQGIGEDAGQISGMEEPLEIPVLNDLTMVLGSIAQSRATGVVVDFSEPSTVYDNVKQAAAFGLSSIVYVPKIELDTVTELSAFCEKASMGCLVAPTLSIGSVLLQQAAIQASFHYSNAEIVESKPNPSDLP

SEQ ID NO: 46984 - DNA, 692 bp, Panicum virgatum
  misc_feature: Ceres CLONE 2033553
  misc_feature: Encodes the peptide sequence at SEQ ID NO. 46985
gagagagagagagatggcgccagtcgccgacgccgccgccgtcccgagccccgcgcaggcagcggccgcggcggcggacgccgagggcctccggaaggccgtgcaagggtggggcacggacgagcgggcgctgatcgagatcctcggccggcggacggccgcgcagcgcgccgaggtgcgccgcgcctacgcggggctctaccgggagtccctcctcgaccgcctccgctccgagctctccggcgacttccggaccgccatggtgctgtgggcgatggacccggcggagcggggcgcgcggctggccaacgacgcgctcgccgccgccaagagagccatcagcgaccagcacgcctgggcgctggtcgaggtcgcctgcgcctccgcgccggaccacctcgtcgccgtccgccgcgcgtaccgctccctcttcggctgctcgctcgaggaggacgccgccgcctgcccggcgctccaggacccgctcaggaaggtaattaaaaccttctcgagaagcctaaggcctcagctgccgttaatggcgtatcgcttggcgcgcggtcagcttcccctagctcggctccgatctcccgctcggtgcttcagctgctggtgagcctggtgcggtcgtaccgctgcgaggcagagatcgtcgacgaggacgtcgcggggctggaggcggcgcagctggc

SEQ ID NO: 46985 - protein, 200 aa, Panicum virgatum
  misc_feature: Ceres CLONE 2033553
  misc_feature (21)..(86): Pfam Name: Annexin Pfam Description: Annexin
MAPVADAAAVPSPAQAAAAAADAEGLRKAVQGWGTDERALIEILGRRTAAQRAEVRRAYAGLYRESLLDRLRSELSGDFRTAMVLWAMDPAERGARLANDALAAAKRAISDQHAWALVEVACASAPDHLVAVRRAYRSLFGCSLEEDAAACPALQDPLRKVIKTFSRSLRPQLPLMAYRLARGQLPLARLRSPARCFSCW

SEQ ID NO: 46986 - DNA, 675 bp, Panicum virgatum
  misc_feature: Ceres CLONE 2033557
  misc_feature: Encodes the peptide sequence at SEQ ID NO. 46987
gtctctctagcaaggctcacaagtggtccgtcaccaccgaaagcctcctgttgccaagatgcgcgtgatcgaggacaagggtggcgccatcgctgtgatcctggtgtccctcttcttcatcggcaccttcccagccatcttgacgcttctggagcgccgaggccggcttccccagcacacgtacctcgactactccatcaccaacctgctcgccgccgtcgtcatcgccgtcatgcttggccaggccggagaggccaggcctggcatgccaaacttcttcacccagctcacccagattcatgataactggccctcagtgctattcgcaatggctggcgggctcgccctcggcctcggaaacctggtatcgcagtacgcatgggtgtttgccggcttgtcagtgaccaacatcatctgctccagcatgactgttgttataggcacaaccatgaactattttctggatgggcgtataaatcgagccgagatcctcttccccggcgtcgcgtgcttcctcatcgcagtcttcctcggtgctgcggtccattcttctaatgccaaggatgacgagcagaaactaaacacgtcaggaagcctgtttctgcaccaaatgagtgctctcctcttgatgttgcattctgttgagcagcattgagctccttactaatatcaatg

SEQ ID NO: 46987 - protein, 198 aa, Panicum virgatum
  misc_feature: Ceres CLONE 2033557
  misc_feature (14)..(196): Pfam Name: FAE_3-kCoA_syn1 Pfam Description: Fatty acid elongase 3-ketoacyl-CoA synthase 1
MRVIEDKGGAIAVILVSLFFIGTFPAILTLLERRGRLPQHTYLDYSITNLLAAVVIAVMLGQAGEARPGMPNFFTQLTQIHDNWPSVLFAMAGGLALGLGNLVSQYAWVFAGLSVTNIICSSMTVVIGTTMNYFLDGRINRAEILFPGVACFLIAVFLGAAVHSSNAKDDEQKLNTSGSLFLHQMSALLLMLHSVEQH

SEQ ID NO: 46988 - DNA, 664 bp, Panicum virgatum
  misc_feature: Ceres CLONE 2033574
  misc_feature: Encodes the peptide sequence at SEQ ID NO. 46989
atcgccacgcttcagctcagacctcagtcgccaagcgttcagctagctactgagaggtcgatttggatcgtgcacagccgcctctcgcgatcagctcgccgcagctcggcgttctcgaccgtcgtctcggtcaccgcccgctcagcacccgcgacgaacccggtcgtctcagctccgccgccgcattatccgtctctctccgacgacgatgtcgagcaggaggtcccgcgcgtcggtctcggaggaggagatcaacgagctcctcgccaggctccagacgctgctccccagcgcgcgccgccgcggcggtagccaggcatcgacgacgaagctgctcaaggaaacgtgcagctacatcaagagcctgcaccgggaggtggacgacctgagcgaccgcctctccgacctcatggccaccatggaccagaacagccccggcgccgagatcatccgcagcctcctccgctagcgatcgatcgactacgagctgacggccacggccagccatggcgacggatacccatcgccatcgccatggacggcctcggcctagcttagctagctctcagcggatcggagctgagtgtaccatattcttccccggcagcagctgcgacctgatgctaaggacgacgacgaagtctggtttaattggtagtacaag

SEQ ID NO: 46989 - protein, 86 aa, Panicum virgatum
  misc_feature: Ceres CLONE 2033574
  misc_feature (4)..(54): Pfam Name: HLH Pfam Description: Helix-loop-helix DNA-binding domain
  misc_feature: Functional homolog of the protein sequence given in SEQ ID NO 50858
  misc_feature: Useful for making plants with modulated nitrogen use efficiency
  misc_feature: Functional homolog of the protein sequence given in SEQ ID NO 50859
  misc_feature: Useful for making plants with altered terpenoid content
  misc_feature: Functional homolog of the protein sequence given in SEQ ID NO 51729
  misc_feature: Useful for making plants with modulated seedling growth
  misc_feature: Functional homolog of the protein sequence given in SEQ ID NO 50860
  misc_feature: Useful for making plants with altered lignin content
MSSRRSRASVSEEEINELLARLQTLLPSARRRGGSQASTTKLLKETCSYIKSLHREVDDLSDRLSDLMATMDQNSPGAEIIRSLLR

SEQ ID NO: 46990 - DNA, 748 bp, Panicum virgatum
  misc_feature: Ceres CLONE 2033587
  misc_feature: Encodes the peptide sequence at SEQ ID NO. 46991
aaaaaaaaaaaaaaaaatgacatgagtagtcctagtttgttagagcagactccgaaagaatatagctccattgtgcgataaacacccctcagttcaccaaaaacaaaggctcataaactgcaagagtcggttccaatcaggattctggagtctgcaacgagatatcagtacaaaacggaactgaagagatgtatcatcatcaacaacagctccacagccacagccatttcctgtcttctaggcagacattccctccagaaaggcacttacttctgcaaggagggagtattccagcagagccagggcttgtgctttcgactgacgctaagcctaggttaaaatggacacctgaactacatgagcgctttgtggatgcggtaaatcaacttggtggacctgataaagccacaccgaagacaatcatgagacttatgggtgtccctggactaacactatatcaccttaagagtcatcttcagaaatacagactaagcaaaaatgttcatgctaaagctaatggtggaaatgcaaaaaatgtggttggctacaccatggcaatggagaagccacctgaaggaaatggatcgccagctagccacctaaaccttggcacccagacaaacaaatctgtgcacataggtgaagcccttcagatgcaaattgaagtacagcgccgactgcatgagcaactagaggtacaaagacatttacaactccgcattgaagcacaggggaagtacctacaatc

SEQ ID NO: 46991 - protein, 186 aa, Panicum virgatum
  misc_feature: Ceres CLONE 2033587
  misc_feature (49)..(100): Pfam Name: Myb_DNA-binding Pfam Description: Myb-like DNA-binding domain
  misc_feature: Functional homolog of the protein sequence given in SEQ ID NO 51559
  misc_feature: Useful for making plants with modulated flowering time
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: Functional homolog of the protein sequence given in SEQ ID NO 50244
  misc_feature: Useful for making plants with altered alkaloid content
  misc_feature: Useful for making plants with altered lignin content
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: Functional homolog of the protein sequence given in SEQ ID NO 51484
  misc_feature: Useful for making plants with altered terpenoid content
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MYHHQQQLHSHSHFLSSRQTFPPERHLLLQGGSIPAEPGLVLSTDAKPRLKWTPELHERFVDAVNQLGGPDKATPKTIMRLMGVPGLTLYHLKSHLQKYRLSKNVHAKANGGNAKNVVGYTMAMEKPPEGNGSPASHLNLGTQTNKSVHIGEALQMQIEVQRRLHEQLEVQRHLQLRIEAQGKYLQ

SEQ ID NO: 46992 - DNA, 662 bp, Panicum virgatum
  misc_feature: Ceres CLONE 2033588
  misc_feature: Encodes the peptide sequence at SEQ ID NO. 46993
agatccttcccagttcccaccgcccggtccgagacgcaccaacgacaccacatccgttcccttccgcggctcctctcgccgtcgccgccggctccgtccagatccagaatacgagaagtggagttgaagcgcgactatgcattcattgaattcagtgatcctcgcgatgctgatgatgcacgatacaacctagatggcaggaatgttgatgggagccgcattattgttgagtttgctaaaggggttccatgtggaccaggtggctcacgtgaatacatgggaagaggccctcccccaggaacaggtggttgtttcaactgtggaatcgatggtcactgggcgagagactgtaaggctggtgactggaaaaataaatgctaccgatgtggagaaaggggccatatagaaagaaattgccagaacagccctaggagtatcaggcgtgagagaagctactcacggtccctgtctccacgccgtggcaggggccgcagtcggagctacagcagaagccggagccggaactatagtcgctcaagatccctatctggatctcctaggggaggtcaacatgaccgtggtgagaggagatcaaggagccttagctacagcaggagccccatgcaatctgcctccccacctgcaaaggagcgcagccctac

SEQ ID NO: 46993 - protein, 220 aa, Panicum virgatum
  misc_feature: Ceres CLONE 2033588
  misc_feature (102)..(119): Pfam Name: zf-CCHC Pfam Description: Zinc knuckle
  misc_feature (124)..(141): Pfam Name: zf-CCHC Pfam Description: Zinc knuckle
RSFPVPTARSETHQRHHIRSLPRLLSPSPPAPSRSRIREVELKRDYAFIEFSDPRDADDARYNLDGRNVDGSRIIVEFAKGVPCGPGGSREYMGRGPPPGTGGCFNCGIDGHWARDCKAGDWKNKCYRCGERGHIERNCQNSPRSIRRERSYSRSLSPRRGRGRSRSYSRSRSRNYSRSRSLSGSPRGGQHDRGERRSRSLSYSRSPMQSASPPAKERSP

SEQ ID NO: 46994 - DNA, 652 bp, Panicum virgatum
  misc_feature: Ceres CLONE 2033592
  misc_feature: Encodes the peptide sequence at SEQ ID NO. 46995
cacttgcttcaggaaaaccctactgcgccaagagctccagccaccaggctgaacaattcagagaccgggatcaggagaaacgccgcggcccgcttcatcgcgcgccctaagtgatcaacgccggttgtgcccagatggcgtccccgtacaaggcctatgagcctccttccaactcctccggctaccggacggacaaagtccgtcgcaagaagctgacggcgcagaagaggaaggagatcaaagaggcgttcgacctcttcgacatcgacggctcaggcaccattgatgcaagggagctcaacgttgccatgagagccctgggattcgagatgacaccggagcaaatcaaccagatgatcgcggaggtggataaggacggcagcggcaccatcgacttcgacgagttcgtgcacatgatgacggacaagatgggcgagcgggacgcccgggacgaactctataaggccttccgcatcatcgacaaggacggtaacggcaagatctccgacatcgacatccagcggctggccatcgagaccggcgagcacttcacgctcgacgaggtgagggagatgatagaggccgccgatgagaacggtgacggcgagatcgacctggaggagttcatgaagatgatgaggcggacgaacct

SEQ ID NO: 46995 - protein, 172 aa, Panicum virgatum
  misc_feature: Ceres CLONE 2033592
  misc_feature (70)..(98): Pfam Name: efhand Pfam Description: EF hand
  misc_feature (143)..(171): Pfam Name: efhand Pfam Description: EF hand
  misc_feature (34)..(62): Pfam Name: efhand Pfam Description: EF hand
  misc_feature: SWISSPROT Homolog: EC 2.7.11.1 Non-specific serine/threonine protein kinase
MASPYKAYEPPSNSSGYRTDKVRRKKLTAQKRKEIKEAFDLFDIDGSGTIDARELNVAMRALGFEMTPEQINQMIAEVDKDGSGTIDFDEFVHMMTDKMGERDARDELYKAFRIIDKDGNGKISDIDIQRLAIETGEHFTLDEVREMIEAADENGDGEIDLEEFMKMMRRTN

SEQ ID NO: 46996 - DNA, 702 bp, Panicum virgatum
  misc_feature: Ceres CLONE 2033602
  misc_feature: Encodes the peptide sequence at SEQ ID NO. 46997
aagaatgaaggccaagatggcatgttacccatgtactacatggcaggtgtcgatgctctctcttcttacccacatcctcttgttcgcatccagctctgtgtgtatctacggtgtcaatgatgacctctcagcgctcttgtctttcaaatcttacataacaaatgatccaggacaggcactgtcctcgtgggacgcttctgacaacggcaccaacaagccgtcgtccgatttctgccaatggaatggcatcgcctgcaatgatcgccggcacccaggtcgtgtcacggccatacgtttgcggggttcagacctaggtggcaccatctccccacatttaggtaacctcactcaccttcaagatcttgatctgtcacaaaacaatctggtaggtgggattccagtcagcctgggccgttgcatagagcttcgcaccatgaacttgagtgtgaatcaactgtctggttcattgttccccgatgctcttggtcatctatcgaagttaaaggtattcaatgttcgccacaacaatcttacgggtgttattcccattactctgtccaaccttacagccctcacgaatcttagcgtcgagagcaactacctgcagggtcaaataccaagctggctctgcaacctgacatcgttggcggccatagatcttgcgcttagcggattaaatggccaaattcctgcagaactggg

SEQ ID NO: 46997 - protein, 232 aa, Panicum virgatum
  misc_feature: Ceres CLONE 2033602
  misc_feature (37)..(85): Pfam Name: LRRNT_2 Pfam Description: Leucine rich repeat N-terminal domain
  misc_feature: SWISSPROT Homolog: EC 2.7.11.1 Non-specific serine/threonine protein kinase
MKAKMACYPCTTWQVSMLSLLTHILLFASSSVCIYGVNDDLSALLSFKSYITNDPGQALSSWDASDNGTNKPSSDFCQWNGIACNDRRHPGRVTAIRLRGSDLGGTISPHLGNLTHLQDLDLSQNNLVGGIPVSLGRCIELRTMNLSVNQLSGSLFPDALGHLSKLKVFNVRHNNLTGVIPITLSNLTALTNLSVESNYLQGQIPSWLCNLTSLAAIDLALSGLNGQIPAEL

SEQ ID NO: 46998 - DNA, 717 bp, Panicum virgatum
  misc_feature: Ceres CLONE 2033605
  misc_feature: Encodes the peptide sequence at SEQ ID NO. 46999
ctctgattcaatccaactactctcatcatgtaaatgtgaacttccgaaacattttgcttctgtcatggttgctgattctcagaataagtcaagtcaatcatggcactcagtagtcgatacacagaaacaaagtgttgtcaccaaatttaaggttcaactgttcaagctgatgcagcagttggagagcacaactcctcattttatccgatgcattcaaccaaatggcaaacaacgccccaggttattcgagcatgatcttgtcttgcatcagcttaaatgctgtggagtgcttgaagttgttcgaatatcaagaacgggctatccaactaggatgactcaccaccagtttgctgaaagatatggatttcttctcctgcgttctattgcgtctcaagacccacttagtgtttcaattgctgttttgcagcagttgaatattccccctgaaatgtatcaagttggctacacaaaattgtttttccgtacaggacagattgctgcactggaaaatgctaaaaggaagatgctccatggaaccctttgtattcagaaacacttccgtgggttgcattttcgacagggttatcagggactgaagaaaggagcaatgactttgcagtcatttatacgcggtgaaagagcaagaatacactttgataatgtcatcaagagatggagggcagctgttctcatacagaagtacactaagcgtcgaat

SEQ ID NO: 46999 - protein, 238 aa, Panicum virgatum
  misc_feature: Ceres CLONE 2033605
  misc_feature: SWISSPROT Homolog: EC 2.7.11.1 Non-specific serine/threonine protein kinase
SDSIQLLSSCKCELPKHFASVMVADSQNKSSQSWHSVVDTQKQSVVTKFKVQLFKLMQQLESTTPHFIRCIQPNGKQRPRLFEHDLVLHQLKCCGVLEVVRISRTGYPTRMTHHQFAERYGFLLLRSIASQDPLSVSIAVLQQLNIPPEMYQVGYTKLFFRTGQIAALENAKRKMLHGTLCIQKHFRGLHFRQGYQGLKKGAMTLQSFIRGERARIHFDNVIKRWRAAVLIQKYTKRR

SEQ ID NO: 47000 - DNA, 690 bp, Panicum virgatum
  misc_feature: Ceres CLONE 2033627
  misc_feature: Encodes the peptide sequence at SEQ ID NO. 47001
acggcactacctctccgtcgcgaagcaaccgcagccgcggcggcttctccgtccccgagctcagccgccctctcttcctcttcccctcctccgaatcgtgttcgtccagctgtagtagtaggcggccggcggcgagatttctctgtacgatgagctggaggattcctctctttggctctcagcagcagcaaacagacccaaatttcccggacatacctacgcaatcttggtaccctccatcggtggtaggctcatcttcacgtccatccacacctacctcttctagtgctagcccacatcaaagagcttcagatcatcctcagtcttcatcccgtgggcaaccatctcctgctgaagctgcagggataattgctcgtttgaaggataagagtattgaggagttacagaggctattgaaagacaaagaggcatacaatgcattctttaattcacttgatcaagttaaaacccagaacaatgtacgggatgagcttagaaaggagacattgcaacttgcaagggaaaatttagaaaaggagcagcggattttggagctccggaatcagtgcacaataataagaaccacagaactggctgctgctctagacaggctaactgatttggagaggcaaaaggatgatattatgaggtcatattcccctgctgcgctgctcgacaagctccaaacat

SEQ ID NO: 47001 - protein, 180 aa, Panicum virgatum
  misc_feature: Ceres CLONE 2033627
  misc_feature (77)..(180): Pfam Name: Mod_r Pfam Description: Modifier of rudimentary (Mod(r)) protein
MSWRIPLFGSQQQQTDPNFPDIPTQSWYPPSVVGSSSRPSTPTSSSASPHQRASDHPQSSSRGQPSPAEAAGIIARLKDKSIEELQRLLKDKEAYNAFFNSLDQVKTQNNVRDELRKETLQLARENLEKEQRILELRNQCTIIRTTELAAALDRLTDLERQKDDIMRSYSPAALLDKLQT

SEQ ID NO: 47002 - DNA, 682 bp, Panicum virgatum
  misc_feature: Ceres CLONE 2033631
  misc_feature: Encodes the peptide sequence at SEQ ID NO. 47003
tttcggacctatgctggaaaagcaagcctctgttttaaagcagagcttgtccatcttttaaactttggggggccttagatgaactttcgaatgttctgaatcaaggtcactaatcttttcatggacttgaaacaatctctgttacaagcagtgtcgtaaaaagcacagctatgtttgtcctgtctttgaggcgacaggagagtgcccacaacaatcaagatgcaagcttcatcatcccaagaaaaaaaacaaatccaagagaagcagagtagacaccctccaaaacaacaattggggcaggtattttgacacaagcgttggccatggaagtggggcaagggtagtttcttcagaggaagaagagagacagagaccggagcaagtctctggtgatgactttgctgactacattgaccttggtgctgatattgaagttgatggagatgtggatgcttcagatgatatgcagctgatggaattggactcggggaatctcaagatgcaggctgacaatcttgatgcacgaaccaagccacttcggatcatgagaacagcaagagtttgacggtttatttcgttggactagatatacagctgcagtgttattactgagggcgataataatacactgtacatgaagacttgaagaggctgaggcgctgacttgagttctatctctggg

SEQ ID NO: 47003 - protein, 33 aa, Panicum virgatum
  misc_feature: Ceres CLONE 2033631
  misc_feature: The sequence is a functional homolog of SEQ ID NO 1334 in the 10/666,642 US patent application
MQLMELDSGNLKMQADNLDARTKPLRIMRTARV

SEQ ID NO: 47004 - DNA, 722 bp, Panicum virgatum
  misc_feature: Ceres CLONE 2033636
  misc_feature: Encodes the peptide sequence at SEQ ID NO. 47005
  misc_feature (584)..(584): n is a, c, t, g, unknown, or other
aatggaagaagctgcgaggggcaaacggacacacgtataatccctgtactttcccgggtccagccagaggcagaaaaagcagaaccgtgttctatgcttccaaggtccagggccttgggatcagcggcgcggcgcttgggcctggtcgcggctccagcccccgcgcgcgcgtcctcggcttcggcagcgcggcggccgtgcccgccgtccgacggcgacgaggccggggaggatgagcttcttcggccgccccacgggcagccgctggaggagcggcggtggcctcgccgcggagagcagcagcatcggagagaattctcatttatcacaacagccgccaaagatcattctgtcttgacccggcaacttctagattcgcgacatgatacagtagatgaagtaggtacagaacatgatccgttcattgagttgaaagcgaggttcatggacttcaaacagcgaaactatgtggaaaaaatttcaaattaccaaagtttggcgcaacagcaaacaccaaagttcatggtgattgcttgtgctgactccagggtctgccctaccagtattttggggtttcagcctgnggaagcatttacagttcgtaatgtggcaaatttggtaccaccatatgagcatgggggttcagagactagtgcagcactagagtttgctgtcaatacactccaggtagaaaatgtattggtggtaggtcacagccgatg

SEQ ID NO: 47005 - protein, 209 aa, Panicum virgatum
  misc_feature: Ceres CLONE 2033636
  misc_feature (136)..(209): Pfam Name: Pro_CA Pfam Description: Carbonic anhydrase
  misc_feature: SWISSPROT Homolog: EC 4.2.1.1 Carbonate dehydratase
  misc_feature (164)..(164): Xaa is any aa, unknown, or other
MLPRSRALGSAARRLGLVAAPAPARASSASAARRPCPPSDGDEAGEDELLRPPHGQPLEERRWPRRGEQQHRREFSFITTAAKDHSVLTRQLLDSRHDTVDEVGTEHDPFIELKARFMDFKQRNYVEKISNYQSLAQQQTPKFMVIACADSRVCPTSILGFQPXEAFTVRNVANLVPPYEHGGSETSAALEFAVNTLQVENVLVVGHSR

SEQ ID NO: 47006 - DNA, 731 bp, Panicum virgatum
  misc_feature: Ceres CLONE 2033639
  misc_feature: Encodes the peptide sequence at SEQ ID NO. 47007
atcacaactcgcaccaaactaagcccaaagggcctaatcgcgcagctcacacgaagcaggtacctcccttcctctcctcccgactcccgttgaccagcaactccagccagcgaggcagccgcaagctctccccggcagtcctccagtcctcctcctgcccgccatgtccggcagccgcggcaactcccgcgagaagacgtgctgctgcggcagctgctgcaccctgctcatctccctgggcctcgccgtgctcatctactgggccatcttccagccgcaccagatacgcgccaccgtcgagtacgccgagctctccaacctcgccgtctccaacgcctcctccccggttgccgtcacctaccacgtcgccatcaacctgagcctctacaaccccagcaagcgcgtcaacatctactacgacgccatcgacgccgagctcctcttccgcggcgccgtcctcagcgcggccgccgccgccgccgcgtcccccgccgagttctaccagcgcaggaagaccgccgagacggtccgcctggagttcgacggcaagggcgtcgccgtccccgagggcgtctcggcggagctggagagcgaggtgaaggccgcggcgtcgctgggcctggagctgagcgtcagggtgcgggtgaggtacgtgttcgggagcatcaagatacggcggaagcccaaggtgtggtgcgcggtgagtatcccggtcccgcgggcggcggggg

SEQ ID NO: 47007 - protein, 189 aa, Panicum virgatum
  misc_feature: Ceres CLONE 2033639
  misc_feature (33)..(178): Pfam Name: Hin1 Pfam Description: Harpin-induced protein 1 (Hin1)
MSGSRGNSREKTCCCGSCCTLLISLGLAVLIYWAIFQPHQIRATVEYAELSNLAVSNASSPVAVTYHVAINLSLYNPSKRVNIYYDAIDAELLFRGAVLSAAAAAAASPAEFYQRRKTAETVRLEFDGKGVAVPEGVSAELESEVKAAASLGLELSVRVRVRYVFGSIKIRRKPKVWCAVSIPVPRAAG

SEQ ID NO: 47008 - DNA, 716 bp, Panicum virgatum
  misc_feature: Ceres CLONE 2033653
  misc_feature: Encodes the peptide sequence at SEQ ID NO. 47009
agttctgcacactttcctcttcctcgacgcctcaagcaaaccatggcagtcgctgtcctcgcgtctccgcgagagcatagctcgatcgcttccaggatcaccgagctacatcggacgacgtgtgctttcggctgggtattacccatctacatatatcctgaaatcgagcgtagcggctatgtgaatgagaagttacccttctctggttcagcgattgtgtatcgagaaggttgggtttctgcaaatcccgagtggaagtcatctgaattctgtatcgtggaaaccgttagccagagcttcgtcgttcatgaaaaagagttcattggaggaagagctcgtgctcacaagacgcataggttactctgttgtccacaaaaagaaaaccttgatgagcatcacggaattatttggcgcagaccctacaaaataattgaggggatttgcaagggtttggcatacctcgatagacaacgggaacatcgtatttgtcattttgatgtaaaaccaaacaatattttgctggatgcaaatatggtgcctaaaatcgcagatttttgcctgtcaaggtacttcgggggaaaaattgtagcaacaaataaaattgtgaagtacaatggaggaatacttctttctgacaagatggagaggttactctgttttgagtatttgcagaacgggaaccttgctgctgcgtatctttctgatgagcatcatgg

SEQ ID NO: 47009 - protein, 224 aa, Panicum virgatum
  misc_feature: Ceres CLONE 2033653
  misc_feature: SWISSPROT Homolog: EC 2.7.11.22 Cyclin-dependent kinase
MAVAVLASPREHSSIASRITELHRTTCAFGWVLPIYIYPEIERSGYVNEKLPFSGSAIVYREGWVSANPEWKSSEFCIVETVSQSFVVHEKEFIGGRARAHKTHRLLCCPQKENLDEHHGIIWRRPYKIIEGICKGLAYLDRQREHRICHFDVKPNNILLDANMVPKIADFCLSRYFGGKIVATNKIVKYNGGILLSDKMERLLCFEYLQNGNLAAAYLSDEHH

SEQ ID NO: 47010 - DNA, 718 bp, Panicum virgatum
  misc_feature: Ceres CLONE 2033664
  misc_feature: Encodes the peptide sequence at SEQ ID NO. 47011
gatttgaagacatcagcatctgttccttcaacaccacccttagtatccagagcagatccttcatcctccaggggtcatttgcaatcaacagattcagatttgatgaagaaagcacggcgttcaccaggatatcaattatacaggcaggtctcggatagcaaaattccatctctcagatctctcaacgaaatcagctctcctgaaggaagaccatcctcttccatgctctcagtctgtagcaatgacctgtcagcagcaggatcccatggtgagtcatctgatggttggtcaatgcgtacgttttctgaaatggttgcgacatcccaaagagagaggtggtcacttgacagtgagctcttaggatccatttccagtaaaatgacaagatcaaatgcttcaaattctacaagccttcctccagaccaagaggtgtgcaagctgtgtttgaaattgttaaaggaaagatcagcttggaatgctcaggagctggctgttgttgctgtgttgttgtgtggtcatgtttaccatgctgactgtctcgatagcataactacagaagctgaaaaatatgatccaccatgccctgtatgcacgcacggggagaaatgttcagtgaagctatttgggaagctggaatcaaagatcaagaataagatacccaaagatgtggtagttgatattgatctagatggaaacattaagcaccagaagaaaggca

SEQ ID NO: 47011 - protein, 239 aa, Panicum virgatum
  misc_feature: Ceres CLONE 2033664
  misc_feature (145)..(197): Pfam Name: zf-C3HC4 Pfam Description: Zinc finger, C3HC4 type (RING finger)
DLKTSASVPSTPPLVSRADPSSSRGHLQSTDSDLMKKARRSPGYQLYRQVSDSKIPSLRSLNEISSPEGRPSSSMLSVCSNDLSAAGSHGESSDGWSMRTFSEMVATSQRERWSLDSELLGSISSKMTRSNASNSTSLPPDQEVCKLCLKLLKERSAWNAQELAVVAVLLCGHVYHADCLDSITTEAEKYDPPCPVCTHGEKCSVKLFGKLESKIKNKIPKDVVVDIDLDGNIKHQKKG

SEQ ID NO: 47012 - DNA, 652 bp, Panicum virgatum
  misc_feature: Ceres CLONE 2033690
  misc_feature: Encodes the peptide sequence at SEQ ID NO. 47013
actccactttcctcgctcacgccaacaacgcctcttctctcctccccttgcctcctctccggtctccggcggcaaacagtctagccatgggctccacggccgccgacatggccgcggtcgccgacgaggaggcgtgcatgtacgcgctgcagctggcgtcgtcctccatcctgccgatgacgctcaagaacgccatcgagctgggcctcctcgacgtcctggaagccgcgcgcaagtccggcgcggcggcggcgtcgctggcgccggaggaggtggtggcgcggctgcccgtggcgccgaggaaccccgacgcgccggtgatggtggaccgcatgctccggctgctggcctcgtacgagatcgtcaagtgcgagatggaggagggcaaggacggcaagtactcgcggcgctacgccgccgcgccggtgtgcaagtggctgacgcccaacgaggacggcgtgtccatggccgcgctcgcgctcatgaaccaggacaaggtgctcatggagagctggtattatctgaaggacgccgttctcgacggcggcatcccgttcaacaaggcgtacggcatgacggcgttcgagtaccacggcactgacccccgcttcaaccgcgtgttcaacgagggcatgaagaaccactcggtgat

SEQ ID NO: 47013 - protein, 188 aa, Panicum virgatum
  misc_feature: Ceres CLONE 2033690
  misc_feature (31)..(88): Pfam Name: Dimerisation Pfam Description: Dimerisation domain
  misc_feature (97)..(188): Pfam Name: Methyltransf_2 Pfam Description: O-methyltransferase
  misc_feature: SWISSPROT Homolog: EC 2.1.1.68 Caffeate O-methyltransferase
  misc_feature: Functional homolog of the protein sequence given in SEQ ID NO 50400
  misc_feature: Useful for making plants with altered carbohydrate content
  misc_feature: Functional homolog of the protein sequence given in SEQ ID NO 50401
  misc_feature: Useful for making plants with altered cell wall content and/or composition
MGSTAADMAAVADEEACMYALQLASSSILPMTLKNAIELGLLDVLEAARKSGAAAASLAPEEVVARLPVAPRNPDAPVMVDRMLRLLASYEIVKCEMEEGKDGKYSRRYAAAPVCKWLTPNEDGVSMAALALMNQDKVLMESWYYLKDAVLDGGIPFNKAYGMTAFEYHGTDPRFNRVFNEGMKNHSV

SEQ ID NO: 47014 - DNA, 686 bp, Panicum virgatum
  misc_feature: Ceres CLONE 2033703
  misc_feature: Encodes the peptide sequence at SEQ ID NO. 47015
aaataataatctcgtgcttctctgggacaggcggtgacgcctgagatgcttgagttcatgaagcagctgcgccagcatgtcaccgtgggcgtggtgggcggatccgatctggtgaagattaccgagcagctcggcaggacagttattactgactacgattacgtcttctccgaaaatggcctcgttgcacacaagaacggagagctaattggaactcaaagtttgaaatcatttcttggagaagacaagctgaaggaatttattaacttcacccttcattacattgctgacttggatatcccaattaaaaggggtaccttcatagagttccgaagtggaatgattaatgtttctccgatagggagaaactgtagtcaagaagaacgtgaagaatttgagaagtacgataaggtgcataacattcgacctaaaatggtatctgtgcttcgtgaaaagtttgctcacttcaacttgacattttctattggagggcagattagttttgatgtatttcctcaaggttgggacaaaacgtactgcttgagatatcttgaggaatttcaagaaattcatttctttggggataagacctacaagggtggcaatgattacgagatatttgaatctgaaagaacagttggtcatacagttaccagccctgatgacacagcacagcagtgcagatc

SEQ ID NO: 47015 - protein, 213 aa, Panicum virgatum
  misc_feature: Ceres CLONE 2033703
  misc_feature (1)..(213): Pfam Name: PMM Pfam Description: Eukaryotic phosphomannomutase
  misc_feature: SWISSPROT Homolog: EC 5.4.2.8 Phosphomannomutase
MLEFMKQLRQHVTVGVVGGSDLVKITEQLGRTVITDYDYVFSENGLVAHKNGELIGTQSLKSFLGEDKLKEFINFTLHYIADLDIPIKRGTFIEFRSGMINVSPIGRNCSQEEREEFEKYDKVHNIRPKMVSVLREKFAHFNLTFSIGGQISFDVFPQGWDKTYCLRYLEEFQEIHFFGDKTYKGGNDYEIFESERTVGHTVTSPDDTAQQCR

SEQ ID NO: 47016 - DNA, 661 bp, Panicum virgatum
  misc_feature: Ceres CLONE 2033704
  misc_feature: Encodes the peptide sequence at SEQ ID NO. 47017
tcagaactcagagcaaccgagaaacacacaaaagcctgaggtcctgtttggtttggactagaaaagtctggactcgaaattttatcaattttgaccgctaattaagatatcaaacaaaatcaatttataaaactaacttcagaaccctacgctaggaattctgaataatctagtgaggtctttgaccgtgtgattagaaaatgattaatgtagtatcattgtagccaatcatcgattaattaccgtcattagattcgtcgcgaaaaattacactcatccctaaaagatttcgcaaatagacttcatttaggtgagattcttctatcgggaacgtgcgcacactgttcctaaaatttctaagaccgatccaaacacggcatgaatcatcgaagcgactgcaatcccagactccagtctcccgcgtcaatcactcaaaacaccaagcaaccacccaccgatcaacaatgtcgctgatccgccgtagcaacgcgttcgaccccttctccctcgacctctgggaccccttccagggctttcccttcggctccggcagcaacatcagcagcctctttccctcgttggcaggcaccaactcggagacggtcgccttcgccggcacccgcatcgactggaaggagactccggaggcgcacgtgttcaa

SEQ ID NO: 47017 - protein, 65 aa, Panicum virgatum
  misc_feature: Ceres CLONE 2033704
  misc_feature: Functional homolog of the protein sequence given in SEQ ID NO 51227
  misc_feature: Useful for making plants with modulated heat sensitivity
MSLIRRSNAFDPFSLDLWDPFQGFPFGSGSNISSLFPSLAGTNSETVAFAGTRIDWKETPEAHVF

SEQ ID NO: 47018 - DNA, 739 bp, Panicum virgatum
  misc_feature: Ceres CLONE 2033706
  misc_feature: Encodes the peptide sequence at SEQ ID NO. 47019
cagcacataccacggatctatatctcacttacctactggatacatgtggagccctcaacttatgccaaagccaaaagactggggccctctagtagatgttgtgggatattgcttcttaaatcttggaacaaagtatcaaccaccaccggagctatcacagtggcttcaacaggggaccaagccaatatatattggttttggtagcatgcctcttgatgatgagaagaaagtcactgctaccattttggatgcattaagagaaacaggacaaagggggatcattagccgtggttggggagctcttggaagtttttcagaagttccagtggatgtcttcatcttggaggattgccctcacgactggctatttcctcgatgtgctgcagtggtgcatcatggtggagcaggtactacagccgcagggctgatagctgggtgtcctaccacagtagtgccattctttggagaccagttcttctgggctgagagagttcatgcacgaggagtgggtcctgcacctatacctatagcagcactcacagttgaggcactttccaatgcaataagattcatgcttgatcctgaggtaaaatcacgagcaatggagctggcgatagcaatagggaatgaggatggcgtggcggctgctgtagacgcatttcaccgacatctgccttcggagttgccacttgctccacctgcacatgtagaggaagaacgcatagacttcttccaatgg

SEQ ID NO: 47019 - protein, 245 aa, Panicum virgatum
  misc_feature: Ceres CLONE 2033706
  misc_feature: SWISSPROT Homolog: EC 2.4.1.173 Sterol 3-beta-glucosyltransferase
STYHGSISHLPTGYMWSPQLMPKPKDWGPLVDVVGYCFLNLGTKYQPPPELSQWLQQGTKPIYIGFGSMPLDDEKKVTATILDALRETGQRGIISRGWGALGSFSEVPVDVFILEDCPHDWLFPRCAAVVHHGGAGTTAAGLIAGCPTTVVPFFGDQFFWAERVHARGVGPAPIPIAALTVEALSNAIRFMLDPEVKSRAMELAIAIGNEDGVAAAVDAFHRHLPSELPLAPPAHVEEERIDFFQ

SEQ ID NO: 47020 - DNA, 687 bp, Panicum virgatum
  misc_feature: Ceres CLONE 2033732
  misc_feature: Encodes the peptide sequence at SEQ ID NO. 47021
gcatgttaccttagtccatagaattaaccaccgcgccgctaagataggagttgcaaggcactgtgacgatgaccaccttatccctgagacctgcagggcagtgcaatgggagctgcctgctcgcacctgccacagcacggcaaccacgtatttcttggtggcgtcggcagcagaggcaaaccacgctgcatcgccagcaaatgcaacagtgttcagtggcaacattacacaatgataaggttgacgatcgcttgggcaagaatccatgcaattttcatccttctatatggggagatttcttcctacactactacgacgcagcagcttcctccaaacagcagacgtggatggtagaacgagcagatgaagtgaagcaagacgtggcaaaaatagtagcaagttcagttgcttgggaccttcatcataggctacaacttatcgatgcgctggagcgtctgtgcttggatcatttgttcgaagatgacattaacgctgcactgactcaaattaggacagttaatcttactgactgtgatcttcacacggtagctatgtggttttatctgcttcgtaagcacggacacagagtttcaccagatgtgtttgtgaggttcaaagatcaagaggggagctttcttgcgaacaatccagtggagctattgagtctgtataatgccgcacacctcg

SEQ ID NO: 47021 - protein, 162 aa, Panicum virgatum
  misc_feature: Ceres CLONE 2033732
  misc_feature (30)..(162): Pfam Name: Terpene_synth Pfam Description: Terpene synthase, N-terminal domain
  misc_feature: SWISSPROT Homolog: EC 4.2.3.13 (+)-delta-cadinene synthase
MQQCSVATLHNDKVDDRLGKNPCNFHPSIWGDFFLHYYDAAASSKQQTWMVERADEVKQDVAKIVASSVAWDLHHRLQLIDALERLCLDHLFEDDINAALTQIRTVNLTDCDLHTVAMWFYLLRKHGHRVSPDVFVRFKDQEGSFLANNPVELLSLYNAAHL

SEQ ID NO: 47022 - DNA, 681 bp, Panicum virgatum
  misc_feature: Ceres CLONE 2033750
  misc_feature: Encodes the peptide sequence at SEQ ID NO. 47023
gaagttatcgatcagttcttcaccttcgctctgctcctagctcgttgaagctgccatccatggggataccttctttctacaagtggctcgtgaccaaatacccaagcatcatctcctccgcaaaggatgaaccagaggggagccctgatggcgtcatctacgacaacctctacctcgacatgaattgcatcatccactattgcttccacccgcaagacagcaagcatgcagacatagatgtgtgccctccgacgacggtcaccgaggtcttggagtccatgttcgagtacttggaccgcctgttccgcatcgtcaggccgagaaggctcctctacttggcagttgatggcgttgctccttgcgccaaaatgaaccgaatgcggcggggacgtttccactctgctttgctagcaaggaaaaaggcgcttaaagaggaagagatgcggagggaattacaagctcaagggaaggaggtgccaccgccagagatttcagaggtttctgaccccaatgtcatcacaccaggaactgaattcatggagcagctatcacaagcgctccaatactacatccgtgccagactgaatactgaccccgggtggaaagacataatggtcatactctctgatgcaaatgttcccggagaaggagagcacaagatcatgtctttcatccgtgcac

SEQ ID NO: 47023 - protein, 207 aa, Panicum virgatum
  misc_feature: Ceres CLONE 2033750
  misc_feature (1)..(207): Pfam Name: XRN_N Pfam Description: XRN 5'-3' exonuclease N-terminus
MGIPSFYKWLVTKYPSIISSAKDEPEGSPDGVIYDNLYLDMNCIIHYCFHPQDSKHADIDVCPPTTVTEVLESMFEYLDRLFRIVRPRRLLYLAVDGVAPCAKMNRMRRGRFHSALLARKKALKEEEMRRELQAQGKEVPPPEISEVSDPNVITPGTEFMEQLSQALQYYIRARLNTDPGWKDIMVILSDANVPGEGEHKIMSFIRA

SEQ ID NO: 47024 - DNA, 682 bp, Panicum virgatum
  misc_feature: Ceres CLONE 2033759
  misc_feature: Encodes the peptide sequence at SEQ ID NO. 47025
cccgacgctcgacccgaaaaaaaaaaattctccgcggggggtaagggaaaggtcgcgtggcgtctcgcccacagtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggagaagaaggtgaccacatcagcatcttcttccacagcaccactggagacaaagcgagatgatgcacctgccgctgctgccactgaagctgtggctgagaagcaagcagagcaagagcccccaaagccacccagcaaccggtgtctgacttgccgcaagaaggtcgggctgaccggcttcctctgccgttgcgggggcaccttctgctccacgcaccgctacaccgactcccaccagtgcacctttgactataagaaggtggcacgggagcagatagccaagcagaatccagttgtgatggccgagaagataaacaagatcaaatgaatggttgtgaagggattcatgcctgggttcctgagtcctcaagttcactataatcgataggttccttcggggctcgggcggtggtctgggttagcgtggt

SEQ ID NO: 47025 - protein, 164 aa, Panicum virgatum
  misc_feature: Ceres CLONE 2033759
  misc_feature (104)..(144): Pfam Name: zf-AN1 Pfam Description: AN1-like Zinc finger
  misc_feature (21)..(45): Pfam Name: zf-A20 Pfam Description: A20-like zinc finger
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGGTFCSTHRYTDSHQCTFDYKKVAREQIAKQNPVVMAEKINKIK

SEQ ID NO: 47026 - DNA, 652 bp, Panicum virgatum
  misc_feature: Ceres CLONE 2033775
  misc_feature: Encodes the peptide sequence at SEQ ID NO. 47027
gttttctcgagcaaacctttcccttctcttggacagcgacgactcgactgggcgagcggcggcgccgtctgccacgtcttcgcccagctctttgccggcgacgagcgcatcctccaggagttagattcaagcggaaggcgccgcttcttcaagatgccgagggccacgagcgatgcaaagcttctgatccagtccctgagcaaggcgtatgctgccacaccaacaaatcttaagattatcgacctgtatgtcatttgtgctgtcgctaccgccatgattcaggttgcatacatgggattggttgggtcattccctttcaactccttcctctcaggtgtcctttcatgcataggaactgcagtacttgctgtttgcctccgcattcaagtgaacaaagacaacaaggaatttaaggatcttcccccagaaagggcctttgctgacttcgttctgtgcaacctggtgctccacctggtgatcatgaacttccttggataagcaaccgctgtacaccgagtggttaagattttgtagccccagattgtgtttgctgatcagtgtgtttaaatctttggaactgtcataatgccgagtatccatatgacttgtcacagattacctatgtaaagacagaattcttgagtccagtgtt

SEQ ID NO: 47027 - protein, 114 aa, Panicum virgatum
  misc_feature: Ceres CLONE 2033775
  misc_feature (3)..(114): Pfam Name: DAD Pfam Description: DAD family
  misc_feature: SWISSPROT Homolog: EC 2.4.1.119 Dolichyl-diphosphooligosaccharide--protein glycotransferase
  misc_feature: Functional homolog of the protein sequence given in SEQ ID NO 50454
  misc_feature: Useful for making plants with modulated flowering time
MPRATSDAKLLIQSLSKAYAATPTNLKIIDLYVICAVATAMIQVAYMGLVGSFPFNSFLSGVLSCIGTAVLAVCLRIQVNKDNKEFKDLPPERAFADFVLCNLVLHLVIMNFLG

SEQ ID NO: 47028 - DNA, 567 bp, Panicum virgatum
  misc_feature: Ceres CLONE 2033798
  misc_feature: Encodes the peptide sequence at SEQ ID NO. 47029
aaagcgctaactctttcggatgggaattttggctcagggcgtagggttctgctatggccagtgacaatgtgcttgagttcgaggaggtcgccaagcacaacgtcaccaaggactgctggatcatcatcgccggcaaggtttatgatgtcacaccctttatggatgagcatcctgggggagatgaggttttgctagctgtaactgggaaagatgctactgctgattttgaagatattggccacagcgattcggctagggagatgatggagaagtaccatattgggcagattgatgcttcaaccatcccagtaaagcgtacttatgtgaatccccaggaagctcccagccacgtggacaaggataatgacttcctcatcaaaatcttgcagtttctcgttcccattatgatcctgggacttgcgtttggtatccggcagtacaccaaatcggagtagctcaactcgtagaggttcacctatgtgaaatgatttggatgaaaataatgcaataactgtgtatttgtcaggtagaagaatgttatctcattggccataagtactctgtact

SEQ ID NO: 47029 - protein, 133 aa, Panicum virgatum
  misc_feature: Ceres CLONE 2033798
  misc_feature (6)..(80): Pfam Name: Cyt-b5 Pfam Description: Cytochrome b5-like Heme/Steroid binding domain
MASDNVLEFEEVAKHNVTKDCWIIIAGKVYDVTPFMDEHPGGDEVLLAVTGKDATADFEDIGHSDSAREMMEKYHIGQIDASTIPVKRTYVNPQEAPSHVDKDNDFLIKILQFLVPIMILGLAFGIRQYTKSE

SEQ ID NO: 47030 - DNA, 698 bp, Panicum virgatum
  misc_feature: Ceres CLONE 2033803
  misc_feature: Encodes the peptide sequence at SEQ ID NO. 47031
acacagatacattcgtcgatccaccagaccaccactgtccagtgctcggctcggttacgcacgcacgcacacaaataggagtacctgttttacaccaagatactagcaagcccaagccgagtcgacaaacaagcagcaggaagaggcatggcgctcgcggaggggaacggcgcggccatcttcggcgaggagcaggaggcgctggtgctcaagtcgtgggccctcatgaagaaggactcggccgacctcggcctccgcttcttcctcaagatcttcgagatcgcgccgtcggcgaagcagatgttctcgttcctgcgcgactccgacgtgccgctggagaagaaccccaagctcaagacccacgccatgtccgtcttcgtcatgacctgcgaggcggcagcgcagctacggaaggccgggaaggtcaccgtcagggagacgacgctcaagcggctgggcgcaacgcacttcaagtacggcgtcgccgacggccacttcgaggtgacaaggttcgcgcttcccgccgacttgtggagcctggagatgaagaacgcctggagcgaggcttacaaccagctcgtggcggccatcaagcaggagatgaagcctgccgcatgatgctgcatgctgctacatactcggcctccgagttccccctacgatgcaccaccatctccaagttctttcattgtcttgtg

SEQ ID NO: 47031 - protein, 156 aa, Panicum virgatum
  misc_feature: Ceres CLONE 2033803
  misc_feature (16)..(125): Pfam Name: Globin Pfam Description: Globin
  misc_feature: Functional homolog of the protein sequence given in SEQ ID NO 50202
  misc_feature: Useful for making plants with modulated cold sensitivity
  misc_feature: Useful for making plants with modulated salt sensitivity
MALAEGNGAAIFGEEQEALVLKSWALMKKDSADLGLRFFLKIFEIAPSAKQMFSFLRDSDVPLEKNPKLKTHAMSVFVMTCEAAAQLRKAGKVTVRETTLKRLGATHFKYGVADGHFEVTRFALPADLWSLEMKNAWSEAYNQLVAAIKQEMKPAA

SEQ ID NO: 47032 - DNA, 674 bp, Panicum virgatum
  misc_feature: Ceres CLONE 2033826
  misc_feature: Encodes the peptide sequence at SEQ ID NO. 47033
gtagactacgacggctgaacttgccgaattttctagctatgcgtgtcctcgattagtcagccctaccaagtccgatctagtctcttcaatggcgtcatcgtccgtcgcctccctcttctccgccgcctcggctctccccgccggcgtcggcgcgcgccagcagcagcggcagccgaggcggctggtggcggcggcggctgcggcgaagcgccggtacaaggggacggtgaggagggaggcggcgctggcggagctggtggagcggaaggtggcggaggcgatggaggcgtgcgcggggcgcgaggcggaggccgggtgccgcgtggcgtgggacgaggtggaggaggtgagccaggccagggccgacctccgccgccgcatcgccgaggcccccggcgacccactcgagcccttctgcgcgcacaaccccgatgccgacgactgcgccgtcgtctacgtcgacgactgactctgaaccatcatgggcgtggtctttgcttactgcctgcagatcgatcgaggctccagaaagagggcatgtttcagctttcagctttgcattgaattatcagacacgttagttatagcaatggtatgattaggcaccattagcgttgcctcttcaattagagagagcaagaatttatttcagtttcatggcggtttcagctgcc

SEQ ID NO: 47033 - protein, 126 aa, Panicum virgatum
  misc_feature: Ceres CLONE 2033826
  misc_feature (53)..(125): Pfam Name: CP12 Pfam Description: CP12 domain
MASSSVASLFSAASALPAGVGARQQQRQPRRLVAAAAAAKRRYKGTVRREAALAELVERKVAEAMEACAGREAEAGCRVAWDEVEEVSQARADLRRRIAEAPGDPLEPFCAHNPDADDCAVVYVDD

SEQ ID NO: 47034 - DNA, 643 bp, Panicum virgatum
  misc_feature: Ceres CLONE 2033831
  misc_feature: Encodes the peptide sequence at SEQ ID NO. 47035
agttcacaccaaagatcaaagcttccgatccagcactcgaatagctagctccgaccaagcacttgagcaaatccaccagcagtgtccgatacgcgctcccaaacccaaccgacaacaatgtcgctggtgaggcgcagcaacgtgttcgaccccttcgccgacttctgggaccccttcgacgtcttccgctccgtggtgcccgcggcgtcgaccggccgcgacaccgcccccttcgccggcgcgcgcatcgactggaaggagacccccgaggcgcacgtcttcaaggccgacctccccggcgtcaagaaggaggaggtcaaggtggaggtggaggacggcaacgtcctggtgatcagcggcgagcgcaacagggagaaggaggacaagaacgacaagtggcaccgcgtggagcgcagcagcggcaagttcctccgccggttccgcctgccggagaacgccaagacggaggaggtgaaggccgggctggagaacggcgtgctcacggtcaccgtgcccaaggccgaggtcaagaagcccgaggtgaaggccatcgagatctctggctgagagttcggtctttacggtcgcgctcgggtcaaagtatggtcgtcgtgtttctgaatcctgtgctctgatgatgatg

SEQ ID NO: 47035 - protein, 149 aa, Panicum virgatum
  misc_feature: Ceres CLONE 2033831
  misc_feature (45)..(148): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFADFWDPFDVFRSVVPAASTGRDTAPFAGARIDWKETPEAHVFKADLPGVKKEEVKVEVEDGNVLVISGERNREKEDKNDKWHRVERSSGKFLRRFRLPENAKTEEVKAGLENGVLTVTVPKAEVKKPEVKAIEISG

SEQ ID NO: 47036 - DNA, 573 bp, Panicum virgatum
  misc_feature: Ceres CLONE 2033835
  misc_feature: Encodes the peptide sequence at SEQ ID NO. 47037
gcagtacaggaagcacaagaaagccacttctagccatcaacaacgacttcttcaccatcatcgtcacctaactcagacagtattagcgactgaagaagaagaagaagatgagctcctccgcggaaccagctgtgtgcggcggcggcggcaagacgtcgtggccggaggtggtggggatgagcatagaggaggccaagaaggtgatcctcaaagacaagcccgacgccgacatccaggtgctgccggtcggcacgccggtgaccaaggatttccgccccaaccgtgtccggatcttcgtcaacaccgtcgccgagacgcctcatgtgggctagcttagctgctcatagctgttgctcagagcatgatgctgcgtgccaaataaagccatcttcagtatgaataataatggatgtgtgttctttccctataaatcaaataaataagcaagggatgtgcccccggcatgtccctttcctctaaataatgccatattatgtgtaataaaagcatcgatcatatcctggcatgaaaaagatgaatcagctatatcagcggaccatcttcttgtttctc

SEQ ID NO: 47037 - protein, 74 aa, Panicum virgatum; identical to SEQ ID NO: 46142
  misc_feature: Ceres CLONE 2033835
  misc_feature (15)..(74): Pfam Name: potato_inhibit Pfam Description: Potato inhibitor I family

SEQ ID NO: 47038 - DNA, 575 bp, Panicum virgatum
  misc_feature: Ceres CLONE 2033837
  misc_feature: Encodes the peptide sequence at SEQ ID NO. 47039
cccgaaaccctagcattcctcacgctgcgccgccgacggtgattaggagcaggagccagaagagggatctgcgatggccaagtcaaagaaccacacggcgcacaaccagtcgtacaaggcgcacaagaacggcatcaagaagcccaagcgccaccgtcagacctccactaacgggatggacccaaagttcctgaggaacctgaggtactcgaggaagaacaacaataagagtggtgaggctgaggctgaggctgaggagtaaactggtggaatttcagatgatgaattcctgtcttgtatcgctaggatcttgaacttaatgctctgttctgtatgaccaaaggagattcctcagttggtaccattttttttttgtcttgctgtctggctggatttgaattaaaaccgtcatttgcagccttatgagaattgggaacccgagtatgtcgttctagtttctgtggtgtctattatcaccagttttacctgctgtaactgacgtgacgtcttatgtggtggtttgctcagacattctgtctatcaagcatttgggcacatcgcctgccttgccaccg

SEQ ID NO: 47039 - protein, 62 aa, Panicum virgatum; identical to SEQ ID NO: 44665
  misc_feature: Ceres CLONE 2033837
  misc_feature (3)..(42): Pfam Name: Ribosomal_L29e Pfam Description: Ribosomal L29e protein family

SEQ ID NO: 47040 - DNA, 656 bp, Panicum virgatum
  misc_feature: Ceres CLONE 2033873
  misc_feature: Encodes the peptide sequence at SEQ ID NO. 47041
aaacactcgaagcgaaagatcagaagctcaccaaatcactcaatcctcactcaagaatcctcgattccgctaaaccgccagtcagaaatcccaccgaccatgtcgctgatccgccgcagcaacgtgttcgaccccttctccctcgatctctgggaccccttcgagggcttccccttcggctccggcagcagcagcagcctcttcccctcgttcccgcgcaccagctcggagaccgcggccttcgccggcgcgcggatcgactggaaggagacgccggaggcccatgtcttcacggcggacgtgccggggctgaagaaggaggaggtcaaggtggaggtcgaggacggcaacgtcctccagatcagtggcgagcgcagcaaggagcaggaagagaagaacgaccggtggcaccaggtggagcgcagcagcggcaggttccttcgcaggttcaggctgccggagaacgccaaggcagagcagatcaaggcttccatggagaacggcgtgctcaccgtcaccgtgcccaaggaggaggctaagaagcccgatgtcaagcccgtccagatcaccggctaggaaggaaggagcacgcgtggcctgtggagctccaagtacctgttctggaaacgaatgccttctgtattttgtgggatggt

SEQ ID NO: 47041 - protein, 158 aa, Panicum virgatum
  misc_feature: Ceres CLONE 2033873
  misc_feature (54)..(157): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFEGFPFGSGSSSSLFPSFPRTSSETAAFAGARIDWKETPEAHVFTADVPGLKKEEVKVEVEDGNVLQISGERSKEQEEKNDRWHQVERSSGRFLRRFRLPENAKAEQIKASMENGVLTVTVPKEEAKKPDVKPVQITG

SEQ ID NO: 47042 - DNA, 700 bp, Panicum virgatum
  misc_feature: Ceres CLONE 2033889
  misc_feature: Encodes the peptide sequence at SEQ ID NO. 47043
aacccagcgaaaccaacacacagaaagagagagcaagtagtcgggggcagtgcaactcatccagcgcacgcacagcccgtcgctccgttccaccgccgccgaactccgggcgatcctcctcccccttgttcctcccacccttcccctgccctcccctccctctccggatcgagccgagcccaggaggagagcgagacgatggtgtccgccgtgctgaggaccatcctggtgacgggcggcgccgggtacatcggcagccacaccgtgctgcagctgctccagcagggcttccgcgtcgtcgtcgtcgacaacctcgacaacgcctccgaggtcgccctcctccgcgtcgccgagctcgccggccacaacggcagcaacctcgtcttccacaaggtacgattcgctggttatactctgccctctcgccgattaattgctcgcagctgctgggccggagaaggcgcaaggattgatcgatttctcctccccgtcctcgtcctccgtctctccgcgggctggggagccgattcttccattcggctttcctttcatctgtttgttcgtttcttaattccgcagcacgaatagaattcacgaaccttccttccttcctttcccttgagttgattattttttatactgctcccgttcggcggggtggtttcccttccccacgcattgggttgcgggggcggtttcg

SEQ ID NO: 47043 - protein, 129 aa, Panicum virgatum
  misc_feature: Ceres CLONE 2033889
  misc_feature: SWISSPROT Homolog: EC 5.1.3.2 UDP-glucose 4-epimerase
MVSAVLRTILVTGGAGYIGSHTVLQLLQQGFRVVVVDNLDNASEVALLRVAELAGHNGSNLVFHKVRFAGYTLPSRRLIARSCWAGEGARIDRFLLPVLVLRLSAGWGADSSIRLSFHLFVRFLIPQHE

SEQ ID NO: 47044 - DNA, 662 bp, Panicum virgatum
  misc_feature: Ceres CLONE 2033899
  misc_feature: Encodes the peptide sequence at SEQ ID NO. 47045
ccccgtttggtttctctgggcagttcctagcacgaatttcttttgcatcgttcctccccctgccttgcagcttgcaggatctccagcacctccacgcctcgatccagatccagctgaaagatggatgcgaacagacgccagagtggaattcagcagttgttgtctgcagagcaagaggctcagcagattgtaaatgcagctagggcagccaaatcggcaaggcttaggcaagccaaggaagaagctgagagggaaatagctgaataccgttcccaaatggaggctgaattccagagaaaggttgcagagagcagtggtgactctggtgcaaatgttaaacgtctcgagcaagagacagcggcaaaaattgaacaactcaatcaacaggctgcaagtatctcctctgaagttattcagatgttgctgaggcatgtgaccactgtgaagaactaaacgttgctgtgcggtgaatatatgattgcaaccttttgtatctctcaatttctttatatcagaggggtagtaaaggatttgtcacttatagctgtaattccatgttattgatcacagaataagctgctgcagtttagcagcaaacctgccttgtactatcagaacttggtgatcatttggtatcagtaaatattgtgttttctggtttc

SEQ ID NO: 47045 - protein, 110 aa, Panicum virgatum
  misc_feature: Ceres CLONE 2033899
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDANRRQSGIQQLLSAEQEAQQIVNAARAAKSARLRQAKEEAEREIAEYRSQMEAEFQRKVAESSGDSGANVKRLEQETAAKIEQLNQQAASISSEVIQMLLRHVTTVKN

SEQ ID NO: 47046 - DNA, 617 bp, Panicum virgatum
  misc_feature: Ceres CLONE 2033901
  misc_feature: Encodes the peptide sequence at SEQ ID NO. 47047
ctcgccatgctcgagctccgctccacgcccatcaacaccaagggctacgagacgctgttccgcctggtggacaacacctgcagcgacagcttcgacctctacaacggcctcttcatgtacaacaagaactccaccgagctgctcaaccgcctcgaatgggccatggactccgtcaagaagaagctcttcgacggcctccacgacgtgctccggaagcagctcttcgagggctcggcgcaggttcccagcacctccaacgtccgcaagtaaccatggcgaattcgtctcagctgagctagtaattcagttcgtctgtgcttgctagctgctcgtttcatgatcatcgagccgtatacatttgccttgtatcagtctgtatctgtattctccccaatcgaggtttgatttgagaggggttcttcctctctctctctctctctctctctctctctctctctctctctctctctggaagaagatgaagaacccccatattcctagtcaattccgctacattccaagtgtcccctctttgctgttggaaatgtggtaggttgacattgggaaatttgtgatatggtgatgaacaaagtgaataaaggagccatctttccatt

SEQ ID NO: 47047 - protein, 89 aa, Panicum virgatum
  misc_feature: Ceres CLONE 2033901
  misc_feature: SWISSPROT Homolog: EC 1.3.1.78 Arogenate dehydrogenase (NADP(+))
LAMLELRSTPINTKGYETLFRLVDNTCSDSFDLYNGLFMYNKNSTELLNRLEWAMDSVKKKLFDGLHDVLRKQLFEGSAQVPSTSNVRK

SEQ ID NO: 47048 - DNA, 676 bp, Panicum virgatum
  misc_feature: Ceres CLONE 2033910
  misc_feature: Encodes the peptide sequence at SEQ ID NO. 47049
aatgctccgacatttatcagagctgaggtcctacctagtggttatcttattcgaccgtgtgaaggtggaggctccatgatttacattgtggatcatgttgatctgaatgctaagagtgtgcctgaggttcttcgaccactctatgaatcacctaagatactggcgcagaagatgactgctgcggcgttgcgacacattaggcaaattgcacatgaatcaagtggtgaaatcccctttgttgctgggcaccagccagctgttctcagaaccttcagtcaaaggctgagcagaggcttcaatgatgctgtgagtggttttccggatgatggctggtctcctttgttgagcagtgatggccctgaggatattacaattacagtcaactcatctccaaacaaacttgttggatctcatgtcagcctctccccattcttttctgctatagggggtggcattatgtgtgccaaagcatcgatgctattgcagaatgtgccacctgctctacttgtgcaattcctgagggagcatcgctctgaatgggctgatcctggtgttgacgcttattctgctgcctctttgagggccaacccatatgctgttccaggtctaagggctggtgggtttatgggcacccaggttatactaccccttgctcgtaccttggagcacgaagagt

SEQ ID NO: 47049 - protein, 225 aa, Panicum virgatum
  misc_feature: Ceres CLONE 2033910
  misc_feature: Functional homolog of the protein sequence given in SEQ ID NO 50330
  misc_feature: Useful for making plants with altered carbohydrate content
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
NAPTFIRAEVLPSGYLIRPCEGGGSMIYIVDHVDLNAKSVPEVLRPLYESPKILAQKMTAAALRHIRQIAHESSGEIPFVAGHQPAVLRTFSQRLSRGFNDAVSGFPDDGWSPLLSSDGPEDITITVNSSPNKLVGSHVSLSPFFSAIGGGIMCAKASMLLQNVPPALLVQFLREHRSEWADPGVDAYSAASLRANPYAVPGLRAGGFMGTQVILPLARTLEHEE

SEQ ID NO: 47050 - DNA, 744 bp, Panicum virgatum
  misc_feature: Ceres CLONE 2033912
  misc_feature: Encodes the peptide sequence at SEQ ID NO. 47051
agcacaaagagcaaatcatcaatcgatcgatccgcaagcgaactggaagcgaagaacagctctcgatttcgaaatcgcgctcaggcatacgccccgcatctaaattcttagcttgatctggtcggagaagaaggcggcagccggcaggaggaaggagagatggcgagcaagaacggcggcggcaagggggagggcccggcgatcggcatcgacctcggcaccacctactcgtgcgttggggtgtggcagcatgaccgggtggagatcatcgccaacgaccagggcaaccgcaccacgccctcgtacgtggccttcgccgacaccgagaggctcatcggcgacgccgccaagaaccaggtcgccatgaaccccaccaacaccgtcttcgatgccaagcggctcatcggcaggcgcttctcggacccgtccgtgcaggcggacatgaagatgtggccgttcaaggtcgtccccggccccgccgacaagcccatgatcgtggtcacctacaagggcgaggagaagaagttctcggccgaggagatctcctccatggtgctcaccaagatgaaggagatcgccgaggcctacctcagcaccaccatcaagaacgccgtcatcaccgtgccggcctacttcaacgactcccagcgccaggccaccaaggacgccggcgtcatcgcgggccctcacgtcatgcgcatcatcaacgagcccacggccgccgccatcgcctacgggctcgac

SEQ ID NO: 47051 - protein, 194 aa, Panicum virgatum
  misc_feature: Ceres CLONE 2033912
  misc_feature (14)..(194): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MASKNGGGKGEGPAIGIDLGTTYSCVGVWQHDRVEIIANDQGNRTTPSYVAFADTERLIGDAAKNQVAMNPTNTVFDAKRLIGRRFSDPSVQADMKMWPFKVVPGPADKPMIVVTYKGEEKKFSAEEISSMVLTKMKEIAEAYLSTTIKNAVITVPAYFNDSQRQATKDAGVIAGPHVMRIINEPTAAAIAYGL

SEQ ID NO: 47052 - DNA, 702 bp, Panicum virgatum
  misc_feature: Ceres CLONE 2033922
  misc_feature: Encodes the peptide sequence at SEQ ID NO. 47053
ttactttgagaagccaagtcgactggtgcgcttcaaagaagcgtcagaaactagaccgaccgatcctgattatgcccaaggttacaagatcatgtttacagattgtttcccgtttctgatagcctctcagggctcactggatgcactaaatgagattcttaaagaacctataccaatgaaccgcttcagaccaaatattttagtggatggatgccaaccatattcagaggatctgtggaaaaccataaagataaacaacctaacatttcaaggtgtgaagttatgcaaccgttgcaaggtaccaaccattaatcaagacaatggaatatctggcaccgaaccaactgaaactttacagacatttcggtctgacaaagtgctgcgtccaagccacaaaaataaacggcaggtgtactttggtcagaatttagtctgcaaggaatctctatcaggaaacaacaaaggaaagatcatcaaggttggcgatccagtttatgttcagcaggcattcacttcttctaatgaagccccagcctgaatcagggcttttcagtttcccatgtgcaatggactatagtagcatttaaaccaagttgtcaacaaaacaagagaaatgcatttgtcatgtgcattgtgctcagattaaagaaacagcaggctgttaagactattggatgatgcaataaaacattttcactgcac

SEQ ID NO: 47053 - protein, 178 aa, Panicum virgatum
  misc_feature: Ceres CLONE 2033922
  misc_feature (18)..(166): Pfam Name: MOSC Pfam Description: MOSC domain
YFEKPSRLVRFKEASETRPTDPDYAQGYKIMFTDCFPFLIASQGSLDALNEILKEPIPMNRFRPNILVDGCQPYSEDLWKTIKINNLTFQGVKLCNRCKVPTINQDNGISGTEPTETLQTFRSDKVLRPSHKNKRQVYFGQNLVCKESLSGNNKGKIIKVGDPVYVQQAFTSSNEAPA

SEQ ID NO: 47054 - DNA, 729 bp, Panicum virgatum
  misc_feature: Ceres CLONE 2033947
  misc_feature: Encodes the peptide sequence at SEQ ID NO. 47055
ggcttgttagcttgttcctctccctctagcaggcctcacggaagaggacgatgcccaaggcgctgctcctccttgccgtgctgctgctcgcggctcgtctcggtcgcacacagcagccaaatgactcgctcaccacaggccaaccattgcttgatgggcaaacactgatttcagcacaaggtacttttacgctgggtttctttccaaatggagacaacacatatctaggaatatggttcaataacatgaaacctcggactgtcatctgggtggcaaaccgtgatgctccaatcaagggaggtaatggaagtcttaccctcagcacaaattctttggacctgctggatagaagaggaaacagtgtttggtcaagtagcagcttcagcaccaacagtccacaagccttccttctcgactccggaaaccttgtcatcaacgactctatgttatcagaggctccaaatccactatggcaaagttttgctgagccctgtgacacattgttgtctggtatgacaattgggactggtccatggaatggtcaggggttcagtggtcaaccttatatgaagacaacaaataagttggcctttaacatgagtgttcatgatgatagtgcgtattactcgttcacatctttggacagctcagtccagtggcgatttgtcatgagttcagacggccttgcacatcgctggtacagcaatccgagcaacgatgcttggggtg

SEQ ID NO: 47055 - protein, 226 aa, Panicum virgatum
  misc_feature: Ceres CLONE 2033947
  misc_feature (68)..(180): Pfam Name: B_lectin Pfam Description: D-mannose binding lectin
MPKALLLLAVLLLAARLGRTQQPNDSLTTGQPLLDGQTLISAQGTFTLGFFPNGDNTYLGIWFNNMKPRTVIWVANRDAPIKGGNGSLTLSTNSLDLLDRRGNSVWSSSSFSTNSPQAFLLDSGNLVINDSMLSEAPNPLWQSFAEPCDTLLSGMTIGTGPWNGQGFSGQPYMKTTNKLAFNMSVHDDSAYYSFTSLDSSVQWRFVMSSDGLAHRWYSNPSNDAWG

SEQ ID NO: 47056 - DNA, 365 bp, Panicum virgatum
  misc_feature: Ceres CLONE 2033951
  misc_feature: Encodes the peptide sequence at SEQ ID NO. 47057
gagacacgggccgtggtagcagctggctcgcccacaggctaagcgttgcgccggcggccggccatctcctcgatcgatcgccaagctccagctctagcttgcaacagagaggtcggtggtcgaggcgggagaccatgaagacgagtgccccgtcgggcaccggcggcggcgtcggcggcggtggcggccagcggccgatgagcatccgcggcatgttccggttcgcggaccgggtggacgtcgtgcttatggccctgggcacgctgggggccatcggcgacggctgctccaccaacctgctgctcatcttcgccagcgacgtgatgaacgcgctcgggtacggtcgcggagcttcctgcgccgcg

SEQ ID NO: 47057 - protein, 76 aa, Panicum virgatum
  misc_feature: Ceres CLONE 2033951
  misc_feature: SWISSPROT Homolog: EC 3.6.3.44 Xenobiotic-transporting ATPase
MKTSAPSGTGGGVGGGGGQRPMSIRGMFRFADRVDVVLMALGTLGAIGDGCSTNLLLIFASDVMNALGYGRGASCA

SEQ ID NO: 47058 - DNA, 679 bp, Panicum virgatum
  misc_feature: Ceres CLONE 2033967
  misc_feature: Encodes the peptide sequence at SEQ ID NO. 47059
acggatccatccatctctcctttgctctttcccttcaattcaactcgtctcacagaactctttccgagagatcgagacaatccggcggagctaagcaacggcgatggcttttagcccgagggctcgcgtgctggcggcggcgctgctcctgggcctctgctgcggcgcgcctaagaagaggacgttccgcaagtacagttaccgcggcgtcgacctcgacgcgctgctcgacatgtccaccgacgacctcgtccagctcttccccgcgcgcgcaaggagaaggttccagaggggtctgaagaggaagcccatggcgctcatcaagaagctgcgcaaggcgaaaaaggatgctcctgccggtgagaagccggagccagtgaggacccatctccgcaacatgatcattgtccctgagatgattggaagcatcatcggtgtctacaatggcaagacattcaaccaggttgagatcaagcctgagatgattggccactacctcgctgagttctccatctcctacaagccggtcaagcacggtaggcctggtattggtgccactcactcctcgcggttcattccgctgaaatgagttattggccagttgtcagcccagaatccagcatggaaggcgcatggcatgtccatgtttccttccagctgtgcagcttgttttgaacaa

SEQ ID NO: 47059 - protein, 161 aa, Panicum virgatum
  misc_feature: Ceres CLONE 2033967
  misc_feature (63)..(144): Pfam Name: Ribosomal_S19 Pfam Description: Ribosomal protein S19
MAFSPRARVLAAALLLGLCCGAPKKRTFRKYSYRGVDLDALLDMSTDDLVQLFPARARRRFQRGLKRKPMALIKKLRKAKKDAPAGEKPEPVRTHLRNMIIVPEMIGSIIGVYNGKTFNQVEIKPEMIGHYLAEFSISYKPVKHGRPGIGATHSSRFIPLK

SEQ ID NO: 47060 - DNA, 702 bp, Panicum virgatum
  misc_feature: Ceres CLONE 2033970
  misc_feature: Encodes the peptide sequence at SEQ ID NO. 47061
gcagaactcagaacagccgagaaacacacacgcgagcctgaatcaataatcatcgaatcgaagcaacagcaatcccagtctcccgcgtcactcaaacaccaagcaaccacccaccgatcaacaatgtcgctgatccgccgcagcaacgtgttcgaccccttctccctcgacctctgggatcccttccagggcttccccttcggctccggcagcggcagcagcaacctcttcccctcgtttgcaggcaccaactctgagaccgcggccttcgccggcgcccgcatcgactggaaggagaccccggaggcgcacgtgttcaaggcggacgtcccggggctgaagaaggaggaggtcaaggtggaggtcgaggacggcaacgtgctccagatcagcggcgagcgcaacaaggagcaggaggagaagaacgacaagtggcacagggtggagcgcagcagcggcaagttcctgcgccggttcaggctgccggagaacgccaagacggagcagatcagcgcgtccatggagaatggcgtgctcaccgtcaccgtgcccaaggaggaggtcaagaagcccgaggtcaagcccgtccagatcaccggctagagccgggagcctggctgtttttgcgtcgtgtggagtcgctcgacgtggagtctgttcttccattcttgggtcaaaatgctagtgttagcgtccgagtcc

SEQ ID NO: 47061 - protein, 159 aa, Panicum virgatum
  misc_feature: Ceres CLONE 2033970
  misc_feature (55)..(158): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLIRRSNVFDPFSLDLWDPFQGFPFGSGSGSSNLFPSFAGTNSETAAFAGARIDWKETPEAHVFKADVPGLKKEEVKVEVEDGNVLQISGERNKEQEEKNDKWHRVERSSGKFLRRFRLPENAKTEQISASMENGVLTVTVPKEEVKKPEVKPVQITG

SEQ ID NO: 47062 - DNA, 694 bp, Panicum virgatum
  misc_feature: Ceres CLONE 2033992
  misc_feature: Encodes the peptide sequence at SEQ ID NO. 47063
attcctccatgtccatcggcttccttcctcccctgttctcctcgatccctcgccgccgctggtccggctccatccatcgtcccaaccgcttcgtctttctcgcgcagctgtcgcaggtccccctagcgcctagagtttgctgagtccgtcggcccaagataatggctggacaccgaaacagtcatggaaaacggcactctgattatgctgaaaatggaggtggtaagagaagaaatcctggtgatgattcctatgctcctggtcccgatgatactgtgtatcgctacctctgctcctctagaaaaattgggagtatcattggccgtggtggagagattgcaaagcagttgaggaccgagactcaagctaagattaggattggcgagagtgttcctgggtgtgaagagcgagttatcacaatatttagctcaagcagggaaactaatactattgatgatgctgaagataaggtttgctctgctcaggatgctctctttagagttcatgagaggcttgcttctgatgagggtcctgggaatgaagacagtgaagaagttgtacctcaagttactgttcgtttgcttgtgccatcagaccagattggatgcattattggaaaaggtgggcatatcatccaaggaatccgcagtgagactggtgcgcaaatacgtgtgcttagtaatgatcatatccc

SEQ ID NO: 47063 - protein, 177 aa, Panicum virgatum
  misc_feature: Ceres CLONE 2033992
  misc_feature (39)..(104): Pfam Name: KH_1 Pfam Description: KH domain
  misc_feature (137)..(177): Pfam Name: KH_1 Pfam Description: KH domain
MAGHRNSHGKRHSDYAENGGGKRRNPGDDSYAPGPDDTVYRYLCSSRKIGSIIGRGGEIAKQLRTETQAKIRIGESVPGCEERVITIFSSSRETNTIDDAEDKVCSAQDALFRVHERLASDEGPGNEDSEEVVPQVTVRLLVPSDQIGCIIGKGGHIIQGIRSETGAQIRVLSNDHI

SEQ ID NO: 47064 - DNA, 691 bp, Panicum virgatum
  misc_feature: Ceres CLONE 2034017
  misc_feature: Encodes the peptide sequence at SEQ ID NO. 47065
aaggcctccaaggcattcttcaatgggctaatggattccgtattcaaggctcccatgtcattttttgactcaacaccagtgggaagaattttaacaagggcatcttcagatttaagcattctggactttgacataccttactccatggcttttgtcactactggtactattgaggttgttacaacagtactggtcatgggtactgtaacttgggaagtattgattgtggcaatcccagttacaatcaccatggtatatgttcagagctactacgtatcctcagctagagagctagtacgaataaatggaacgacaaaggcacctgtcatgaactatgcatcagagtcaatccttggtgtggtgaccatcagggcatttgcagcaatagataggttcatccacagcaacatggagctaattgacactgatgcgactctgttcttccacactattgctgcacaagagtgggtgcttataagagtggaggcactgcagtccttgacaataattacagcagcattgttccttgttctagttcctcccggagtaatttcaccaggttttgctggactttgcctctcctatgctttgacgctgactgcagcacaggttttcttgacaaggttttattcatacttggaaaactacatcatctcagttgagcgaatcaagcagtatatgcacctcccag

SEQ ID NO: 47065 - protein, 230 aa, Panicum virgatum
  misc_feature: Ceres CLONE 2034017
  misc_feature: SWISSPROT Homolog: EC 3.6.3.44 Xenobiotic-transporting ATPase
KASKAFFNGLMDSVFKAPMSFFDSTPVGRILTRASSDLSILDFDIPYSMAFVTTGTIEVVTTVLVMGTVTWEVLIVAIPVTITMVYVQSYYVSSARELVRINGTTKAPVMNYASESILGVVTIRAFAAIDRFIHSNMELIDTDATLFFHTIAAQEWVLIRVEALQSLTIITAALFLVLVPPGVISPGFAGLCLSYALTLTAAQVFLTRFYSYLENYIISVERIKQYMHLP

SEQ ID NO: 47066 - DNA, 684 bp, Panicum virgatum
  misc_feature: Ceres CLONE 2034023
  misc_feature: Encodes the peptide sequence at SEQ ID NO. 47067
agcacaagcagcaacgagccttcttcctgatcccaactccatcgagcaagctcgtcgtcgatctctctaactcgaagccccatcagcaacatgtcggacaagtgcagcaactgcgactgcgctgacaggagccagtgcacgaagggcaacagctatggcgtcgtcgtagtcgacaccgagaggtaactaacatgtcttttggattgttttcgcatgatgcacgcatgaaccttctttctgttcatgtagtagtatgatttaactatcatcatctcgtctgatggatggatgcgtcgtgcatgcagccgcgtcgagcgccgcgaggaggaggtcgctgccgccggcgagaacgacggcaagtgcaagtgcggcaccagctgcggctgcggcgccagctgcaactgcggccactgaagctcgccgcctacgatccatggccctgcacactccatccagatctacccagtacccaatcctgtacctgtacgtcgtcgatcacagagtatataaaataaaccgccatgcccgtgttgaatacgtacgtcgtgtcctatgtgtcctgcgtctctgctgctgtcatgtgaccagaaacctgtagctacctagcttgctacctgctgcctggctgtgtgacgtcctagctagctagcttatttggtgcaggcagggcgcgtatacgtgtct

SEQ ID NO: 47067 - protein, 31 aa, Panicum virgatum
  misc_feature: Ceres CLONE 2034023
  misc_feature: Functional homolog of the protein sequence given in SEQ ID NO 50873
  misc_feature: Useful for making plants with modulated nitrogen use efficiency
MSDKCSNCDCADRSQCTKGNSYGVVVVDTER

SEQ ID NO: 47068 - DNA, 572 bp, Panicum virgatum
  misc_feature: Ceres CLONE 2034049
  misc_feature: Encodes the peptide sequence at SEQ ID NO. 47069
aaggggcagcaagaacaggccacagaaagaacaatcccagcaatggcagcaaggtgtgctctttctgccccatccagcgtggttcgccaacccctctacggcaacaagctctccaagaatctcactccatgcctgccgtcgccaagagccgtgagggtgagagtgaatgctgcaaagcttcctccaggggttgaggtgcccagggtgcagccgaagctgagcgagcccttcttggggttcacccagactgccgagatctggaactccagggcctgcatgatgggcctcatcggcaccttcatcgtggagctggtgctgaacaaggggattcttcagataattggggtggaggtggggaagggcctcgaccttcctctttaattgccattggcaaagctgattgcaagccttactctctctctctctctctctctctctctctctctctctctctctctctctctctcaaaacctaagaatacctattatattgctctaaacattattctgtcaaatatagatactcatgcaattctgttgcgtaaccatatgacagagttttttaagttctc

SEQ ID NO: 47069 - protein, 112 aa, Panicum virgatum
  misc_feature: Ceres CLONE 2034049
  misc_feature: SWISSPROT Homolog: EC 4.99.1.1 Ferrochelatase
MAARCALSAPSSVVRQPLYGNKLSKNLTPCLPSPRAVRVRVNAAKLPPGVEVPRVQPKLSEPFLGFTQTAEIWNSRACMMGLIGTFIVELVLNKGILQIIGVEVGKGLDLPL

SEQ ID NO: 47070 - DNA, 497 bp, Panicum virgatum
  misc_feature: Ceres CLONE 2034052
  misc_feature: Encodes the peptide sequence at SEQ ID NO. 47071
ggcgctgccttcactgcccacccatcgcccaggaaaggtgccagtttgttccgtgatcgcgtcatcagcaggcgtgccaagatatcagctaagcttggtggagatggggagctgaagcctccaggcaagaagaagttcatcaccacggatgaggagcccgatcagtactggcagactgcaggggagagggagggtgagaaccccctgaagacgccccggccctacatcatcatcttcggcatgtccacccccttcgtcatcctcgccatcgcctttgccaatggctggatcaaggtccctgtactatgaaaccatgtcaccacgaagttaccagcaaaacaccttggcacttcctgcatcctctccagcgagagcactgcgagtttttaccttcatacagatgaagagtcaatgctttgtaatcttccgttcttcacacaagacggaggtttgtagttttgtactaccagcagtctgacaggaactgtcacatgtcc

SEQ ID NO: 47071 - protein, 102 aa, Panicum virgatum
  misc_feature: Ceres CLONE 2034052
  misc_feature: Functional homolog of the protein sequence given in SEQ ID NO 51730
  misc_feature: Useful for making plants with modulated biomass
GAAFTAHPSPRKGASLFRDRVISRRAKISAKLGGDGELKPPGKKKFITTDEEPDQYWQTAGEREGENPLKTPRPYIIIFGMSTPFVILAIAFANGWIKVPVL

SEQ ID NO: 47072 - DNA, 703 bp, Panicum virgatum
  misc_feature: Ceres CLONE 2034062
  misc_feature: Encodes the peptide sequence at SEQ ID NO. 47073
acacacacactgtccgtccatccctctgatcagctctgctcttctgcttctcttcgacctcgccaagccacaccaatggcggcgcgcgctctcttgatgctgcgggaggcctccccgtgggcgctggccggcgcggcggcggccgtggcgctgctgtggctggtgacctggacggcggagtgggcctggtggacgccgcggcggctcgaccgggccctgcgggcccggggcctcaagggcacccggtaccgcctcttcaccggcgacctggcggagaacgcccggatcaaccgggaggctcgcaccaagccgctgccgctcggctgccacgacatcgccccacgcgtgcagcccatgctccacagagccatcaaggaatacggtagtttcaaatcaaccagctctctgccaatttgatccctttcgtttcattttcttgaggtgttttagtatcgggacaacaagctttactgcaattcttgtgacgatgtactatgcgtctatacttcaggatcgcattagagcatgaattttaatcttagtaacaagtaacaaaaagagaaacggtttacctgctcttctggtcttactactgtttcaggctgtatttatggtgattttcgaaactccaatgcagggaaaatgacgttcacctggtttgggccaataccgagggtgatgataccagacccggagttagtca

SEQ ID NO: 47073 - protein, 113 aa, Panicum virgatum
  misc_feature: Ceres CLONE 2034062
  misc_feature: SWISSPROT Homolog: EC 1.3.3.9 Secologanin synthase
MAARALLMLREASPWALAGAAAAVALLWLVTWTAEWAWWTPRRLDRALRARGLKGTRYRLFTGDLAENARINREARTKPLPLGCHDIAPRVQPMLHRAIKEYGSFKSTSSLPI

SEQ ID NO: 47074 - DNA, 617 bp, Panicum virgatum
  misc_feature: Ceres CLONE 2034063
  misc_feature: Encodes the peptide sequence at SEQ ID NO. 47075
gacagaactatccatcaccaaggcgcgcccttccttccttgtgcgagttgtgtgggaatataatctactagtctaggagttgtatactatccgaacaagctaggcaggtacgatgagttcatccgtggtagccgtccaagacatggacgccttgtttgaagctgtggaaaaggctaataaagagaaaaagctgttcgtactggagttcatagggtcgacgtcctaccgaacgacatgcgagttcatgaagccgattgttaattcagtcgcaactactaacaacgaagccaacttttgtacagtcgacgtcgacaacaatgagttcaaggatctcgcgaaggcgtggaaagtgcaggccctgccgacattcctggtgataaaggacaactactcggtggaaaagcttgtcgcgcccgacaagcaggagctcatcgaaagcatcagcaaggctactaaaaagtgaaaacaaaatgtatctattgtaacatgcgtgcacattgatccatgtgtacccatccagagcacgtatgagcaccctgtatggtaatggtatggtagcacagtatatgtatgcctccatttcttcggaacaagagatccggactttgatgccctga

SEQ ID NO: 47075 - protein, 106 aa, Panicum virgatum
  misc_feature: Ceres CLONE 2034063
  misc_feature (8)..(103): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MDALFEAVEKANKEKKLFVLEFIGSTSYRTTCEFMKPIVNSVATTNNEANFCTVDVDNNEFKDLAKAWKVQALPTFLVIKDNYSVEKLVAPDKQELIESISKATKK

SEQ ID NO: 47076 - DNA, 748 bp, Panicum virgatum
  misc_feature: Ceres CLONE 2034065
  misc_feature: Encodes the peptide sequence at SEQ ID NO. 47077
gttttcttcctctctttcatcgtctcgccgttccgtccctccaaaaccctagacgcgaccctcccccagcgccgctcgccgccgcccgcggccatggatctcctccgctcgcacctccacaaggtccgcatcccggagtcggacgaggcggatcgcccgctcaagaagcccaccctccttgcaataggcgtggaaggaggctttggtgatcaagaacctgaatatgatgatacttttgaaatcgtcattttacctgattttatctctcttccattcccctcagttgacttgccagagaaggttaggattgcagttgataaggttatccttgctgaaagtgctgacagaaaacaacaactagctgcttgggtcgctgaaaagaagaatattagtgcatatgctatggatctgcagcagctagaaaatggtgttattgtgcctcctactggatggaagtgcagcaaatgcgataaaactgagaacctctggttgaatttaactgatggtatgatcctttgcgggaggaagctttgggatggaagcggtgggaataatcatgcaattgaacattacgagcagactaaatatcctcttgcagtaaagcttggaacaattactgctgatttggaagcagcagacgttttctcatacccggaagacgatagtgttgaagatccactattagctcgacacttgtcacattttggtatcgatttttcttcactttcaaagactgagattactactg

SEQ ID NO: 47077 - protein, 218 aa, Panicum virgatum
  misc_feature: Ceres CLONE 2034065
  misc_feature (122)..(199): Pfam Name: zf-UBP Pfam Description: Zn-finger in ubiquitin-hydrolases and other protein
  misc_feature: SWISSPROT Homolog: EC 3.1.2.15 Ubiquitin thiolesterase
MDLLRSHLHKVRIPESDEADRPLKKPTLLAIGVEGGFGDQEPEYDDTFEIVILPDFISLPFPSVDLPEKVRIAVDKVILAESADRKQQLAAWVAEKKNISAYAMDLQQLENGVIVPPTGWKCSKCDKTENLWLNLTDGMILCGRKLWDGSGGNNHAIEHYEQTKYPLAVKLGTITADLEAADVFSYPEDDSVEDPLLARHLSHFGIDFSSLSKTEITT

SEQ ID NO: 47078 - DNA, 713 bp, Panicum virgatum
  misc_feature: Ceres CLONE 2034073
  misc_feature: Encodes the peptide sequence at SEQ ID NO. 47079
aaagctagctcattcattcattcatcatcagctcctccgatcccccttccgcgcgagcagctgctctcccgatctccatcactactgcatgtcctagctagctagagctcagccacctagctagctagtacttgcagcagcagcagcagatcaagcatagcgtagccgccgccatgccgaccaagaaagcccgcgccggcggctgcgacatccaggccaccggcatcaactaccgcatcgccgtctccacccagccccctctcaaggtctggagcaggtcagacgacgacgcccaagaccaccaccaccaccacctcatcagcggcgtccgccacgtgctccgcaacgtcacctgccgcgcgcgccccggcgagctgctcgccatcgtcggccccagcggcgccggcaagtccacccttctcgagatcctcgccggccgcctctccccctccccggcgcccgacctgctcctcctcgacggcgccgccgccgccagcgccgacctccgccgcgtctccggctacgtcacccagcgggacgtcctcttcccgctgctcaccgtgcgcgagacgctgctcttcagcgctcgcctccgcctcggcgcgaccctgcccgccaaggacatggacgcccgcgtcgacgcgctcctcgacgacctcaccctgcgccgcgtcgccgccacgaggatcaaggacctctccggcggggagcgg

SEQ ID NO: 47079 - protein, 179 aa, Panicum virgatum
  misc_feature: Ceres CLONE 2034073
  misc_feature (66)..(178): Pfam Name: ABC_tran Pfam Description: ABC transporter
  misc_feature: SWISSPROT Homolog: EC 3.6.3.25 Sulfate-transporting ATPase
MPTKKARAGGCDIQATGINYRIAVSTQPPLKVWSRSDDDAQDHHHHHLISGVRHVLRNVTCRARPGELLAIVGPSGAGKSTLLEILAGRLSPSPAPDLLLLDGAAAASADLRRVSGYVTQRDVLFPLLTVRETLLFSARLRLGATLPAKDMDARVDALLDDLTLRRVAATRIKDLSGGE

SEQ ID NO: 47080 - DNA, 668 bp, Panicum virgatum
  misc_feature: Ceres CLONE 2034078
  misc_feature: Encodes the peptide sequence at SEQ ID NO. 47081
tccgagcaggatttccgcaagtatctgcctcggtttcaaccagagaaccttgataagaatgctcagatattcgaacgtgtcaacgcaatggctgcaagaaaaggttgcacaccatcacaactagcattggcttgggttcatcatcaaggaaacgatgtttgccctattccaggcacaacaaaaatcgagaatttcaaccaaaatgtgggggcactttctgtgaagctgactccagacgagatggccgaactcgagtcatatgctgccgcaggtgaagtcttgggtgaccggtatcctcagatggccaacacctggaaggattccgagacaccaccattgtcgtcttggaaatctgagtagcccaatacgatatcttcaactgcatgcatggcctatatctactacaagttcttgagctgcagaagatcctcggtctagtttgcaagagcgtccacaatatgtgcttgtcttgatgcaagtgatgatgtgttgtagtgtctattatgtgcttgtcttgatgcaagtgatatgtttggtagtgtgtattgtgtgaattgttgtgaacgtgatccctgctagaggtacaagtgataccggcgtggcttgtacaagaggtcacttgtacacggtacacaaacatggaaacaaataaacaatcctatgttgcc

SEQ ID NO: 47081 - protein, 119 aa, Panicum virgatum
  misc_feature: Ceres CLONE 2034078
  misc_feature: SWISSPROT Homolog: EC 1.1.1.65 Pyridoxine 4-dehydrogenase
SEQDFRKYLPRFQPENLDKNAQIFERVNAMAARKGCTPSQLALAWVHHQGNDVCPIPGTTKIENFNQNVGALSVKLTPDEMAELESYAAAGEVLGDRYPQMANTWKDSETPPLSSWKSE

SEQ ID NO: 47082 - DNA, 753 bp, Panicum virgatum
  misc_feature: Ceres CLONE 2034088
  misc_feature: Encodes the peptide sequence at SEQ ID NO. 47083
actgccacttcactccttccggatcaccttcacccctgccgctctgagcgcgccggagctccccgcctccaccagcccgcccgcgggccgcggctgccggatctcccgcggtatggcgattcgcccactccaccgctcccccctagcttccttccctccatagcgaggccgagcttgaactccggccacgggcgccccgcccgtcatctcagatctgtgcctggccggcgtcaccgggccacccaccgccggtcttctccggccctgactggccgcgggagaccccgaaactgaccgcgtccgggttgcgaagctgaggcgaagcattcggtacccgacgcgtgacgcgtgctcgacgaaatgtcgggccgccggagcaagaaagcgtcgagtgcggacggcggcgaccggatcagcggcctgccggacgaggtcctccaccgcgtgctgtcgcacctgccggcgcccgaggccgcgcggacgagcgtgctagccaggcgctggcgggacctctggaagtcgaaccgtcgcctgagcgtcgtttttccttggacgtccatgactgtcagcaggaccgagaggctcgcgaggttaatatcccagcacgggctccgccgcagccgcagcctccgccggcctcggttgagtattgcacgcctgctgagtgtcactggggataggactgcgctggctgttgacaggctgaacaggatggtgaaccgcctgcttctgctccgcgaccccgtgccgctc

SEQ ID NO: 47083 - protein, 130 aa, Panicum virgatum
  misc_feature: Ceres CLONE 2034088
  misc_feature (16)..(63): Pfam Name: F-box Pfam Description: F-box domain
MSGRRSKKASSADGGDRISGLPDEVLHRVLSHLPAPEAARTSVLARRWRDLWKSNRRLSVVFPWTSMTVSRTERLARLISQHGLRRSRSLRRPRLSIARLLSVTGDRTALAVDRLNRMVNRLLLLRDPVP

SEQ ID NO: 47084 - DNA, 759 bp, Panicum virgatum
  misc_feature: Ceres CLONE 2034090
  misc_feature: Encodes the peptide sequence at SEQ ID NO. 47085
aattcacaccgcccaaccccctccaaaacccacccgccccgctttccttctcgagctgtcgcccacaccctctccgtcccctccgccccctccccttccgcgcccgccggatctccaaccgccggttgcgagattttccagcattggttgttcagttgtttcacaatttaaaaaacctcaatttctggacttgctcagcaaaataagttcgttccgctgtagtcaatcccgactggtagcaatggcaaccactccagccaatggtaattcgcagagtggccctcagcggaactatcaggttgttgttgctgccacttgtgacttgggcattgggaagggtgggatcttgccatggaagcttcctggtgaccttaagttcttcaaggagcttacgctttcaacatctgaccctggcaagaagaatgcagttataatgggaaggaaaacatgggagagcattcctgttaagttgaggccattgcctggtcgtttgaatgtcatacttactcgatctggtagttttgattttgcaacagtagaaaatgttgttatctgtggaagcatgaagtctgccttagaattgctagcatcaactccatattgcttatcaattgagaaagtttttgttatagggggtgggcaggtactgaggaagtatcttaatggacctgcatgtgaggccatccatctaactgacattcagtcgagcattgagtgtgacactttcatccccccattgacttctcagtgttccaacca

SEQ ID NO: 47085 - protein, 172 aa, Panicum virgatum
  misc_feature: Ceres CLONE 2034090
  misc_feature (17)..(172): Pfam Name: DHFR_1 Pfam Description: Dihydrofolate reductase
  misc_feature: SWISSPROT Homolog: EC 1.5.1.3 Dihydrofolate reductase
MATTPANGNSQSGPQRNYQVVVAATCDLGIGKGGILPWKLPGDLKFFKELTLSTSDPGKKNAVIMGRKTWESIPVKLRPLPGRLNVILTRSGSFDFATVENVVICGSMKSALELLASTPYCLSIEKVFVIGGGQVLRKYLNGPACEAIHLTDIQSSIECDTFIPPLTSQCSN

SEQ ID NO: 47086 - DNA, 694 bp, Panicum virgatum
  misc_feature: Ceres CLONE 2034094
  misc_feature: Encodes the peptide sequence at SEQ ID NO. 47087
gctatgtgtgggcttgcaagaactatgatggagatgtgcagagtgatttcttggctcaaggttttggctcgctgggtttgatgacatcagtgttgactctcataaataaatacaatgacgctgatccattctgccggtaggtgtgccctgatgggaaaaccatcgaagctgaagctgctcatggcacagttacccgccacttccgtgttcaccagaaaggaggtgaaaccagtacgaacagcatcgcttcaatctttgcttggacgagaggacttgcacacagggcaaagctcgatgacaatgataggctacttgactttgcactcaaactcgaggctgcctgtgttggaactgtggagtctgggaagatgacaaaagatcttgcacttcttgttcacggctcttccaacgtcatgagaagccattacttgaacactgaagagttcattgatgccgttgctgctgagctccaatcaaaactggcagccaattgagcttacaggaagcttttggcaaatttagtgcttcaccacccaccactactaagtcatttcggctacattagcattgttattcacgcttcgcaatggagtgactgtgccttctgccatttggatgtaagctaattcaagatgctactagtgttatgcgcgcgctctgaataaaggacatagagttggccagtgctgtgatt

SEQ ID NO: 47087 - protein, 45 aa, Panicum virgatum
  misc_feature: Ceres CLONE 2034094
  misc_feature: SWISSPROT Homolog: EC 1.1.1.42 Isocitrate dehydrogenase (NADP(+))
YVWACKNYDGDVQSDFLAQGFGSLGLMTSVLTLINKYNDADPFCR

SEQ ID NO: 47088 - DNA, 451 bp, Panicum virgatum
  misc_feature: Ceres CLONE 2034110
  misc_feature: Encodes the peptide sequence at SEQ ID NO. 47089
cgactggaaaattgtggccatttctttggatgacccaaaagcatctcttgttaatgatgtggatgatgttgagaagcattttccggggacactgactgccatcagagactggttcagagactacaagataccagatggaaagcctgccaacagatttggtctcggcaacaagcccacaagcaaggaatatgcgctgaaggtcattgaggaaactaacgaatcatgggagaaattggtgaagaggaatatccctgctggagagctctcactagcctaatctcgaggccatgagaagccacaacattctttgaaccgcgttttccttgatcatgtcgttttgtatgctgtaactctgtaagcatgcttcttcattttgcggatgttttttcgaactgtgaaacaggaataatcttgtcgggtgaataatgattttggagcgagtttttactag

SEQ ID NO: 47089 - protein, 91 aa, Panicum virgatum
  misc_feature: Ceres CLONE 2034110
  misc_feature (1)..(77): Pfam Name: Pyrophosphatase Pfam Description: Inorganic pyrophosphatase
  misc_feature: SWISSPROT Homolog: EC 3.6.1.1 Inorganic diphosphatase
DWKIVAISLDDPKASLVNDVDDVEKHFPGTLTAIRDWFRDYKIPDGKPANRFGLGNKPTSKEYALKVIEETNESWEKLVKRNIPAGELSLA

SEQ ID NO: 47090 - DNA, 617 bp, Panicum virgatum
  misc_feature: Ceres CLONE 2034112
  misc_feature: Encodes the peptide sequence at SEQ ID NO. 47091
ctagaagaaccacggagttctgaaggcgatcaactaccaaggcttcaaagcttgcaaaggatactccaaggaagtgtggctgttcaggtcaacagtggagtgttaagtgtgtgcactgcattcttatccggtgagcctgcgaccaggctccgatcacaagaactgcagcagctcatcgctgcattgcttgaattcatggctgtctgcaagcgtgcgatccgtgtgcatttcagattgataggcgaagaagaccaggaattccacacccagctcgtcaacgggttccagtcactcactgctgagctgtctcactatatccctgctatactttctgagctatgatagtactgtagcaatctggaaattaggtagcatgtgaatggttgttcattctttcagtcgagatccccaccaaatgtccatatttccattagctttggttgtatagttctgagaactggaaattaactagtctttgcagttctgtaccgcttcgtagaaccaagtcccgattttggagtgtaaagctggctaatccttagtgttatgtctacgtcaccctgtcttttgttgcagtttgctcattgtactagcaacgagcggacattttgaccccg

SEQ ID NO: 47091 - protein, 113 aa, Panicum virgatum
  misc_feature: Ceres CLONE 2034112
  misc_feature (1)..(106): Pfam Name: Ded_cyto Pfam Description: Dedicator of cytokinesis
LEEPRSSEGDQLPRLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 47092 - DNA, 663 bp, Panicum virgatum
  misc_feature: Ceres CLONE 2034117
  misc_feature: Encodes the peptide sequence at SEQ ID NO. 47093
aaaaaagcatgccgtcttgagccgaaaaagccggagaagcaggtcaaatccggccgtcggatcaccgtcgaacggctaaacgaggaacaaggtagagggggcggggtgggccctccccccatctgttcttctcgcaagagaatggaatgagatacactcacacgcgcaaagcagttggaatcacaggtggatccaattccgagcaccgtcgccgtgcgcgtcatcgcccaattccccgcccccggcctagcacccagttctgaattcctccacatctccatcgccccggcaggaacatcccatgcaccgcaggcggctcccctataaaaccccgtctagtcccccgccctgatggcaccggcgcgcacacggcggagaattcatcgctcgagtcaattcgcccgcttctccgcgcccctgctagcctgcttgtgtgattctgaagggagatttagtcgagcaggatgaatgcattggcagcaaccagcaggaacttcaagcaggcagctaagctgctggccctcgactccaagctggagaagagcttgctcatcccgttccgagagatcaaggtgatgaaaccactacagttttttagatctggtaaacttttttccgttgtttcacttgctcgtggtggttccctgtattcctgatgaacac

SEQ ID NO: 47093 - protein, 63 aa, Panicum virgatum
  misc_feature: Ceres CLONE 2034117
  misc_feature: SWISSPROT Homolog: EC 1.4.1.3 Glutamate dehydrogenase (NAD(P)(+))
MNALAATSRNFKQAAKLLALDSKLEKSLLIPFREIKVMKPLQFFRSGKLFSVVSLARGGSLYS

SEQ ID NO: 47094 - DNA, 625 bp, Panicum virgatum
  misc_feature: Ceres CLONE 2034119
  misc_feature: Encodes the peptide sequence at SEQ ID NO. 47095
agattgagaaaaagaaacgagaagggggcgctagggttttggcgtccgaaatcgcagccatcgacgccgccgcatccaactccggcgagcgagcagattccaggtcggcggcggcccctaatcccctctatcggcagcgcagatggcgtccggcggcccggctctcgagtcgctcgtcgaccaggtcatctccgtcatcaccaacgatggccgcaacattgtgggcacgctcaggggattcgaccaggccaccaacattatcctcgacgagtcccacgagagggtctattctacaaaggagggagtccaacaacttgttcttggtttgtacattatcaggggtgacaacataagcgttgtgggtgaggtggatgaagacttggatgcaaggttggatctgtcgaagctaagagcgcacccactgaagccggtcatccactgatcgctgctgccagatcagatgcacttgtttgttgggtagcttgtggactggatgcgtcggtattctgattattgttgaatgcgggatgtagcatcgtcgtcgagggtaactgagtaatatgaacgctgtatcttgcttacaattgtgaatcaatgaatgtgtgttggctgtcgggttgcacgt

SEQ ID NO: 47095 - protein, 99 aa, Panicum virgatum; identical to SEQ ID NO: 34249
  misc_feature: Ceres CLONE 2034119
  misc_feature (6)..(75): Pfam Name: LSM Pfam Description: LSM domain

SEQ ID NO: 47096 - DNA, 628 bp, Panicum virgatum
  misc_feature: Ceres CLONE 2034137
  misc_feature: Encodes the peptide sequence at SEQ ID NO. 47097
aaacgcggctccccctcccttctcttcccgatcattccattccggctttccccaacccttcgaccacccgaggaagaaaagaagttgaagcatggggaagagaaagtcagctgctaagccacctcctaagaagcggatggacaagcttgacactgtcttttcctgcccattctgcaatcatgggagcagtgttgagtgccgtattgacatgaagaatttgattggcgaggcttcttgcagaatctgtcaggaaaacttcagcaccactgttaatgcactcactgagcctattgacatatatagtgaatggattgatgagtgtgagcgcgtcaacactgttgaaggtgatgatgatgcatgagctccccccatgctgatggaacggttacttgcaactgtattgtactggcatgcttgaatgccatagtcagccatggcttgtaatggcgctgtaagggcatattggctgcctgatacgccgttaggcggtatcagtttatctagcacttaataaactctaaaaaaatacatgtatgcctagtagtgactctgcgtttttctacgcaactagcgactgcctacaatgatgtaaacaggttttctgtgagtatgttctcatgttttaaac

SEQ ID NO: 47097 - protein, 89 aa, Panicum virgatum; identical to SEQ ID NO: 27831
  misc_feature: Ceres CLONE 2034137
  misc_feature (8)..(68): Pfam Name: Elf1 Pfam Description: Transcription elongation factor Elf1 like

SEQ ID NO: 47098 - DNA, 694 bp, Panicum virgatum
  misc_feature: Ceres CLONE 2034140
  misc_feature: Encodes the peptide sequence at SEQ ID NO. 47099
attcggttcctcttcctcctccctcccctgcccctcctcctcctcgtctcaccttcctcgcctgctcttcgcgtgcgccgcggaagccgtggtccgtggaggacggacagcccggggacgctcggggctcgtgcggggtgcactgatctgcagcctgcgtgcccccggtggcggggcgggccggcgtcggcttcgaggaatgtgcagattgtagcagctgtttcttctgcatatgcactttgtattgttgatatcatttcaaaggaggccatagtctcctggattttgtatgccttgttatctggaattggttaccgtagatgtcatttcgtagcatagtccgtgatgttagggatggcttcggcagcttgtccagacgcagctttgaggtgaccctcgcaagcatttatggccttaccgggcatcacaaagggaagacccatagctcatcgcatgaactcgatgactcgccttccataatccgagaaagccgctgggcaagcctacctcctgaactcatccgtgatataatacggagactcgaggctgacgagagcacctggccagcacggaagcatgttgtttgctttgcagctgtttgtaggacatggagggaaatgtgtaaagagattgtgtggagcccagagttttgtgggaagctcaccttccctgtgtctctaaaacaggtaaaggg

SEQ ID NO: 47099 - protein, 124 aa, Panicum virgatum
  misc_feature: Ceres CLONE 2034140
  misc_feature (57)..(112): Pfam Name: F-box Pfam Description: F-box domain
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVRDGFGSLSRRSFEVTLASIYGLTGHHKGKTHSSSHELDDSPSIIRESRWASLPPELIRDIIRRLEADESTWPARKHVVCFAAVCRTWREMCKEIVWSPEFCGKLTFPVSLKQVK

SEQ ID NO: 47100 - DNA, 579 bp, Panicum virgatum
  misc_feature: Ceres CLONE 2034141
  misc_feature: Encodes the peptide sequence at SEQ ID NO. 47101
acgcttgaacgaccacatcacaagcactccgcattcagcagagaagcagcgacatggcttcccagctctccgccgccgcggccatggccaccgtgccgcagttccacggcctccgcggctacgcctcgccgaggtccgtcgtggcggtgccgtcgatgcgggtgggcaggaagagggcgcagggcatccggtgcgactacatcggctcagccaccaaccagatcatggttgtgacgacgacgctgatgctggtggcggggcggttcgggctggcgccgtcggcgaaccggaaggcgacggcggggctgaagctggaggcgcgcgactccggcctgcagaccggcgaccccgccgggttcacgctcgctgacacgctggcctgcggcgccgtcggccacatcctcggcgtcggcatcgtgctcggcctcaagaacaccggcgcgctcgaccagatcatcggctagagccgttagatgaacctctgtttctctaatggaacgatcggtgccgagttacttttaacatgtacattgtgcgtgcgtgcatcatcttgttcgaatggactatagctttgtttcc

SEQ ID NO: 47101 - protein, 136 aa, Panicum virgatum
  misc_feature: Ceres CLONE 2034141
  misc_feature (51)..(131): Pfam Name: PSI_PSAK Pfam Description: Photosystem I psaG / psaK
MASQLSAAAAMATVPQFHGLRGYASPRSVVAVPSMRVGRKRAQGIRCDYIGSATNQIMVVTTTLMLVAGRFGLAPSANRKATAGLKLEARDSGLQTGDPAGFTLADTLACGAVGHILGVGIVLGLKNTGALDQIIG

SEQ ID NO: 47102 - DNA, 672 bp, Panicum virgatum
  misc_feature: Ceres CLONE 2034160
  misc_feature: Encodes the peptide sequence at SEQ ID NO. 47103
gggattcggctgccgtggacgaccagagaagaacctcggcagtcggcaaccaccaaactctcctggttctagtcgcacctcccccaccgacgcgtcgatcagatcagattggtgatccagcccagcttagctggactgcagctaatatggcggccttgccattagctaccgctgaagtatgtgatgccaatcctcatttaattatgaatggagagcttcgtgcgcttcagcccatcttccaaatctacggaaggcggcaggtttttgctggccctattgtgacgctgaaggtgtatgaagataatgttctaatccgcgagttccttgaagagaaaggtcatggcagggtccttgtagttgatggtggtggcagcatgcgttgcgccattttgggtggcaaccctgtccagcaagcacagaacaatggatgggctggcattgtggtcaatggctgcatcagggatgttgatgagatcaatggttgcgacattggtgtccgagctctgaactcgcaccctatgaaggcaaacaagaaaggcatgggtgagaagcatgtccctgttacctttgctggaaccagaatttgcgacggtgagtggctctatgcagacacagatggcattcttgtgtcaaggacggaattgactgtttagacctagtacctctccatat

SEQ ID NO: 47103 - protein, 168 aa, Panicum virgatum
  misc_feature: Ceres CLONE 2034160
  misc_feature (4)..(161): Pfam Name: Methyltransf_6 Pfam Description: Demethylmenaquinone methyltransferase
MAALPLATAEVCDANPHLIMNGELRALQPIFQIYGRRQVFAGPIVTLKVYEDNVLIREFLEEKGHGRVLVVDGGGSMRCAILGGNPVQQAQNNGWAGIVVNGCIRDVDEINGCDIGVRALNSHPMKANKKGMGEKHVPVTFAGTRICDGEWLYADTDGILVSRTELTV

SEQ ID NO: 47104 - DNA, 613 bp, Panicum virgatum
  misc_feature: Ceres CLONE 2034175
  misc_feature: Encodes the peptide sequence at SEQ ID NO. 47105
cctgggccgggtgatgctgaaacgcagcacgatactattcatggatgaggccactgcttcagtggattcccaaactgatgctgtgattcagaagatcatccgggaagactttgcagcttgtacaatcatcagcattgcccacagaataccaacagtcatggattgcgacagagtcctggttatcgatgcaggactagcaaaggagtttgaccgacctgcgaatctgatcgagaggccttctctctttggagcattggttcaagagtacgcaaaccggtcatccgatgtgtagccttggagatggcataatttttgactcaagattttggaggaaatagggaacggagatttcctggtgtggtgcgttgaactagcaagctgcattcatttgctccgaataaaactgcgagccctgaaaatttggtgagcggtaaaccgggttgtgaaaggtcggaggagccacgatgtgattcattcaaggcatcaatatgactgagacgaagcagatatcaagatgtgtttcagccggttaagctgaaattttctaatattgtgagttgaagatgatgtatgaatgtactgttcgactagaatattgtcactctcaggcaga

SEQ ID NO: 47105 - protein, 96 aa, Panicum virgatum
  misc_feature: Ceres CLONE 2034175
  misc_feature: SWISSPROT Homolog: EC 3.6.3.44 Xenobiotic-transporting ATPase
LGRVMLKRSTILFMDEATASVDSQTDAVIQKIIREDFAACTIISIAHRIPTVMDCDRVLVIDAGLAKEFDRPANLIERPSLFGALVQEYANRSSDV

SEQ ID NO: 47106 - DNA, 613 bp, Panicum virgatum
  misc_feature: Ceres CLONE 2034177
  misc_feature: Encodes the peptide sequence at SEQ ID NO. 47107
aaataatttagcagctctccacaagaggtttagaaatggcggtcaagtttgtagttcttcttggtgttgtcctggcctttctcctcgtctcccaggatttggcctgtgctagagagctcactgaaaccaatgagtcgtctaaaggaaaagatgtgaagcccgctggaggagcgcctggactcaaggatgaaaagtggggaggtggatacaatggaggatatggcaacggcggtggttacggtggaggttacggtggtggtggcgggtacggtggtggctatgggcctagatatggtggaggataccaccatggccacggaggaggctatgggcccggatatggtggcggacaccgtggtggatggaattaagagacagagctatgtatgtctctctacgtcaaataagaaacacgtcatgatgatatatggtataaaacatggtgatggacatactgtcgatggaatcttgtcttgcatgaagtgtgataataagagctaggcagctagccatgtctggcagtgtgcacagctggcttttagaagaactggtacctcatccagtatggacctatgtatacatataaataaatgactatcctgtaaagttgtgt

SEQ ID NO: 47107 - protein, 111 aa, Panicum virgatum
  misc_feature: Ceres CLONE 2034177
  misc_feature (1)..(110): Pfam Name: GRP Pfam Description: Glycine rich protein family
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
MAVKFVVLLGVVLAFLLVSQDLACARELTETNESSKGKDVKPAGGAPGLKDEKWGGGYNGGYGNGGGYGGGYGGGGGYGGGYGPRYGGGYHHGHGGGYGPGYGGGHRGGWN

SEQ ID NO: 47108 - DNA, 679 bp, Panicum virgatum
  misc_feature: Ceres CLONE 2034178
  misc_feature: Encodes the peptide sequence at SEQ ID NO. 47109
atccttccatcagtccgcgcagccaggagagaagggcgtagggaaacaaaagaaagggcaaaaatgctgcgccacgccgcccgccgtctcgcctcccgctccgccgtcgccggcggccgtgcgctctccactgcggaggtgcccgcgcaagccgcagaggactcctcgttcgtggaggcgtggaagaaggtggcccccaacatcgaggcccccaagacgcccatgtcgctgatgcagccgcgcccccccacgccggccaccatccccaccaagctcaccgtcaacttcgtcctcccctacaaatcagagatcgccaacaaggaggttgacatggtaattgtcccagctacaactggacagatgggtgttttgccagggcacgttgccacaatcgcagagctcaagcctggtgttctatctgtacaccagggaaacgatgttaccaagtactttgtgagcagtggctttgcattcgtccacgcaaactctgtcgctgatatcgtggctgttgaggctgtccctgtggatcagatcgacccaagcttggtccaaaagggcctcactgatttcacggctaagcttggatcagcctcgacagacttggagaaggctgaggctcagatcggagtcgatgttcacagtgcactcaatgctgcattggccggttaatgtgacgtct

SEQ ID NO: 47109 - protein, 201 aa, Panicum virgatum
  misc_feature: Ceres CLONE 2034178
  misc_feature (70)..(153): Pfam Name: ATP-synt_DE_N Pfam Description: ATP synthase, Delta/Epsilon chain, beta-sandwich domain
  misc_feature: SWISSPROT Homolog: EC 3.6.3.14 H(+)-transporting two-sector ATPase
MLRHAARRLASRSAVAGGRALSTAEVPAQAAEDSSFVEAWKKVAPNIEAPKTPMSLMQPRPPTPATIPTKLTVNFVLPYKSEIANKEVDMVIVPATTGQMGVLPGHVATIAELKPGVLSVHQGNDVTKYFVSSGFAFVHANSVADIVAVEAVPVDQIDPSLVQKGLTDFTAKLGSASTDLEKAEAQIGVDVHSALNAALAG

SEQ ID NO: 47110 - DNA, 759 bp, Panicum virgatum
  misc_feature: Ceres CLONE 2034189
  misc_feature: Encodes the peptide sequence at SEQ ID NO. 47111
aacactagcaggcatcgagttctcacaggcaggcaaagagaaacacccagcacccaagcagaactgcactccaaacaatggagagttttgcccaggagcatgtcatcggaattccattggcttcgtttgcatatgcccaagaggaagggcaaggaaaaccttcctgttctgccttgattcataagaagaataagaagagttccttcatttatcggatgagcaaattgagccagaaaacagatagctacatgcaagggttcaaagaacacttaaccctgggaccaaaattttcagaaactatcaaagggaaagtaagctttggagcaaaggttctacaagctggcagcattgataaagtcttcagggaatactttgtagtcgagaaagatgagaaattattgaaggctttccagtgttatctttcaacaacagctggtccaatagctggaatgcttttcatctcaactgagaagataacattccatagtgataggcctctgagtttagcgtgttccaaaggaggcaagacaagggtaccctacaaggtgttgatccccacaaaaaggataaagagtgcttcagtcagagaaaatatgtacaatcctgacgagaagtatattgatgtagttactgttgatggctttgatttttggtttatgggttttattagctacgagaagtccttcagatatcttcagaatgtaatttcggagttgagatgatacacgtagttctagtctgaaacatactgcataccat

SEQ ID NO: 47111 - protein, 214 aa, Panicum virgatum
  misc_feature: Ceres CLONE 2034189
  misc_feature (93)..(171): Pfam Name: GRAM Pfam Description: GRAM domain
MESFAQEHVIGIPLASFAYAQEEGQGKPSCSALIHKKNKKSSFIYRMSKLSQKTDSYMQGFKEHLTLGPKFSETIKGKVSFGAKVLQAGSIDKVFREYFVVEKDEKLLKAFQCYLSTTAGPIAGMLFISTEKITFHSDRPLSLACSKGGKTRVPYKVLIPTKRIKSASVRENMYNPDEKYIDVVTVDGFDFWFMGFISYEKSFRYLQNVISELR

SEQ ID NO: 47112 - DNA, 728 bp, Panicum virgatum
  misc_feature: Ceres CLONE 2034217
  misc_feature: Encodes the peptide sequence at SEQ ID NO. 47113
ttttggcttgcttttcctgtgtcagtaccgcctcttggtttcaacacttattttgtctcaagcatgaagaaatcagcatctgtttcttccaagtccacaatatactcatctcaaggaagtgaaaatagtaatctacaagttgggcaagggaacttgaaacttcagtataatgcagctggagcattctctctgtactcggatagcaggactctgattgaagcaaatttcgagcagaaatacaagtattacatagggcaggatggtaacggaagtgatcctcaggcttctggagcatacatatttcggcctaatggcactgttcctatcaagactgacagtcaggttcctctcacagttctgcgtggccccatagtggatgaagtgcaccagcagattaattcatggatatatcagattaccagagtttacaaggggaaggactatgtggaaaccgaatttattgttgggcctgttccaacagatgatggaaatggaaaagaagtagcaactgaaattttcacaaacatggcaacaaacaaaacattttacactgattccagtggacgcgatttcatcaaaaggataagagattatcgatcagagtggaagattgaagtgcaccagcccattgctggaaactattatcctgttaatcttggcatttatgtggaagatggcaacaaagagttgtctgtactggtagacagatcaattggaggttcaagtat

SEQ ID NO: 47113 - protein, 242 aa, Panicum virgatum
  misc_feature: Ceres CLONE 2034217
  misc_feature (1)..(242): Pfam Name: Glyco_hydro_38C Pfam Description: Glycosyl hydrolases family 38 C-terminal domain
  misc_feature: SWISSPROT Homolog: EC 3.2.1.24 Alpha-mannosidase
FWLAFPVSVPPLGFNTYFVSSMKKSASVSSKSTIYSSQGSENSNLQVGQGNLKLQYNAAGAFSLYSDSRTLIEANFEQKYKYYIGQDGNGSDPQASGAYIFRPNGTVPIKTDSQVPLTVLRGPIVDEVHQQINSWIYQITRVYKGKDYVETEFIVGPVPTDDGNGKEVATEIFTNMATNKTFYTDSSGRDFIKRIRDYRSEWKIEVHQPIAGNYYPVNLGIYVEDGNKELSVLVDRSIGGSS

SEQ ID NO: 47114 - DNA, 655 bp, Panicum virgatum
  misc_feature: Ceres CLONE 2034238
  misc_feature: Encodes the peptide sequence at SEQ ID NO. 47115
aagccaaagccgcaactgctgcaagctgaggtcgccaccacgcccccccacaccccccgagagccacgcgccatgcccccgaccccgacccccgccgccgccgccgcggcgccggaggaggcgtcgttccgcctcgtgggccaccgcagcttcgtccgcgtcaacccgcgctcggaccgcttccacgcgctcgcgttccaccacgtcgagctctggtgcgccgacgcggcgtcggccgcgggccgcttctccttcgggctcggcgcgccgctcgccgcgcggtctgacctctccacggggaactccgcgcacgcctcgctcctgctccgctcgggctccctcgcgttcctcttcaccgcgccctacgcgcgcggcgccgaccccgccaccgcgaccctgccctccttctccgcgcccgccgcgcggcgcttcgcggccgaccacggcctcgcggtgcgcgccgtggcgctccgcgtcgccgacgccgaggacgccttccgcgccagcgtcgccgccggggcgcgcccggcgttcgagcccgtcgagctcggcctcgggttccgcctcgccgaggtcgagctctacggcgacgtcgtgctccgctacgtcagctacccggacgccgcgggcgcgcccttcctgccgggcttcgagg

SEQ ID NO: 47115 - protein, 194 aa, Panicum virgatum
  misc_feature: Ceres CLONE 2034238
  misc_feature: SWISSPROT Homolog: EC 1.13.11.27 4-hydroxyphenylpyruvate dioxygenase
  misc_feature: Functional homolog of the protein sequence given in SEQ ID NO 51578
  misc_feature: Useful for making plants with altered tocopherol content
MPPTPTPAAAAAAPEEASFRLVGHRSFVRVNPRSDRFHALAFHHVELWCADAASAAGRFSFGLGAPLAARSDLSTGNSAHASLLLRSGSLAFLFTAPYARGADPATATLPSFSAPAARRFAADHGLAVRAVALRVADAEDAFRASVAAGARPAFEPVELGLGFRLAEVELYGDVVLRYVSYPDAAGAPFLPGFE

SEQ ID NO: 47116 - DNA, 655 bp, Panicum virgatum
  misc_feature: Ceres CLONE 2034245
  misc_feature: Encodes the peptide sequence at SEQ ID NO. 47117
atcataatcccacacagatcaagtgctcatcttgaaggccagggatggcttccgattccaagtctctgcttctgattggcgtcgtcctggcttccctcctcctcgtcaccaaggatgtggctgctgctagaaatcacttcatcgaggacaaggaatctgaggcaaagaacatgaagattaatggtgaggctgaactcaatgatgagaagggggctcgcggatattacggcggcgggtatggtggtggatatggtggagtgtacggcggtggctatggcggctatgttcctgggcatggttggtatggtggcgggtatggttaccctggctttggcggtggatatggtggtggtggcggtggcggtggctatggtagtggatatggcgctggcggcggtggatatggtggcggcggttatcctggagtaggatattatggtggcggaggtggtggcaagcattaggatctatatacaagcattgtgcttcaacaatattacctgttactgtggttcacttgctttagacatggtttcatgttatccctttggtattaagttcgtcttggtgcaatgctgttatatcatgttgtattatgccaatatatatttcaaataaatgacagcccaattactttggacaacattggtggttc

SEQ ID NO: 47117 - protein, 139 aa, Panicum virgatum
  misc_feature: Ceres CLONE 2034245
  misc_feature (1)..(134): Pfam Name: GRP Pfam Description: Glycine rich protein family
  misc_feature: Functional homolog of the protein sequence given in SEQ ID NO 50178
  misc_feature: Useful for making plants with modulated nitrogen use efficiency
MASDSKSLLLIGVVLASLLLVTKDVAAARNHFIEDKESEAKNMKINGEAELNDEKGARGYYGGGYGGGYGGVYGGGYGGYVPGHGWYGGGYGYPGFGGGYGGGGGGGGYGSGYGAGGGGYGGGGYPGVGYYGGGGGGKH

SEQ ID NO: 47118 - DNA, 550 bp, Panicum virgatum
  misc_feature: Ceres CLONE 2034265
  misc_feature: Encodes the peptide sequence at SEQ ID NO. 47119
aaagttccatgccacctccacctgcatatgaagaagtcaatggtatattcatgaggaacactgttgcagaattggtcgagactgtggagtacttcttggccgaggccatccaatcatatcgagctgagagcgacaccgagctcaaccttgcagctggtgactacatagtggtccgaaaggtgtcgaacaatggatgggctgaaggtgaatgcaggggtaaagctggctggttcccttacgactacatcgagaaacgggaacgtgtgcttgcaaataaagttgcccaagttttctgagacgctcaccgagccatacatacccccgtgtttgtacactgtgtattatgtccgttatcgtcagagaaaatctgtaattttgctgaaacctgcctgttggatggcttcctgcctggccgtcagcattgtttaaatccatatggcaggaactgtacactaatgtttatttcattcttcaactatcccgtcaatatataaccatacctttttttttgttttgaacatgcaataaaatcagaaatcaagcaccaact

SEQ ID NO: 47119 - protein, 97 aa, Panicum virgatum
  misc_feature: Ceres CLONE 2034265
  misc_feature (32)..(85): Pfam Name: SH3_2 Pfam Description: Variant SH3 domain
SSMPPPPAYEEVNGIFMRNTVAELVETVEYFLAEAIQSYRAESDTELNLAAGDYIVVRKVSNNGWAEGECRGKAGWFPYDYIEKRERVLANKVAQVF

SEQ ID NO: 47120 - DNA, 660 bp, Panicum virgatum
  misc_feature: Ceres CLONE 2034281
  misc_feature: Encodes the peptide sequence at SEQ ID NO. 47121
agaataaagagagcaggttccaactaaaactacttcgaagcttagcagagccaagccgatccacatcatcagttcatcacgttaaaaagcaagtgatcgcgagtagccactcatcaatggggccggcggcggcccgccccgacagtggcgcgccggagacggagcagcggagggtcttccacttcggcaagggcaggagcgacggcaacaaggccatgaaagacttggtatgttcgcgcgtgcgctagtgcttagtattgtgcgagacctccgatccatcagcacatgcatttgacgacgcatgccggcagctgggcgggaagggcgcgaacctggcggagatggcgagcatcgggctgtcggtgccgccggggttcaccgtgtccacggaggcgtgccggcagcaccggcagctcggcggcggggccatgccgccggggctctgggacgaggtcctcgacgcgctgcgccgcgtggagcgcgacatgggcgccggcctcggcgacccgcgccacccgctgctcctctccgtgcgctccggggccgccatctccatgcccggcatgatggacaccgtgctcaacctcgggctcaacgacgacgtcgtcgctggcctcgccaactgcggcggccggcgattcgccttcgactcctaccgcc

SEQ ID NO: 47121 - protein, 106 aa, Panicum virgatum
  misc_feature: Ceres CLONE 2034281
  misc_feature: SWISSPROT Homolog: EC 2.7.9.1 Pyruvate, phosphate dikinase
MASIGLSVPPGFTVSTEACRQHRQLGGGAMPPGLWDEVLDALRRVERDMGAGLGDPRHPLLLSVRSGAAISMPGMMDTVLNLGLNDDVVAGLANCGGRRFAFDSYR

SEQ ID NO: 47122 - DNA, 646 bp, Panicum virgatum
  misc_feature: Ceres CLONE 2034285
  misc_feature: Encodes the peptide sequence at SEQ ID NO. 47123
ctctcggactctctcctcccttgctctcccttccctggtggcggcggcgaccgagcggcggcgaccgagcggcggcgtcatttgtcctgtcttcgcccaacccttttttggcgacgagcgcatccttcagttttaacaatgaagatgatcgctgcctacctgctcgcggttctgggtggaaacacttccccaactgctgatgacgttaagaacattctggaatcagttggggctgaagctgatgaagagaaactggacttcctgctcacagaactcaaagacaaggacataacagaagtgattgcagctggaagggaaaagttcgcctccgtgccttcaggtggtggtgcaattgctgtgggagctccggctgctgcagctggtggtgctgcacctgctgaagaggcaaagaaggaagagaaggttgaagagaaggaggaatcagatgatgatatgggtttcagcttgttcgattaagcactgctgccccgcatatagtttcttctcacgtgtggtctgatacaccggtcggtatccgcaaaataaccatgccgagaactagtatcagtgtgctattttgcttgtgatgatggacatttctagtactctttcttgaacgtgaacatttctagtactgtggtatcat

SEQ ID NO: 47123 - protein, 112 aa, Panicum virgatum; identical to SEQ ID NO: 26025
  misc_feature: Ceres CLONE 2034285
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 47124 - DNA, 702 bp, Panicum virgatum
  misc_feature: Ceres CLONE 2034286
  misc_feature: Encodes the peptide sequence at SEQ ID NO. 47125
atccagctcatacttccagttcaaacatcgtttccactttccaggcaaggtggagcagcaagccgatcagaaaggctgccgttttgtgttcgccggcacggcagaggtgacagttaagtgcaccatgcaccattcagagcagccggcgagactcgccatgcccatgcttgtactattgccattgctgctgctgtgctatggagttggaaacgtccactgctcaaaggttcatgatagcagcatcgatctgcaggcactgctcgacttcaagcagggcatcaacgatccgaatggagccttgaacaattggaccatgagatcccacttctgtcactggaatggtgtccagtgcactttggagcaaccacggcgcgtcgtggggctcaaactgccaaaccaaagtttgtcaggcacaatcagctcctctcttggcaaccttactttccttaatcaccttgacctctcctacaacaactttgttggtcccttacctcttctcggcaaacttaccttccttaattatcttgacctctcctataatctctttgatggtcccttgcctcctcttggccacctccaacaactgcagtgcctttatttgaacaacaacaatttgtctgggatcattcctgatgaacttggaaactgctccaattttgacatcttagatttatcttcaaacttactagtgggttcaattct

SEQ ID NO: 47125 - protein, 192 aa, Panicum virgatum
  misc_feature: Ceres CLONE 2034286
  misc_feature (38)..(77): Pfam Name: LRRNT_2 Pfam Description: Leucine rich repeat N-terminal domain
  misc_feature: SWISSPROT Homolog: EC 2.7.11.1 Non-specific serine/threonine protein kinase
MHHSEQPARLAMPMLVLLPLLLLCYGVGNVHCSKVHDSSIDLQALLDFKQGINDPNGALNNWTMRSHFCHWNGVQCTLEQPRRVVGLKLPNQSLSGTISSSLGNLTFLNHLDLSYNNFVGPLPLLGKLTFLNYLDLSYNLFDGPLPPLGHLQQLQCLYLNNNNLSGIIPDELGNCSNFDILDLSSNLLVGSI

SEQ ID NO: 47126 - DNA, 583 bp, Panicum virgatum
  misc_feature: Ceres CLONE 2034287
  misc_feature: Encodes the peptide sequence at SEQ ID NO. 47127
caaaagaacccgcggcagggaagaggagaggagggtcctgaaaggaagaaaccgaacgcccaaacccgagcccaagaacagaacaccaccgttcgcctcgccggggagtccatccgcaacgatctgcagccatggcgatggcttacaagatggcgacggaggggatgaacgtgaaggaggagtgccagcgctggttcatggagatgaagtggaagaaggtgcaccgcttcttggtgtacaagatcgacgagcgggcgcgcgccgtgctggtggacaaggtgggcggccccggcgaggggtacgaggagctcgtcgccgcgctgcccggcgacgactgccgctacgccgtcttcgacttcgactacgttaccgtcgacaactgcaagaagagcaagatcttcttcatcgcctgggaaaatcctcgctactgtctgtctcgattttgtatcgctccatccctcctccagttctcttcacctcgcagaagctatcggttccttctctgccatggcgatcttgacagcagtaacttaaggacttttcttaggaaaagcaatacttctaaacctggtaaaattgcgct

SEQ ID NO: 47127 - protein, 150 aa, Panicum virgatum
  misc_feature: Ceres CLONE 2034287
  misc_feature (16)..(139): Pfam Name: Cofilin_ADF Pfam Description: Cofilin/tropomyosin-type actin-binding protein
MAMAYKMATEGMNVKEECQRWFMEMKWKKVHRFLVYKIDERARAVLVDKVGGPGEGYEELVAALPGDDCRYAVFDFDYVTVDNCKKSKIFFIAWENPRYCLSRFCIAPSLLQFSSPRRSYRFLLCHGDLDSSNLRTFLRKSNTSKPGKIA

SEQ ID NO: 47128 - DNA, 649 bp, Panicum virgatum
  misc_feature: Ceres CLONE 2034298
  misc_feature: Encodes the peptide sequence at SEQ ID NO. 47129
aatcgcataatatggagtcctgatggaaccttgtttggtattgcttattcaaggcatattgtacagatttattcctatcacggtggcgatgatattaggcaacacttggagattgatgcacatgttggtggtgtaaatgacattgcatttgctcatccaaataagcagctatgtataattacatgtggagatgataagacaattaaggtatgggaggccactagtggagcaaagcaatttacctttgaaggacatgaagctcctgtttattcagtttgtccgcattacaaggaaaatatccagttcatcttctcaactgctttagatggaaagatcaaggcttggctatatgataatttgggatctagagttgactatgatgcaccaggtcactggtgcactacaatggcatatagcgcagatggttcaagattattttcatgtgggacaagcaaggatggtgaatcacatctagtcgaatggaatgaaagtgaaggagcggtgaagagaacataccagggattccgcaagcgatccatgggtgtcgtgcaattcgataccacccgcaacaggtttttggctgctggagatgaattcttgattaagatatgggacatggacaacacaggtcttctgactactattgatg

SEQ ID NO: 47129 - protein, 216 aa, Panicum virgatum
  misc_feature: Ceres CLONE 2034298
  misc_feature (32)..(72): Pfam Name: WD40 Pfam Description: WD domain, G-beta repeat
  misc_feature (76)..(116): Pfam Name: WD40 Pfam Description: WD domain, G-beta repeat
  misc_feature: SWISSPROT Homolog: EC 2.7.11.7 [Myosin heavy-chain] kinase
NRIIWSPDGTLFGIAYSRHIVQIYSYHGGDDIRQHLEIDAHVGGVNDIAFAHPNKQLCIITCGDDKTIKVWEATSGAKQFTFEGHEAPVYSVCPHYKENIQFIFSTALDGKIKAWLYDNLGSRVDYDAPGHWCTTMAYSADGSRLFSCGTSKDGESHLVEWNESEGAVKRTYQGFRKRSMGVVQFDTTRNRFLAAGDEFLIKIWDMDNTGLLTTID

SEQ ID NO: 47130 - DNA, 436 bp, Panicum virgatum
  misc_feature: Ceres CLONE 2034309
  misc_feature: Encodes the peptide sequence at SEQ ID NO. 47131
ctttctgtcaaatctttcgctttgaaacagcgattgagaaaccacagcgatgggtctgcgatacgaactgtgcgttggcctgaacaagggtcacaagaccagcaagatcaggaatgtgcggtacacaggcgacaagaaggccaagaacctgcgtcctgacaggctgaagggtgtgcaaacgaaacacaccaagttcatgcgggacgttatccgggaggtggtcggccacgcgccgtacgagaagcggtgcatggagttgccgaaggtgtccaaggacaagcgcgcgctcaagttcctgaagcgccgcctgggcacacacatccgtggcaagaggaagcgtgaggagctggccaacatcctcacccagatgcgtaaggctcaggcccacgccaagtaaaccacccggcaaatgatgagttacttcaataaacattcg

SEQ ID NO: 47131 - protein, 115 aa, Panicum virgatum
  misc_feature: Ceres CLONE 2034309
  misc_feature (2)..(110): Pfam Name: Ribosomal_L36e Pfam Description: Ribosomal protein L36e
MGLRYELCVGLNKGHKTSKIRNVRYTGDKKAKNLRPDRLKGVQTKHTKFMRDVIREVVGHAPYEKRCMELPKVSKDKRALKFLKRRLGTHIRGKRKREELANILTQMRKAQAHAK

SEQ ID NO: 47132 - DNA, 734 bp, Panicum virgatum
  misc_feature: Ceres CLONE 2034321
  misc_feature: Encodes the peptide sequence at SEQ ID NO. 47133
aaaaacatcgagcattggaagagctaaaactccagtccagctatccaacaagtgtctacacataagacatcagcactagttgggttcccaagaaacaaagtccagtccaaagatgtctgggtcgaggagctcttcttcccgcagcgttaacgtggactccacgtggagcaagaaagagaacaagctgtttgaagaggccctcgcccactacggcgaggacacacccgaccgctggcacaaggtgtcccgcgccattggaggcagcaagacggccgacgaggtgcgccgccattatgagttactcgatgatgacatcaagctcattttgtccggcaatgttccgttccccaagtacaacacacagggagcttggaactaagagtgaagcatgtgaagaaccaccgacgacagacactgctgctacataaacagatacagatatcttagctattcaaggaaacatgctgatatattgttgttttcttatgaagttaatgatcgcttggtcaaaaataaaaggagccagtaaccatacgtatgtgtgttaatgtgtgtgtatataacgataggttgtacgcaaatcagctgttatgctacagaatttagggtacactatctgcccatagtgtgtagttatggtcccctagcagggactacttgtgcagtaaacagtattgtaaataaataaaactcatgtaccggtttgctaattatatataaattgtgcttggttg

SEQ ID NO: 47133 - protein, 88 aa, Panicum virgatum
  misc_feature: Ceres CLONE 2034321
  misc_feature (15)..(65): Pfam Name: Myb_DNA-binding Pfam Description: Myb-like DNA-binding domain
  misc_feature: Functional homolog of the protein sequence given in SEQ ID NO 51731
  misc_feature: Useful for making plants with modulated nitrogen use efficiency
  misc_feature: Functional homolog of the protein sequence given in SEQ ID NO 51404
  misc_feature: Useful for making plants with altered lignin content
  misc_feature: Useful for making plants with modulated low light sensitivity
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Functional homolog of the protein sequence given in SEQ ID NO 51406
  misc_feature: Useful for making plants with modulated flowering time
  misc_feature: The sequence is a functional homolog of SEQ ID NO 976 in the 11/435,388 US patent application
  misc_feature: The sequence is a functional homolog of SEQ ID NO 510 in the 10/666,642 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: Functional homolog of the protein sequence given in SEQ ID NO 51732
  misc_feature: Useful for making plants with altered alkaloid content
MSGSRSSSSRSVNVDSTWSKKENKLFEEALAHYGEDTPDRWHKVSRAIGGSKTADEVRRHYELLDDDIKLILSGNVPFPKYNTQGAWN

SEQ ID NO: 47134 - DNA, 606 bp, Panicum virgatum
  misc_feature: Ceres CLONE 2034351
  misc_feature: Encodes the peptide sequence at SEQ ID NO. 47135
agcagcagccagactcgcacgccgctcctcctccctgctcccgccgccgccgccggctgtgttcgccttcctcctcgcagcgatcgaggccattattcgaaaatgggtgactcaagtgtgagcaatggccttggccctgtcacacgggtgctgttctgtggcccatattggcctgctgctactaattacaccagagagtatctgcaggactatcccttcattcaggtcgatgaagtaggtcttgagcaagtacctgatgttattcaaaactataatttatgtgtagtaaaaaatcggcgtatagattcagatatcattgccaaggcaactcagatgaagattataatgcagtatggtgttgggttagaaggtgttgatgtaaatgctgctacagaacacaaaatcaaagttgcacggatacctggaagtacgacaggaaatgccgtctcttgcgcagaaatggcaatctatcttactctgggcgttctgcgcaaacaagtatgtgttgtattgctagtagttttgaccatgtgcatgctggaagtactcttcttttgtttcagttttttgaagcttctcttcgatgaacattgacagtattaagct

SEQ ID NO: 47135 - protein, 163 aa, Panicum virgatum
  misc_feature: Ceres CLONE 2034351
  misc_feature (16)..(150): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MGDSSVSNGLGPVTRVLFCGPYWPAATNYTREYLQDYPFIQVDEVGLEQVPDVIQNYNLCVVKNRRIDSDIIAKATQMKIIMQYGVGLEGVDVNAATEHKIKVARIPGSTTGNAVSCAEMAIYLTLGVLRKQVCVVLLVVLTMCMLEVLFFCFSFLKLLFDEH

SEQ ID NO: 47136 - DNA, 687 bp, Panicum virgatum
  misc_feature: Ceres CLONE 2034356
  misc_feature: Encodes the peptide sequence at SEQ ID NO. 47137
ctagtcgctccgcacctcgttccctcctccctccctccctccgcctcccccacccttctcgctccgccccccacgcgtcgccggccgccgcgggagaatcccgaggccgggatcggacccccgcccgctcgccggactcgccgcctcggccctcgcctccctcgctctccgcctccgcgcccaggtctaattcgcccggcggcgtaggaatcccgtcctagattcgatcgaggggcggcaatgccgggctccgcatagccggaaatcgggcgctgacaggcaccgcggcgccgagatgggccgttccggcgggcggcggcgggaccgtatgcgatggagcaagctctacacctttaactgcttcaagggccaccacggggaagccggcgccgaggggccctcctccgacggcgccggcgccctcggcgggccggggttctcgcgcgtcgtgcactgcaacaaccccaccctgcagaagccgctcaagtaccccaccaactacatcaccaccaccaagtacaacatcatcaccttcttccccaaggccatcttcgagcagttccggcgcgtggccaacctctacttcctcctcaccgccatcctctctctcaccccagtgtgccccttctcagccgtcagcatgatcgcgcccctagcctttgttgtcgggctcagcatgctcaagga

SEQ ID NO: 47137 - protein, 130 aa, Panicum virgatum
  misc_feature: Ceres CLONE 2034356
  misc_feature: SWISSPROT Homolog: EC 3.6.3.1 Phospholipid-translocating ATPase
MGRSGGRRRDRMRWSKLYTFNCFKGHHGEAGAEGPSSDGAGALGGPGFSRVVHCNNPTLQKPLKYPTNYITTTKYNIITFFPKAIFEQFRRVANLYFLLTAILSLTPVCPFSAVSMIAPLAFVVGLSMLK

SEQ ID NO: 47138 - DNA, 743 bp, Panicum virgatum
  misc_feature: Ceres CLONE 2034362
  misc_feature: Encodes the peptide sequence at SEQ ID NO. 47139
atttgtcaagctcatgccatccaaatgcttcgtgcattaaacatttaatatcgccatgttccctcagtgatggcttcagaacatcatgtgctgtcacaaattatgatgacccatacaggtttttgcaatcttcaattgcttgtggtgcctataatgatagggcaagcacggaaccatgccctttggaaaactgtagaagtcacccctcaatagacaacttacagtcagggaatacagatgccaaagacaagctttctgctggttacttatctggtaccgacaacaatcagagcatcttagtttcactctcacgtacctgcatcccaaaaagcttagcatgtgaacgttctcacctcctccgcatcaaattttatggtagttttgacaagccactagggaggtacctccgcgaggacttatttgatcaggcatattgctgctcatcatgcaaggagccttcagaatcacatgttaggtgctatatgcatcagcatggcagcctaacaatcagtgttagatgccttctgtgtcaaaagttaccaggtgaacatgatggaaggatatggatgtggcacagatgtatgaggtgtaagcctaaggatggaatgccgccggcaacacatagagtaattatgtctgatgctgcttggggcctatcatttggcaagttcctggagctgagcttctcaaatcatatgactgctaatcgaattgcgagttgtgcccattctctccaaagggat

SEQ ID NO: 47139 - protein, 246 aa, Panicum virgatum
  misc_feature: Ceres CLONE 2034362
  misc_feature: SWISSPROT Homolog: EC 2.7.1.68 1-phosphatidylinositol-4-phosphate 5-kinase
LSSSCHPNASCIKHLISPCSLSDGFRTSCAVTNYDDPYRFLQSSIACGAYNDRASTEPCPLENCRSHPSIDNLQSGNTDAKDKLSAGYLSGTDNNQSILVSLSRTCIPKSLACERSHLLRIKFYGSFDKPLGRYLREDLFDQAYCCSSCKEPSESHVRCYMHQHGSLTISVRCLLCQKLPGEHDGRIWMWHRCMRCKPKDGMPPATHRVIMSDAAWGLSFGKFLELSFSNHMTANRIASCAHSLQR

SEQ ID NO: 47140 - DNA, 754 bp, Panicum virgatum
  misc_feature: Ceres CLONE 2034366
  misc_feature: Encodes the peptide sequence at SEQ ID NO. 47141
gcgatcccctttccacttcaccgcggccgctcgctcgctggggaagagctgcagcggcgtcagcggcggcggctgctttgttggcgccgcgtgcctccgacccaccccgcgccgtcgtgggatctgaggaggtccacggaccgagaagagggaggggggcctcccgaccctacggggggcgggcctcgcgcggcagccccgcgctctctgcgacggcagagcggcaccagccctacggaggatgtgctgcgtgcctatctgagaggtgacgacaggtctgaagttactggtcctctgtcgaaaccaaaaagcaagtgttctcaccaaacactgtgatctcacgggagtgtaaaaagaggagagcagtctcaccaaacacaggtctgataagcggtgaaccaccacgtcctagtacagattcagaggttggagaaataaactcccaagaatctgattctgaggtgacatcaaattctatatttgagcaccaatcattccctaagagcatggctgaaagcatgaatgttagcaagacaaggctgtgtgggaaaattctgaagaagctcatggatcacaaaggtggttggcttttccacaaaccagttgaccctgttctttatgggattcctgattactttgatgttatccgtaatccaatggacttgggtactgttcatatgaaactttcaaacaagcaatatgttacagctagtgagtttgcagcagatgtgcgacttacattcacaaatgcaat

SEQ ID NO: 47141 - protein, 82 aa, Panicum virgatum
  misc_feature: Ceres CLONE 2034366
  misc_feature (9)..(82): Pfam Name: Bromodomain Pfam Description: Bromodomain
  misc_feature: SWISSPROT Homolog: EC 2.3.1.48 Histone acetyltransferase
MAESMNVSKTRLCGKILKKLMDHKGGWLFHKPVDPVLYGIPDYFDVIRNPMDLGTVHMKLSNKQYVTASEFAADVRLTFTNA

SEQ ID NO: 47142 - DNA, 744 bp, Panicum virgatum
  misc_feature: Ceres CLONE 2034380
  misc_feature: Encodes the peptide sequence at SEQ ID NO. 47143
gcaaacaaaccccaccagccccgccccgccccggccactccacagtccacacaacacacggcacgctgttgcagcgcccccggccggcggaggagtactcaagcggagtcagaggctcgatcgatcgacatgccggcggcgggcggcgtgttctccgggtcggtgaacctcaagtacgtgaagctggggtaccagtacctggtgaaccacttcctgacgctgctgctggtgccggtgatggcggccaccgcgctggagctggcgcgcctgggccccggcgagctgctctcgctgtgtcggtcgctggagctcgacctcgtccacatcctctgctccgccttcctcgtcgtcttcgtcggcaccgtctacgtcatgtcgcgcccccggcccgtgtacctggtggactacgcctgctacaagccccccgccagctgccgggtgcccttcgccaccttcatggagcacacgcgcctcatcagcgacgacgacaagagcgtgcgcttccagaccaggatcctcgagcgctcggggctcggcgaggacacgtgcctcccgcccgccaaccactacatcccgccaaaccccagcatggaggccgcgcgcgccgaggcgcagctcgtcatcttctccgccatcgacgacctcgtccgccgcacggggctcaagcccaaggacatcgacatcctcgtcgtttactgcagcctcttctccccgacgccctcgctctccgccatgatcatcaac

SEQ ID NO: 47143 - protein, 204 aa, Panicum virgatum
  misc_feature: Ceres CLONE 2034380
  misc_feature (80)..(204): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MPAAGGVFSGSVNLKYVKLGYQYLVNHFLTLLLVPVMAATALELARLGPGELLSLCRSLELDLVHILCSAFLVVFVGTVYVMSRPRPVYLVDYACYKPPASCRVPFATFMEHTRLISDDDKSVRFQTRILERSGLGEDTCLPPANHYIPPNPSMEAARAEAQLVIFSAIDDLVRRTGLKPKDIDILVVYCSLFSPTPSLSAMII

SEQ ID NO: 47144 - DNA, 594 bp, Panicum virgatum
  misc_feature: Ceres CLONE 2034385
  misc_feature: Encodes the peptide sequence at SEQ ID NO. 47145
aaaggagaccgtggcgagcctccagaagacgcaccctgatgccgcgttcacctacgtcgacgtgtacaccgccaagtacaagctgatcagcgaggccaagaagctcggctttaacgaccctctgctggcctgctgcggccatggcggccggtacaacttcgacctgagcatcggctgcggcgggaaggagcaggtgaacgggacgtgggtgatggttgggaattcctgcgaggagccctccaagagggtgagctgggacggcgtgcacttcaccgaggccgccaacaagttcgtgttcgaccagatcgtcggaggcgcgctgtcggacccgcctgtgccgctgaagcgagcatgccagagcaaagggcgatgaacccgacgtgtgtcactactagggctggctacgctgcagcagcagctgctgctgcttcttgctgtgtgagtgtacaattggaggagcacgcgtgctcgaggatggggtatattgactcacttggaataagggaaatggaaatcgcatcgatgagcgtcgttgccccacccacaataggatgttcaggaaacattagcatacatggattttgctgttgacat

SEQ ID NO: 47145 - protein, 123 aa, Panicum virgatum
  misc_feature: Ceres CLONE 2034385
  misc_feature: SWISSPROT Homolog: EC 3.2.1.51 Alpha-L-fucosidase
KETVASLQKTHPDAAFTYVDVYTAKYKLISEAKKLGFNDPLLACCGHGGRYNFDLSIGCGGKEQVNGTWVMVGNSCEEPSKRVSWDGVHFTEAANKFVFDQIVGGALSDPPVPLKRACQSKGR

SEQ ID NO: 47146 - DNA, 513 bp, Panicum virgatum
  misc_feature: Ceres CLONE 2034394
  misc_feature: Encodes the peptide sequence at SEQ ID NO. 47147
gttttccggtgtgccttgaaatcatgtcactagcagaagccatgttcttgactgatctggagctgaatacagtatctcttttcacttctttgatgtctttctctaaggagccatctctgctgccagctcgtatttcatctctattgttgaatgattcttctgggattgcggtcggaatggcaacaaacattcctcataatctgggggagcttgttgatgcactttctgttataattcaaaaccctgaagccacagaaggaaatctccatcccggagatgttcaagagcacgtgtatgacaatgtcttaaattcttatattcacctatatctagatgatgatgaaggaacattccactacatgggcctgcaattctttgtaagcacatagagtcgtttgatatacattcttttcttggacatatcatattgttctcacttgatatggaatcttgaactgtatctatattggacccaatgcccatacctcacaattttaagttgtgattttactc

SEQ ID NO: 47147 - protein, 128 aa, Panicum virgatum
  misc_feature: Ceres CLONE 2034394
  misc_feature: SWISSPROT Homolog: EC 5.99.1.3 DNA topoisomerase (ATP-hydrolyzing)
FPVCLEIMSLAEAMFLTDLELNTVSLFTSLMSFSKEPSLLPARISSLLLNDSSGIAVGMATNIPHNLGELVDALSVIIQNPEATEGNLHPGDVQEHVYDNVLNSYIHLYLDDDEGTFHYMGLQFFVST

SEQ ID NO: 47148 - DNA, 708 bp, Panicum virgatum
  misc_feature: Ceres CLONE 2034404
  misc_feature: Encodes the peptide sequence at SEQ ID NO. 47149
cacacaacagatcaagatcattaccaaggcaagcttggtagctgctgtccattcttgctccttgaaaatacaccaggaaaaagataaacacattcattgattagccttcttgtgccttccgagtaaccgtcgtacatttccaaagttaaggcaagatgagttccgtgaagaccctgcgcaagaacaactggaaagacgctctccagaaggctaaacgggaggataggctgctggtgatggaattcatggcttcgtggtccgagccctccaagctgatgaaccctattgtcgccaacaccatagcccccgaccccaagttcagagacaaggtcgacttctgcatgctcgacgtcgaagagttcaaggatttggctcgctcgctccgtgtggaggcgctgccgactttcctgctggtgaaggactactacgtgaagaaacgcgtcgtgggggtcgacaaggatgaactccggagcagcatcttagagcagttgggtgaggcatcgtccaataatgcctgatgggcctcaagaatctctgatggtgtctgggcacacgcatgcatatcgatgtgatgagcccttggtgtatgtgtaattccttcagggccgctagatcacgcacatcttgaggccctgaacataaataaataaataaggtttggtatatgtgtttcattgcacaaaagaataacagattcaccaccagggt

SEQ ID NO: 47149 - protein, 120 aa, Panicum virgatum
  misc_feature: Ceres CLONE 2034404
  misc_feature (3)..(111): Pfam Name: Thioredoxin Pfam Description: Thioredoxin
  misc_feature: SWISSPROT Homolog: EC 1.8.1.9 Thioredoxin-disulfide reductase
MSSVKTLRKNNWKDALQKAKREDRLLVMEFMASWSEPSKLMNPIVANTIAPDPKFRDKVDFCMLDVEEFKDLARSLRVEALPTFLLVKDYYVKKRVVGVDKDELRSSILEQLGEASSNNA

SEQ ID NO: 47150 - DNA, 674 bp, Panicum virgatum
  misc_feature: Ceres CLONE 2034405
  misc_feature: Encodes the peptide sequence at SEQ ID NO. 47151
actccaactccctcccaagtcccaaccaccttcccggttccccttccgcaccgattccccctcgcctcctcccaacccgctcactcccgtccccatccgccgcgatggcctcgagcctcgccgtcgccgtcgccgcgcccgcctcgtcgccttccccggtcggctccgcctccgccgccgccgccccgctccgcttcgccctccgccgcggcctcccgccgacctgccgcgcgctccgcgcccgcccgcgctcccgcggcgcggccgtcgtgtgccaggcccagggcggccaggacaccgccatccaagttcctgatgtgagcaaatccacatggcaatcgcttgtggtggagagcgagctccccgtcctcgtcgagttctgggcctcgtggtgcggaccgtgcaaaatgatagaccccatcgtcggcaagctctcaaaggagtacgaagggaagctgaaatgctacaagctgaacaccgacgagaaccctgacatcgcgacccagtttggcatccggagcatccccacaatgatgatattcaagagcggcgagaagaaggatgcggtaattggggccgtgcccgagagcaccctgatcacctgcatcgagaagtatgttgacgggaggtgaaatctcaatctgagccgcttagccttggactacaatatgtag

SEQ ID NO: 47151 - protein, 175 aa, Panicum virgatum
  misc_feature: Ceres CLONE 2034405
  misc_feature (68)..(171): Pfam Name: Thioredoxin Pfam Description: Thioredoxin
  misc_feature: SWISSPROT Homolog: EC 1.8.1.8 Protein-disulfide reductase
  misc_feature: Functional homolog of the protein sequence given in SEQ ID NO 50158
  misc_feature: Useful for making plants with modulated heat sensitivity
MASSLAVAVAAPASSPSPVGSASAAAAPLRFALRRGLPPTCRALRARPRSRGAAVVCQAQGGQDTAIQVPDVSKSTWQSLVVESELPVLVEFWASWCGPCKMIDPIVGKLSKEYEGKLKCYKLNTDENPDIATQFGIRSIPTMMIFKSGEKKDAVIGAVPESTLITCIEKYVDGR

SEQ ID NO: 47152 - DNA, 644 bp, Panicum virgatum
  misc_feature: Ceres CLONE 2034427
  misc_feature: Encodes the peptide sequence at SEQ ID NO. 47153
ttcagttgagtgtgctccatcaccattcaccaagcaaagcaacctcgctcgctctcccaatcatccttatcagatcatcttcttccaagatgtcttgcagctgcggatcaagctgcaactgcggctccagctgcaagtgcggcaagatgtaccctgaccttgaggagaagagcagcggcggtgctcaggccaccgtcgtcctcggcctggccccggagaagaaggccggccacttcgaggcggcggcggagtccggtgagaccgcccacgcctgcaagtgcggcaacagctgcacctgcgacccctgcaactgctgatttggatggggaacgtacacacctgcgtgcatgctagctaccgcctactctgcttgtgtgtgacttgattgaacaagaataaggatgagcctgagccaacgtgcctgatgtatcggtttggctccggcctcatccagcatgcatgcgtcgtctgcccttatgtgtgctttgctacctccttattaccttgtgcttggcgtccgtcatgtatctgtatgtgttgatcattgcaaataaaccatgcaggcatgatgcatctctgcatgtgtctctgtaatgatcggtccagagtgatgaatatataaaactggtttgctttatctgccg

SEQ ID NO: 47153 - protein, 75 aa, Panicum virgatum
  misc_feature: Ceres CLONE 2034427
  misc_feature (1)..(75): Pfam Name: Metallothio_2 Pfam Description: Metallothionein
MSCSCGSSCNCGSSCKCGKMYPDLEEKSSGGAQATVVLGLAPEKKAGHFEAAAESGETAHACKCGNSCTCDPCNC

SEQ ID NO: 47154 - DNA, 728 bp, Panicum virgatum
  misc_feature: Ceres CLONE 2034441
  misc_feature: Encodes the peptide sequence at SEQ ID NO. 47155
atcgagcagagcacacagacagagcaaacgcatacgaccttcagcaatccactcgcactcgaccgcgctcagtcatctaaccgacgacgatgtcgctggtgaggcgcagcaacgtgttcgaccccttcgccgacttctgggaccccttcgacggcatcttccgctccctggtcccgtccgtcgcgccgtcgggccgcgacaccgccgccttcgccaacgcgcgcatcgactggaaggagacccccgaggcgcacgtcttcaaggccgacctccccggtgtcaagaaggaggaggtcaaggtcgaggtgtaggacggcaacgtcctggtcatcagcggcgagcgcagtaaggagaaggaggacaagaacgacaagtggcaccgcgtcgagcgcagcagcggcaagttcctccgccggttccgcctgccggagaacgccaagacggacgaggtgaaggccgggctggagaacggcgtgctcacggtcaccgtgcccaaggccgaggtcaagaagcctgaggtgaaggccatcgagatctccggttaagcaaccctggtccctgactccctggacgtgggaagaagctgtgatgatgatgctccggttctggtcgtgatcggttgatgtctgtgtcatgcaaaagcataacctgctgcctgcaatcagtgttctctgtatgtaatcatgcatgttgagcatatatgaaagtaaataaagcactactcctgc

SEQ ID NO: 47155 - protein, 73 aa, Panicum virgatum
  misc_feature: Ceres CLONE 2034441
  misc_feature: Functional homolog of the protein sequence given in SEQ ID NO 51227
  misc_feature: Useful for making plants with modulated heat sensitivity
MSLVRRSNVFDPFADFWDPFDGIFRSLVPSVAPSGRDTAAFANARIDWKETPEAHVFKADLPGVKKEEVKVEV

SEQ ID NO: 47156 - DNA, 668 bp, Panicum virgatum
  misc_feature: Ceres CLONE 2034447
  misc_feature: Encodes the peptide sequence at SEQ ID NO. 47157
atctgcacaccgagctctgagttagcgttccaggatcggaggtagcttgctaaggtccgatggcagacatgcagatcgtcctgtccgggaggaagatcgaggcgcagtacgtggagatgaaggtgccgctctactcctacgggtgcgagaagaagatcaagaaggcactctcgcatctaaaagggatacattcggtgcaggtggactaccaccagcagaaggtgacggtgtgggggatctgcaaccgcgaggacgtgctcgccgccgtccggaagaagcggacagcggcgcggttctgggacggcgacgtgctgggtcccggccagcaggtgccggctcccggagacgctcccaagcagtacctggcggcgttcaccgcgtacaggttgaggaagtcgtggaagaagctgttcccgctgatccggctgtaaatctggccgtgagcttagttgttgttgttttttttttttgtgaactcccatgagcttagctttcctgacaagtggagacgtattccgcgtgcgaattgatcgcaaggaatatcaaatgggttggtagcgcgtgcgtgttgatatcgaacaaatctgctgcgttacaatcttagagacgggcgaatcacaatgatataccgtttgcacggatcaatgcagttcgattatagttgttgc

SEQ ID NO: 47157 - protein, 123 aa, Panicum virgatum
  misc_feature: Ceres CLONE 2034447
  misc_feature (18)..(79): Pfam Name: HMA Pfam Description: Heavy-metal-associated domain
MADMQIVLSGRKIEAQYVEMKVPLYSYGCEKKIKKALSHLKGIHSVQVDYHQQKVTVWGICNREDVLAAVRKKRTAARFWDGDVLGPGQQVPAPGDAPKQYLAAFTAYRLRKSWKKLFPLIRL

SEQ ID NO: 47158 - DNA, 638 bp, Panicum virgatum
  misc_feature: Ceres CLONE 2034453
  misc_feature: Encodes the peptide sequence at SEQ ID NO. 47159
aacctcgcagtcatccccgagaaggagccgccgccgccgcgcagcgcaaaccctagcagtcttcgccgccgtcactcctcctcggggcgcaaccatggtggccacaaagaagacgaagaagtccacggacaatatcaacaacaagcttcagcttgtgatgaagagcggcaagtacacgctcggctacaagaccgtcctcaggactcttaggaactccaagtcgaagcttgtgatcattgctaacaactgccctccccttcggaagtctgaaattgagtactatgcaatgctggctaaggtcactgttcaccatttccatggaaacaatgttgacctgggtacagcctgtggaaaatacttccgtgtctgctgtcttagcattattgatccaggtgattcggatatcatcaagactacatcgggtgaccagtaagggagagatgccagtaccccttggcattggtgttctgagcttttctagtgtagtagtggatctttcaggacttgtcctttcaccttatattgtgttaagcactatttgcctgcccgtaatctgagtttttgggaacagtcttgcattgaaaattttgttcctggaattgacactatcaatggagctgtggcctatggttgtcctc

SEQ ID NO: 47159 - protein, 112 aa, Panicum virgatum; identical to SEQ ID NO: 41050
  misc_feature: Ceres CLONE 2034453
  misc_feature (12)..(106): Pfam Name: Ribosomal_L7Ae Pfam Description: Ribosomal protein L7Ae/L30e/S12e/Gadd45 family

SEQ ID NO: 47160 - DNA, 684 bp, Panicum virgatum
  misc_feature: Ceres CLONE 2034456
  misc_feature: Encodes the peptide sequence at SEQ ID NO. 47161
aatctccccgccgccgccgcatcgccaaatccccgcgtccagtgtgttcggatcgtctcctgccgcgtctctcccgatccgtcccatcggggacttcgctcagccgtcggcatatgcccctttccgccgcccaaatctgagccgcgcgcgccgggccgcccgtgactctcccgccggctgcgagagcgccgcccgccgccgccgcgcttctcccacgggcagggcagccacacgatacaaatttttgcagcagcaattcaccttgcaaggaagattctgcgctccaatagcgacctgtagcagagccgcgacaatgaacagcctatgtggtgcagcagctatgcagcagctcgagcatctatggactctggtcttccgaatattgcctgatgagctgcctgtgcctggcctcccttccaatttgctaaagagactgttttgcaaagccgggaatctgtatggattggggactgcgaccagagcagtgccgccggagctgccgcaggatgtgttgatggacatctttgccacccttgagaccctcgaccttgtgcgcgtgggctctgtatgcacgtcctggcgttctgcctacacatgcctgcgcgacctggggctgtgcaaacactcccagacaccgtgcctgttttacacttctgagtctgccggtgacaatgctgcgttcct

SEQ ID NO: 47161 - protein, 123 aa, Panicum virgatum
  misc_feature: Ceres CLONE 2034456
  misc_feature (57)..(103): Pfam Name: F-box Pfam Description: F-box domain
MNSLCGAAAMQQLEHLWTLVFRILPDELPVPGLPSNLLKRLFCKAGNLYGLGTATRAVPPELPQDVLMDIFATLETLDLVRVGSVCTSWRSAYTCLRDLGLCKHSQTPCLFYTSESAGDNAAF

SEQ ID NO: 47162 - DNA, 597 bp, Panicum virgatum
  misc_feature: Ceres CLONE 2034457
  misc_feature: Encodes the peptide sequence at SEQ ID NO. 47163
tagacaaaatgtttgaatttgagggtgaattggtatctgctaacaagaattggcagattgtttatactgacaatgagggtgatatgatgcttgtgggagatgacccgtgggaagaattctgcagcatagtgcgcaagatctacatttacacaaaagaggaggtccagaagatgaactcgaaatcatctgccccgagaaaggaagaacctctagcatctggtgaagtatgtgcggccacaaatgagtaggacttgtctacctggggcaagcagtttagataactaggtcgtgtgaaggaagctgacgaagctgacgatgcatgaaagaggatctctgcattgtgccgggtccctgcccaagtaacacctcaaaccttttgcgtgtctgttgcaacccataccatccgtttgggtttagtagggagtgtagacctgtcttctccgcggtttgctcttggcagaatgtttaagcgccaaggttattattatcgttatttgctgattttctctccccctttggctgtaaatatttatcgacccagtccagtagtagcaagcggtagcaagtaccctgtattaaccagttatttgcggcttt

SEQ ID NO: 47163 - protein, 81 aa, Panicum virgatum
  misc_feature: Ceres CLONE 2034457
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: The sequence is a functional homolog of SEQ ID NO 298 in the 10/412,699 US patent application
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
DKMFEFEGELVSANKNWQIVYTDNEGDMMLVGDDPWEEFCSIVRKIYIYTKEEVQKMNSKSSAPRKEEPLASGEVCAATNE

SEQ ID NO: 47164 - DNA, 744 bp, Panicum virgatum
  misc_feature: Ceres CLONE 2034492
  misc_feature: Encodes the peptide sequence at SEQ ID NO. 47165
atatggtatttgcaaaatcgtggccccggtaagtgcttctgttcctgctggtgtcgtgctgatgaaggaacagcccaattttaagttcatgactagagttcagccccttcgtctagctgaatgggctgaagatgatacagtcactttcttcatgagtggaagaaagtacacattcagagactatgaaaaaatggccaacaaagtgttctctaagaaatattccagcgccagttgtctcccagctaggtatgtggaggaggaattctggcgtgaaattgcttttgggaaaatggatttcgtagaatatgcttgtgacgttgatgggagtgccttctcttcttctcctcatgatcaacttgggaaaagcaattggaacctcaagaatttttcacggcttccgaattctgttctgagactccttcagatgccaattccaggagtaacagatccaatgctttatattgggatgctcttcagtatgtttgcatggcatgtcgaagaccactatttgtacagcataaattaccatcactgtggggcatttaagacatggtatggaatacctggcgatgcggctcctgggtttgaaagggttgctagccagtatgtatataacaaggacattttgattggtgatggggaggatgcagcttttgatgttctactgggaaagacaacaatgttccctccaaatgtcttactagatcacaatgttcctgtatatagagctgtacaaagacctgt

SEQ ID NO: 47165 - protein, 247 aa, Panicum virgatum
  misc_feature: Ceres CLONE 2034492
  misc_feature (151)..(247): Pfam Name: JmjC Pfam Description: JmjC domain
YGICKIVAPVSASVPAGVVLMKEQPNFKFMTRVQPLRLAEWAEDDTVTFFMSGRKYTFRDYEKMANKVFSKKYSSASCLPARYVEEEFWREIAFGKMDFVEYACDVDGSAFSSSPHDQLGKSNWNLKNFSRLPNSVLRLLQMPIPGVTDPMLYIGMLFSMFAWHVEDHYLYSINYHHCGAFKTWYGIPGDAAPGFERVASQYVYNKDILIGDGEDAAFDVLLGKTTMFPPNVLLDHNVPVYRAVQRP

SEQ ID NO: 47166 - DNA, 682 bp, Panicum virgatum
  misc_feature: Ceres CLONE 2034493
  misc_feature: Encodes the peptide sequence at SEQ ID NO. 47167
gacgcacactgcagatccttactcctctgcgagctgcttgcttgctgtgatcgttcaatccccactccatctgaatcgtatcgagtcccttcaggtcagcctgcaggccgggctccgatcagccatggcgaacgcggcgtccggggtggcggtggcggaggagtgcacggcgcggttccaggagctgcgcacggcgcgcgcgcaccgcttcgtggtgttcaagatcgacgactccctggagcgggtggtggtcgacaaggtgggcgcccgggacgccgtcttcggcgacctcaccgccagcctccccgccgacggctgccgctacgccgtgtacgaccacgacttcaccgtcggcgacgccaccgcgcagggctccgcggccgaggcgccccgcagcaagatcgtcttcgtgtcgtggtccccggcgacggcggacgtgaagagcaagatggtgtacgcgagctcctgcgaggggttcaagaaggagctggacggcgtgcagatcgacctgcaggccacggagcccagcgagctcaccctcgacgtcctcaacgaccacgtctcctaatcgattggtggtgctactccgaaataacgtacacgtacgccgcatatatactttgtgcacggcgtgcaatacaaagatgtgtgtgtgtgtgtgactgtgtatccatgtacgtac

SEQ ID NO: 47167 - protein, 147 aa, Panicum virgatum
  misc_feature: Ceres CLONE 2034493
  misc_feature (12)..(147): Pfam Name: Cofilin_ADF Pfam Description: Cofilin/tropomyosin-type actin-binding protein
MANAASGVAVAEECTARFQELRTARAHRFVVFKIDDSLERVVVDKVGARDAVFGDLTASLPADGCRYAVYDHDFTVGDATAQGSAAEAPRSKIVFVSWSPATADVKSKMVYASSCEGFKKELDGVQIDLQATEPSELTLDVLNDHVS

SEQ ID NO: 47168 - DNA, 727 bp, Panicum virgatum
  misc_feature: Ceres CLONE 2034499
  misc_feature: Encodes the peptide sequence at SEQ ID NO. 47169
cctggacaaaatcagctcccgaaatccaaaactgaaacaggtgattttgaggttgggccttgctcggaggaccgattttggagccggaggaggggatgtcaggacccctcgatcgatttgctaggccatgtcttgtacataacgatgaaaggaaagagagcagatctgatgcagacaactcagaaggagataagaagactaaaattggctctttcaagaaaaaagcaattaatgcggggaataaattcaggcattccttgagaaggagaagcaaaaagaaaaatgaacctagggattccatcaaggacataagggatattaaagagctccaagatgtcgagacatttcggcaatgcttaattgatgaggatttgctgccacaacagcatgatgattatcacatgatgttgaggttcctaaaagcgcggaaatttgatgttgagaaagcaaagaatatgtggtcagacatgcttaggtggaggaaggaattcgggaccgacaaaatagaggaatttgactacaccgagttagatgaagttacaaagtattacccacaattttatcatggggtggataaagagggtagacctatctacatagagttaataggaaaagttgatgcaaacaagctagtgcaggtaacaaccatcgatcggtatgtgagataccatgtcaaggagtttgagagatgtttccagatgagatttccagcttgctcaattgctgc

SEQ ID NO: 47169 - protein, 210 aa, Panicum virgatum
  misc_feature: Ceres CLONE 2034499
  misc_feature (75)..(137): Pfam Name: CRAL_TRIO_N Pfam Description: CRAL/TRIO, N-terminus
MSGPLDRFARPCLVHNDERKESRSDADNSEGDKKTKIGSFKKKAINAGNKFRHSLRRRSKKKNEPRDSIKDIRDIKELQDVETFRQCLIDEDLLPQQHDDYHMMLRFLKARKFDVEKAKNMWSDMLRWRKEFGTDKIEEFDYTELDEVTKYYPQFYHGVDKEGRPIYIELIGKVDANKLVQVTTIDRYVRYHVKEFERCFQMRFPACSIA

SEQ ID NO: 47170 - DNA, 408 bp, Panicum virgatum
  misc_feature: Ceres CLONE 2034516
  misc_feature: Encodes the peptide sequence at SEQ ID NO. 47171
cgagagcgcccccaagttcctcaagaacggcgacgctgggttcgtcaagatgatccccaccaagcccatggtggtggagacgttctcagagtacccgccgctggggcggttcgctgtgcgggacatgaggcagacggtggctgtcggcgtgatcaagagcgtggagaagaaggacccaacgggagcaaaggtcaccaaggctgcggctaagaagaaataaaaatatataggtcgatccgtgccgtggatgttattataacatcccataagctagctagtggagtattttggctagaaagtttgcattactgttattatatcgtcggggttgtttatttgggtctcgcagtgcttagtatgtgtcggtgtcagtttccagaatcaatatatatgctatgtttttcgctg

SEQ ID NO: 47171 - protein, 72 aa, Panicum virgatum
  misc_feature: Ceres CLONE 2034516
  misc_feature (1)..(55): Pfam Name: GTP_EFTU_D3 Pfam Description: Elongation factor Tu C-terminal domain
  misc_feature: The sequence is a functional homolog of SEQ ID NO 576 in the 10/666,642 US patent application
ESAPKFLKNGDAGFVKMIPTKPMVVETFSEYPPLGRFAVRDMRQTVAVGVIKSVEKKDPTGAKVTKAAAKKK

SEQ ID NO: 47172 - DNA, 722 bp, Panicum virgatum
  misc_feature: Ceres CLONE 2034529
  misc_feature: Encodes the peptide sequence at SEQ ID NO. 47173
tggacgcgctcacccgcctccgccgctccctcgtcggcggcggcgacgaggaggaggacctgccggaggactccattctgggggacaccgaggacctctgctccctctcccaactccagaggatctacgcgttcgcggcgtgcttggtggccggactcgccctgatgatcctgtcttttatcgtcttcgctagacctatcaaattcgcagtcatgtttacgtttggaaacatgttggcagttgggagcacagcctttgttatggggccacaaaaacagctaaggatgatgtttgatccagttcgattgtatgcaacagctatttatgttggatgtgttgttttggctctaatcttcgctctttggattcatgacaagctgctaacactgatcgcgatcatatgtgagatctgcgccctgttttggtacagtttgagctacatacctttcgcacgaaggatggtttctgacctgatggtgaagttatgtgacactgaactttgagcttgggtgggttgtgcagcattcgctagtgcctgaaatcagggaagcctttgggtgcttgttcatttacccgtttccaatgggtatcttgtttgattaacaaaccaaagtttgttttttttgtataaatgtatgccatgatgcaatatttgtaaaaactttggttgcatctgtaaatcggatttctgggcttgtactgcagcaaaaacatctgcttgt

SEQ ID NO: 47173 - protein, 166 aa, Panicum virgatum
  misc_feature: Ceres CLONE 2034529
  misc_feature (35)..(154): Pfam Name: SFT2 Pfam Description: SFT2-like protein
DALTRLRRSLVGGGDEEEDLPEDSILGDTEDLCSLSQLQRIYAFAACLVAGLALMILSFIVFARPIKFAVMFTFGNMLAVGSTAFVMGPQKQLRMMFDPVRLYATAIYVGCVVLALIFALWIHDKLLTLIAIICEICALFWYSLSYIPFARRMVSDLMVKLCDTEL

SEQ ID NO: 47174 - DNA, 758 bp, Panicum virgatum
  misc_feature: Ceres CLONE 2034543
  misc_feature: Encodes the peptide sequence at SEQ ID NO. 47175
acacgcccgcaccgcaccgcaggtccgcagtttctgcttcccgttaggcttcctgtctttttcttctccggctccggctccggcgaccggcggcgatgggggtcaagaacctctgggacatcctcgactcctgcaagaagaagctcccgctccagcacctccagaacaagaaggtgtgcgtggatctttcctgctggctcgtgcagctctgcagcgcccaccgctccccagccttcctcaaggacaaggtctacctcaagaacctcttccaccgcatccgagccctcctcgccctcaattgcagcctcgtcttcgtcacagatggggcgattccgtctgtcaaattggcaacttacaggcgccgcctcggagttaatgctgctgctgctttgttcttgttcccctcagtttcccctcaaccccagtcatttaaattctcctttggaatcaattcaccccaggctgctcgagaggaggacaactcacaacccctgacttctttgcgccggaacaagagctctgaattctcgcgcatgataaaagaggccaagcatcttgggatggccctgggaatcccctgcttggatggagtggaagaagcggaagcacagtgcgcattgctcaattttgcctccttgtgcgatggctgttttacatcagattcagattcattccttttcggtgcagggacagtttatagagatgttttcataggagagggtggctatgtaatttgctatgagatggaagacattgag

SEQ ID NO: 47175 - protein, 220 aa, Panicum virgatum
  misc_feature: Ceres CLONE 2034543
  misc_feature (1)..(97): Pfam Name: XPG_N Pfam Description: XPG N-terminal domain
  misc_feature (156)..(218): Pfam Name: XPG_I Pfam Description: XPG I-region
MGVKNLWDILDSCKKKLPLQHLQNKKVCVDLSCWLVQLCSAHRSPAFLKDKVYLKNLFHRIRALLALNCSLVFVTDGAIPSVKLATYRRRLGVNAAAALFLFPSVSPQPQSFKFSFGINSPQAAREEDNSQPLTSLRRNKSSEFSRMIKEAKHLGMALGIPCLDGVEEAEAQCALLNFASLCDGCFTSDSDSFLFGAGTVYRDVFIGEGGYVICYEMEDI

SEQ ID NO: 47176 - DNA, 690 bp, Panicum virgatum
  misc_feature: Ceres CLONE 2034562
  misc_feature: Encodes the peptide sequence at SEQ ID NO. 47177
acgacggttcacccctctcgccctgaggcagtcaagcaggctcatccccctttcccttctctctccgtctctcctctcccttggtcttccttcctggcggcgacgacttggcgatcggcggcgcgtcttcctccgcccctttgccggcgacgatcacccaccaggctgatctggtcttttggtttcgtggaattgatctggcagcgcggggggcgatctgttaaacagtctggatcatgcttcttccagtttaaaagcttgaatctcgtaggtgtgatccattccttggactgcaaagaatcgtatgttcttgctccttgctgcgacaatcatgcagagtgggggcgagatgaggcctgtgcacaacagcgttgacacagtgaacgcggccgccgccgccattgtcacagcggagagccgtgcagaacctcccgcggagccgcgaaggaaatgggctgatcggttgagtgtatacttctgctttgggtctcagaagaatggtcggcgcatcaaccacgctgcacttgtcccagaacccgcgtctcaaaggttagatgcgcctgcagcagaaattccaaaccacccaccgcctcctgtattcccatttgtggcacctccatcctctcccgcttctttcctcccatcagaacccacatctattgtacaatcgccaagggttggcgctccacc

SEQ ID NO: 47177 - protein, 119 aa, Panicum virgatum
  misc_feature: Ceres CLONE 2034562
  misc_feature: The sequence is a functional homolog of SEQ ID NO 3 in US patent 7129396
MQSGGEMRPVHNSVDTVNAAAAAIVTAESRAEPPAEPRRKWADRLSVYFCFGSQKNGRRINHAALVPEPASQRLDAPAAEIPNHPPPPVFPFVAPPSSPASFLPSEPTSIVQSPRVGAP

SEQ ID NO: 47178 - DNA, 723 bp, Panicum virgatum
  misc_feature: Ceres CLONE 2034564
  misc_feature: Encodes the peptide sequence at SEQ ID NO. 47179
cggaatcccctcctcccctcagcctctcatcctatccatccaagaaccccgaaaattccagacccgggagcgcgcagaaattagcgcccgctagcaagccagccagccagccgaagcaggccgcagccatggccgcccccgccacgacctccctgctgagcacgctgctgcagctgccccttgcccctttctcggggaagagctcgccgccgtccgtggtgcacgtggcgcggcgggcgccgacggcggtggtggccgccaaggggtacaatgtgcagatcctggtggacgagaacgagggcgaggagtccatcttccggcggttccgccgcgaggtgatgcgcgccggcgtgctgcaggagatcaagcgccgccggaggtacgagagcaagaaggacgagaagaagcgcaaggcgcgcgaggccgggcgccgcaaccgccgcaggcgcatgatggatgagccaaggttcccagaagaagatgcaggggcagctgcaagagctcgcgatgaggatgatgacaactgggaaattgacggtctcctgtgaaacaatggagttcataagttcagaaccctccagatacacagtttcgacatttgagttcttttttggctaggcaaagcacaaaactgtattgagttttggcagtgttcatttccacttcaattgtacgatcgctatgtgtaactaaatcttagctaatgcagcatccttcgctttc

SEQ ID NO: 47179 - protein, 139 aa, Panicum virgatum
  misc_feature: Ceres CLONE 2034564
  misc_feature (49)..(102): Pfam Name: Ribosomal_S21 Pfam Description: Ribosomal protein S21
MAAPATTSLLSTLLQLPLAPFSGKSSPPSVVHVARRAPTAVVAAKGYNVQILVDENEGEESIFRRFRREVMRAGVLQEIKRRRRYESKKDEKKRKAREAGRRNRRRRMMDEPRFPEEDAGAAARARDEDDDNWEIDGLL

SEQ ID NO: 47180 - DNA, 576 bp, Panicum virgatum
  misc_feature: Ceres CLONE 2034597
  misc_feature: Encodes the peptide sequence at SEQ ID NO. 47181
ctcgcagtctccgcctgctccggccctctccacttcggcaacaccagcacagttgcggcggcggttacgacccgaggcccgagcccaggcaggggcgtcgcgaccaccgcgatgccttcgtcgtcctcctcgccgccgccgccgccagtcgaggagacgaccgccgcccccgccgccgcctcccccgcgggtgggttccgcctcaccgagccctccttcctcgagtcgctgatgccgaagaaggagatcggcgtcgaccgcttcctcgccgcgcaccccgagtacgatgggcgcggcgcgctcatcgccatcttcgattctggagttaatccagctgctgctgggttgcagactacttcagatggaaagcctaaaatccttgacgttattgattgcactggtagtggtgatgttgacacatccaaagtggtgaaagctgatgctgatggtgctattgtcggtgcttcaggtgctcgtttggttgtaaactcctcgtggaagaacccttctcaagagtggcatgttggctgtaaattaatatatgaactgtttactgatacacttacatctcgattg

SEQ ID NO: 47181 - protein, 154 aa, Panicum virgatum
  misc_feature: Ceres CLONE 2034597
  misc_feature: SWISSPROT Homolog: EC 3.4.14.10 Tripeptidyl-peptidase II
MPSSSSSPPPPPVEETTAAPAAASPAGGFRLTEPSFLESLMPKKEIGVDRFLAAHPEYDGRGALIAIFDSGVNPAAAGLQTTSDGKPKILDVIDCTGSGDVDTSKVVKADADGAIVGASGARLVVNSSWKNPSQEWHVGCKLIYELFTDTLTSR

SEQ ID NO: 47182 - DNA, 645 bp, Panicum virgatum
  misc_feature: Ceres CLONE 2034614
  misc_feature: Encodes the peptide sequence at SEQ ID NO. 47183
tcaccgcatcatttatttttcctttttttttggggccccccttccccatccctcagattccttttctttcttgctcaggttttccccaaaccctgcccaccgccgccgcattcctttgcaactccgattgaagcaacacatcggcgcaccgcgggcatcaaaccttggacgtacagttaataagttgtggcaaaacatctcctatgatggcttcacgaggaaccagtgccgtgctttcaagagctgctcggatgaggcaaaagctgcagtctgctttggaggccagtgccctagatatcgaagatgtttcttaccaacatgctgggcatgcagctgtcaaggacaatgcaaacgagacgcattttaacatcaaggtaatctcaccaaaatttgagggacaaagtctggtgaagcgtcacaggatggtgtatgatcttcttactgatgaactgaactcaggtctccatgctatctccattgttgcaaaaaccccaaaagaatcaggatcttgagtgtctagagtaatgagcaccggcttgtgtttcagaataagttgattgtagcagtatcatgtaaccataaattgattgccaaaacattggtataatgtgctgcgtttcttaagaagacatggttttttgcacc

SEQ ID NO: 47183 - protein, 102 aa, Panicum virgatum
  misc_feature: Ceres CLONE 2034614
  misc_feature (20)..(100): Pfam Name: BolA Pfam Description: BolA-like protein
MMASRGTSAVLSRAARMRQKLQSALEASALDIEDVSYQHAGHAAVKDNANETHFNIKVISPKFEGQSLVKRHRMVYDLLTDELNSGLHAISIVAKTPKESGS

SEQ ID NO: 47184 - DNA, 746 bp, Panicum virgatum
  misc_feature: Ceres CLONE 2034624
  misc_feature: Encodes the peptide sequence at SEQ ID NO. 47185
aatgatcactagtgcttgccatacttgctccgcctattaatagcgttggcctgtaacctccctgcctgccagagcgccccgtcgtcatccttccttccctgcttcgatcgccagcccttagcctcctgtcgtctcgtcgtcgtccgcggcctgcttatcctcgtctctggatccggccggccgcctgagcgccgggccggggcgcgggggctagctagccagcgcgctagtctctcgtcccagcgtcgtacggttgtgtgggtgcgtgcgtgctagctgccggcattgcgcgaggaaattgagagaggcggcgcgcggcggcatgaagctcctcgtcctgccgccggcagccgctgggtcggcgccaccgccgtgtccttcccgctttctcgtgaaaggtccatgccgcatctggggcaaagctggggcgacggggccccgcggcacgcgcgtcgcccggtggagggcgcaggcccggacgacgacaacgcaggccgacaacgtatccgctgctgctcctcctgctaaagtacctgcagtgttccaaacaacccacatcgaagacgatactgaaatcataaaatggcctgggaaaccagaggatcttgatgagtaccgattgatccctgaggctgatgggacggacttgcagccactcatcgatcaggtgagggcaattctaagatcaatgaatgacggggatatcagcatctcggcgtatgacacagcgtggggtgcactggtgc

SEQ ID NO: 47185 - protein, 141 aa, Panicum virgatum
  misc_feature: Ceres CLONE 2034624
  misc_feature: SWISSPROT Homolog: EC 5.5.1.13 Ent-copalyl diphosphate synthase
MKLLVLPPAAAGSAPPPCPSRFLVKGPCRIWGKAGATGPRGTRVARWRAQARTTTTQADNVSAAAPPAKVPAVFQTTHIEDDTEIIKWPGKPEDLDEYRLIPEADGTDLQPLIDQVRAILRSMNDGDISISAYDTAWGALV

SEQ ID NO: 47186 - DNA, 715 bp, Panicum virgatum
  misc_feature: Ceres CLONE 2034625
  misc_feature: Encodes the peptide sequence at SEQ ID NO. 47187
  misc_feature (629)..(629): n is a, c, t, g, unknown, or other
aggaaagagaattggctgagagttcacgtgatctactgactgtagatctagaaagtgtcactcatgacgccaagcgctttagcgagcagctaaaaatggttcaagacacgaacaaaaggcttcaagaatacaacaccagcttacaacagtacaacagtaatcttcaggctgatgcctcaaagagtggtgagactatctcaaaactacaaaaagagaagagcgccatgatggaaactatggccgctttgagagaatgtaacaattcaatgagcagccagctagaatcttctagagcttctcaacaagaggcaattagggtgaaggaagaactcaggaaagaagtggagtgctttagagctgagttgaagcaggctagagatgaccgtgatcattcagttgctcaactgaacaatttgaacattgaacttgctaattgcaaggaacaaattggtagatcatctaaagaatgtgagagcatgagcactaaagtatcggcacttgaggaaacatgcaatacacagcaagaacagattcagactttacagaagcagcttgcagttgcaaccgagaagttgaagcttgctgatgtgactgcaatcgaggcgatgacagggtatgaagagcagaangagaaaatagaataccttgaggagcgtttggcgcatgcagagtctcaaattgtcgaaggtgatgagttgcggaaaaaactacacaa

SEQ ID NO: 47187 - protein, 237 aa, Panicum virgatum
  misc_feature: Ceres CLONE 2034625
  misc_feature: SWISSPROT Homolog: EC 2.7.11.1 Non-specific serine/threonine protein kinase
  misc_feature (209)..(209): Xaa is any aa, unknown, or other
ERELAESSRDLLTVDLESVTHDAKRFSEQLKMVQDTNKRLQEYNTSLQQYNSNLQADASKSGETISKLQKEKSAMMETMAALRECNNSMSSQLESSRASQQEAIRVKEELRKEVECFRAELKQARDDRDHSVAQLNNLNIELANCKEQIGRSSKECESMSTKVSALEETCNTQQEQIQTLQKQLAVATEKLKLADVTAIEAMTGYEEQXEKIEYLEERLAHAESQIVEGDELRKKLH

SEQ ID NO: 47188 - DNA, 589 bp, Panicum virgatum
  misc_feature: Ceres CLONE 2034639
  misc_feature: Encodes the peptide sequence at SEQ ID NO. 47189
cctgcttctcgatcggattggggcttcgttgggggggtcttggtaggtgtggtgtgcccgggagttggggcttcgttactttgcttcgctcgtgcgcaagggagagagagagaagagggaggagtaagcgaggaggcagatggcgtcgaagcggatcctcaaggagctcaaggacctgcagaaggatcctcccacctcctgcagcgcaggtagtttcggttctgcacgccccatcctctttgttctactacagctctacttttttttttaaatttccatcatgggagatcggttcttcccttctcaagacgtatgtgcgatgcgggtcgtcgtgcttagtttccagatctgtgtgtagatccactgggaagcctgtcgttggcgcacgaataatttcaaatattgttcttggtgtgggtaagggcatgtagtgcaaaattaggaaaagaatggtaggttatctgtgtatgtagttggcactactgctaattttggttagatccagagaggggcctggcctccttgtggtcatttcgtctcatggccaggcaccttcaggatcaatttgaaatttgccatttgcccgttc

SEQ ID NO: 47189 - protein, 43 aa, Panicum virgatum
  misc_feature: Ceres CLONE 2034639
  misc_feature: SWISSPROT Homolog: EC 6.3.2.19 Ubiquitin--protein ligase
  misc_feature: Functional homolog of the protein sequence given in SEQ ID NO 50118
  misc_feature: Useful for biocontainment applications
MASKRILKELKDLQKDPPTSCSAGSFGSARPILFVLLQLYFFF

SEQ ID NO: 47190 - DNA, 551 bp, Panicum virgatum
  misc_feature: Ceres CLONE 2034653
  misc_feature: Encodes the peptide sequence at SEQ ID NO. 47191
agcagcgaagggagctaggactagaagtctagaacaagtagagacgtagagtacagggagaagccatggccggcaggagcttcttgatccggtctcccaaggaggagtccgacgccgccgtcaaagaggctgtactactgggagcgaagaatgctgcaatagctggtactgtggtagcggttcccacgttggtcggctgccgtgtccttccttgggctaaggctaatctcaactacactgcacaagcactcatcatatctgcagacaaaacaccatcgggaagcttgacaagtagatttcggtgcagaactatggctgtaatggctcactgattttggtgtttcgctactcaagccaattgtgctgtaaagacttgcttacctgacggactcaaccggtgcatgcagttttcccctaattttatttggaataaaatatggggctaatgggtatacgcctttgtaatgtggaatacgagacctgcttctttgtcacttgttaggggttgtaagactgttcagtaaaatgctatatggtatttgttgcctccc

SEQ ID NO: 47191 - protein, 88 aa, Panicum virgatum
  misc_feature: Ceres CLONE 2034653
  misc_feature (10)..(82): Pfam Name: ENOD93 Pfam Description: Early nodulin 93 ENOD93 protein
MAGRSFLIRSPKEESDAAVKEAVLLGAKNAAIAGTVVAVPTLVGCRVLPWAKANLNYTAQALIISADKTPSGSLTSRFRCRTMAVMAH

SEQ ID NO: 47192 - DNA, 679 bp, Panicum virgatum
  misc_feature: Ceres CLONE 2034684
  misc_feature: Encodes the peptide sequence at SEQ ID NO. 47193
aaaaaaaactctccctatctctccctctctccccccacccagagctcgaaaccctaggcgcgcgcggcgggggcggcgacgcatggccatggacccggacgcggtggccaaggccttcgtggagcactactaccggacgttcgacaccaaccgcgccgcgctggtgtcgctgtaccaggacacctccatgctcaccttcgagggccagaagctccagggccccgccgccatcgccggcaagctcggctcgctccccttccagcactgcgagcaccagatcgtcaccgtcgacttccagccgtcggggccccagggaggcatgctcgtcttcgtctccggctccatccgcactgcccccgacgagcaccccatgaagttctcccaggcgttccatttgatgccggctggaaattccttctacgtgcagaatgacatgttccgcctgaactatggttaaagacagtcaagagttgctggaagcgaagtgattaagggtttcatgttgaactgatgaatatgaatgatgctgctactcttgcccctttgttggctgctgttgtttattgctagaaaattgctagacttgatatgcttgttggataatttcttattttggatcatgtactctggttgcgtgggcaccgattctctgtggattgtgaatgaaaacggtccagat

SEQ ID NO: 47193 - protein, 124 aa, Panicum virgatum
  misc_feature: Ceres CLONE 2034684
  misc_feature (8)..(121): Pfam Name: NTF2 Pfam Description: Nuclear transport factor 2 (NTF2) domain
MAMDPDAVAKAFVEHYYRTFDTNRAALVSLYQDTSMLTFEGQKLQGPAAIAGKLGSLPFQHCEHQIVTVDFQPSGPQGGMLVFVSGSIRTAPDEHPMKFSQAFHLMPAGNSFYVQNDMFRLNYG

SEQ ID NO: 47194 - DNA, 623 bp, Panicum virgatum
  misc_feature: Ceres CLONE 2034687
  misc_feature: Encodes the peptide sequence at SEQ ID NO. 47195
actagagaccgctcgaggcgtcctccgccgccgctcccgctcatcttctcctctggcgctctccctcccggatccaggatgaagtttgttgctgcatatctacttgctgtcctcgatgggaaccccagccccgcagcggaggatctgtccgccatacgggaatcaggtggctgtgaaatcaacagtgaaaagatggagctcctgctgtcccaactgagcggcaaggacattacggagctcattgctgcaggaagggagaagttcgcttctatcccctgcggtggtggtggtgagggtgtatcggccgctgctccacctgctggtggcgctgctcttgctcctgaagcgaataaggaagagaaggtggaggataatgaagaaagatatgatgacatgggcttcagcctcttcaattaagcttctgcagtcatctaagctgtctcatgttagtacgaaaaccaatattcgatgtttggatttgaaccctgttttattttgtcaatcaccagatagacttattatcttgatatgtactaattcatctgtaggtggctatgctggttgtgggatggtatgcttatgaaccagacttctcactatcctatatatattcgatgaattgg

SEQ ID NO: 47195 - protein, 112 aa, Panicum virgatum
  misc_feature: Ceres CLONE 2034687
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass
MKFVAAYLLAVLDGNPSPAAEDLSAIRESGGCEINSEKMELLLSQLSGKDITELIAAGREKFASIPCGGGGEGVSAAAPPAGGAALAPEANKEEKVEDNEERYDDMGFSLFN

SEQ ID NO: 47196 - DNA, 686 bp, Panicum virgatum
  misc_feature: Ceres CLONE 2034702
  misc_feature: Encodes the peptide sequence at SEQ ID NO. 47197
atccgcacgctctcctccccccgactccgatccctcatggccgccaccgccgccgccgcgctcgcctcaccggcggccctctccgcgtcgccggcgcgccggggcctcgtcagcttcgccgcccccgcgctccgctcgggctccggcacccgcgccgtcgcgctctccggtgtacgaactcatgttgtggctgttgagcaagctgttgtacaaaatgctactaagttggaagctccagtagttgttgttactggtgcttccaggggaattggaaaagccattgcattaactcttggagaagcaggctgcaaggtcttggtgaattatgcccgatcttcaaaggaggctgaagaagtctccaaggagattgaagcatctggaggccaggccatcacctttggaggagatgtttccaaagaagctgacgttgaatctatgataaaaacagcagttgacacatggggaacaattgatgtacttgtaaataatgcaggaatcacacgggacacattgttgatgagaatgaagaaatcacagtggcaagacgtaattgatctgaatcttactggcgttttcctatgcacgcaggctgcaacgaaagtaatgatgaagaaaaagaagggaagaattatcaacatagcatcaattgttggtctaactggtaatgctggacaagctaattatgc

SEQ ID NO: 47197 - protein, 216 aa, Panicum virgatum
  misc_feature: Ceres CLONE 2034702
  misc_feature (67)..(216): Pfam Name: adh_short Pfam Description: short chain dehydrogenase
  misc_feature: SWISSPROT Homolog: EC 1.1.1.100 3-oxoacyl-[acyl-carrier-protein] reductase
MAATAAAALASPAALSASPARRGLVSFAAPALRSGSGTRAVALSGVRTHVVAVEQAVVQNATKLEAPVVVVTGASRGIGKAIALTLGEAGCKVLVNYARSSKEAEEVSKEIEASGGQAITFGGDVSKEADVESMIKTAVDTWGTIDVLVNNAGITRDTLLMRMKKSQWQDVIDLNLTGVFLCTQAATKVMMKKKKGRIINIASIVGLTGNAGQANY

SEQ ID NO: 47198 - DNA, 684 bp, Panicum virgatum
  misc_feature: Ceres CLONE 2034707
  misc_feature: Encodes the peptide sequence at SEQ ID NO. 47199
agagagaataggcaaggcacggccggacgttgtacagattcttgtgcgcaacgtacgcagagctgaaggatatgcaagcggagatgcagggcggcctggagcagccgatgcagatggtgctgcgggtgaagcacccgtcgtcgctgggcggcggcggcggcggcgacgaggaggaaggcgaggcgtcgtcgcggtcggcgctgtcggtgttcaaggccaaggaggagcagatcgagaggcgcaagatggaggtccgggagaaggtcttcgcgcacctcggccgcgtcgaggaggagtccaagcgcctcgccttcatcaggcaggagctggaaggcatggcggacccgacgaggaaggaggtggagtcgatacggaagcggatcgacacggtgaaccgtcaactaaagcctctcggcaagagctgcgtcaaaaaggagaaggaatacaaagaggtgctcgaggcctacaatgagaagagcaaagagaaagcactgctagtcaacaggctaattgagctggtgagcgaaagcgagaggatgcggatgaagaagctcgaagagctcaacaagacagtcgactcactctattagacacaagatagcagtgttcacgccatcccccgattggagggcctgctcgctctctcaactgtaaactttgtgtgccatggatccgtgactcgtc

SEQ ID NO: 47199 - protein, 168 aa, Panicum virgatum
  misc_feature: Ceres CLONE 2034707
  misc_feature: Functional homolog of the protein sequence given in SEQ ID NO 50446
  misc_feature: Useful for making plants with modulated biomass
MQGGLEQPMQMVLRVKHPSSLGGGGGGDEEEGEASSRSALSVFKAKEEQIERRKMEVREKVFAHLGRVEEESKRLAFIRQELEGMADPTRKEVESIRKRIDTVNRQLKPLGKSCVKKEKEYKEVLEAYNEKSKEKALLVNRLIELVSESERMRMKKLEELNKTVDSLY

SEQ ID NO: 47200 - DNA, 734 bp, Panicum virgatum
  misc_feature: Ceres CLONE 2034711
  misc_feature: Encodes the peptide sequence at SEQ ID NO. 47201
gaaacatcaaacaaagaccaacaattgtagctcgtgcagtaggagctgcgactgcaagcaaacatgctggccctcgttttcctgctcgtctccagcttcagcctccaaacaaccggcgctatcgacaccctcaccttgggccagtctctcccatggaaccagacgctggtctccaagggcggcaactttgagctcggcctcttctcccccggcaagtccaagaagtactacatcggcatctggttcaagaaggtctccaagcaaacggtcgtatgggtggccaaccgagagcgcccgatcctcgtgccgtcggcctctcgcttcacgctgagcgatcgcggcgagctcctcgtccaggcggcgccatccaacaccttgctgtggtcgtcgaacgcgtccgcgtcgtccccgggcaccaccgtcgtcgccacgctccaggacgacggcaacctcgtggttcggaacaacgcgacggtgtcggcgtcggcgtcggagccggaaaccgtgacgtggcagagcttcgaccaccccacggacacgtggctccccggggccaggctcggctacgaccgggcccgcggcgtgcacagcttcctcacgtcgtggaccgacgccgagaacccggcgcccggcgccttctccatggtgatcgacccgcgcgggcaggccaagttcgacctgctcgccggcggcgcgcaccagtactggaccacaggcctgtgggacggcgaggt

SEQ ID NO: 47201 - protein, 223 aa, Panicum virgatum
  misc_feature: Ceres CLONE 2034711
  misc_feature (66)..(188): Pfam Name: B_lectin Pfam Description: D-mannose binding lectin
MLALVFLLVSSFSLQTTGAIDTLTLGQSLPWNQTLVSKGGNFELGLFSPGKSKKYYIGIWFKKVSKQTVVWVANRERPILVPSASRFTLSDRGELLVQAAPSNTLLWSSNASASSPGTTVVATLQDDGNLVVRNNATVSASASEPETVTWQSFDHPTDTWLPGARLGYDRARGVHSFLTSWTDAENPAPGAFSMVIDPRGQAKFDLLAGGAHQYWTTGLWDGE

SEQ ID NO: 47202 - DNA, 653 bp, Panicum virgatum
  misc_feature: Ceres CLONE 2034723
  misc_feature: Encodes the peptide sequence at SEQ ID NO. 47203
ctttttacaccacagaagtcctccggaagtttgccaggtcacagcttgattacatccttggaaagaacccactaaagatgagctatgttgtgggttttggaaataagtaccctaagcgtcctcatcacagaggtgcatcgatacctcataatggcgtcaagtatggatgcaaaggaggtttcaaatggagggagactaaaaaggcaaaccctaatattctcgtcggagcaatggtggctggccctgacaggcatgatggtttcaaagatgtccgcacaaactacaattacacagagcctactcttgcagcaaatgctggtttggtcgcagcactgatttctatagctgatataccaactggaaggtacagcatcgacaagaacacaatcttctctgcaattcctcctatgttcccaacacctccaccgccgccatcagcatggaaaccataaagagacagacctctgaatattttccaagcatcaaactgggaagtggagcaacatatgatcgtttggtgcagcaaaggccagaaacagaatatcagatgacataagcttatagagcttctatttctgtaccagtttgacagatcagtataaaatcttctgtcaaacatagatcggaagttgtgtgcaccgcgtgaagctaat

SEQ ID NO: 47203 - protein, 149 aa, Panicum virgatum
  misc_feature: Ceres CLONE 2034723
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
FYTTEVLRKFARSQLDYILGKNPLKMSYVVGFGNKYPKRPHHRGASIPHNGVKYGCKGGFKWRETKKANPNILVGAMVAGPDRHDGFKDVRTNYNYTEPTLAANAGLVAALISIADIPTGRYSIDKNTIFSAIPPMFPTPPPPPSAWKP

SEQ ID NO: 47204 - DNA, 674 bp, Panicum virgatum
  misc_feature: Ceres CLONE 2034737
  misc_feature: Encodes the peptide sequence at SEQ ID NO. 47205
gagcgaaaccagccgacgccaccgcccccgcctcctccccgtccccctcccaccgcctctccccgatccgcgccgccctcgccgacccggagcccggcggctggtcggcgcgggaatgcgggttccgcgcgcggcgattggttgattcatcgattcggcggtggtggactggtggactggtggtagtcgcgcgccgaggcggcgatgggctgcttcccgtgcttcggcccggggcgcgaggaggggctcgagtactacggcgccaagggcggcggcggcaatggcggtgcggccgggtgggcggccgcgtcctcgtccgccgccgctgctggcgggggcggcgcggaggcggcggcgccgcgcgccgagaggatccccgcaggggcagacaagtcgcgggccaaaggcaatgccggctcgaagaaggagctcgcggttctcaagggcgccaacagcaatgccatctccacgcagaccttcaccttccgccagcttgcagccgcgacgaagaacttcagggatgaatgcttcattggggagggagggttcggccgtgtttacaagggccgcctggacggcacaggccaggttgttgctatcaaacagcttaatagggatggtaatcaaggaaacaaagaattttctagtggaagttctcttgctcagcttgcttc

SEQ ID NO: 47205 - protein, 156 aa, Panicum virgatum
  misc_feature: Ceres CLONE 2034737
  misc_feature: SWISSPROT Homolog: EC 2.7.11.1 Non-specific serine/threonine protein kinase
MGCFPCFGPGREEGLEYYGAKGGGGNGGAAGWAAASSSAAAAGGGGAEAAAPRAERIPAGADKSRAKGNAGSKKELAVLKGANSNAISTQTFTFRQLAAATKNFRDECFIGEGGFGRVYKGRLDGTGQVVAIKQLNRDGNQGNKEFSSGSSLAQLA

SEQ ID NO: 47206 - DNA, 657 bp, Panicum virgatum
  misc_feature: Ceres CLONE 2034745
  misc_feature: Encodes the peptide sequence at SEQ ID NO. 47207
aacctttcctccgtcatcgttcttctccccttcccgcagttcttcttcctcggcgtcgcgtctcctcctccatctcgtaaccctagacaacccatcagatcggggtctcggctcctcttggctcacgagaccagggatttgtctcgcgatcctacgagttccatgacggacgctgaacctgttgatccgaagaattaccttgaggaacgttgcaagccacaatgtgtaaaatcattgtatgattatgagagatgcatgaaaagagttgagaatgatgatagtgggcagaagcactgcaccggccaatatttcgacaactggtcatgtgtcgacaagtgtgttgctccaaagctctttgataagctcaaatgatgatggactgctactttcaatgtgacttctttgccgtagttctcaagctaaataaattgaacatgtaacaaacggtttcattttgctattcaaatggtactagtctttgaataaggcagcaaacacgttctgtgctggtgttcagtttcactttcattactagagaaggtagatggagcaaggtacccagagtgctagccaaacgttttcctggtggtggtggtggatatgagcttcaaaattcaaacttccatcctttattttgacaactgtttccattcaaga

SEQ ID NO: 47207 - protein, 69 aa, Panicum virgatum
  misc_feature: Ceres CLONE 2034745
  misc_feature (7)..(69): Pfam Name: UCR_hinge Pfam Description: Ubiquinol-cytochrome C reductase hinge protein
MTDAEPVDPKNYLEERCKPQCVKSLYDYERCMKRVENDDSGQKHCTGQYFDNWSCVDKCVAPKLFDKLK

SEQ ID NO: 47208 - DNA, 644 bp, Panicum virgatum
  misc_feature: Ceres CLONE 2034771
  misc_feature: Encodes the peptide sequence at SEQ ID NO. 47209
gacaatccttcttgctgccagttcgtcaatatgcatgcaggtgtcatcgaaaaggctgactgtcatgttggaagaattcctgcagatgccaccttgtgattacaagacactgctattaagcatttacattcctcatcagactaccactggtgctttatctggtgatagaactatggataaggcagtaagtacactaggaacttctgtgctatttgagacataccgagcttctccacgccctgttggcaatgcagttgcatatcttaatgctgctttcttggctcaagttgcttcagatggaacttcaaacagcttaatattgagagagctaagtctggcttttggtgcatatggaacccagcatgccatccgggctagcaatgttgagaaactgttagtgggtaaacccattactgcatcggtactgcttgaagcatgtacacttctcaagaaaacaattgttcctaaagaaggcacaagacatgctgcatatagatcaagcttggcagttgcatttctgtttagttttctttacccagtaaccaaagacacattgaagcctcaaaaggccgttcatcttaatggctttgtaccttctggcaccaatggaaatccaatttgtggacccgatgcgcatgtttgat

SEQ ID NO: 47209 - protein, 213 aa, Panicum virgatum
  misc_feature: Ceres CLONE 2034771
  misc_feature (72)..(185): Pfam Name: CO_deh_flav_C Pfam Description: CO dehydrogenase flavoprotein C-terminal domain
  misc_feature: SWISSPROT Homolog: EC 1.2.3.1 Aldehyde oxidase
TILLAASSSICMQVSSKRLTVMLEEFLQMPPCDYKTLLLSIYIPHQTTTGALSGDRTMDKAVSTLGTSVLFETYRASPRPVGNAVAYLNAAFLAQVASDGTSNSLILRELSLAFGAYGTQHAIRASNVEKLLVGKPITASVLLEACTLLKKTIVPKEGTRHAAYRSSLAVAFLFSFLYPVTKDTLKPQKAVHLNGFVPSGTNGNPICGPDAHV

SEQ ID NO: 47210 - DNA, 670 bp, Panicum virgatum
  misc_feature: Ceres CLONE 2034772
  misc_feature: Encodes the peptide sequence at SEQ ID NO. 47211
gagcgaagcgaccgaccagacccagtttccagtttccaccacaccccacctctctgcgctccggtccggcgggcgagttgtcgtgtcgccggcatcgatggcggcggtggtgcgcggcgtcctcaggggcatcaaggagaagggcctcgccaacttcctccgcgacgcccgcgaagaaggatacctgaattgccttctggatgggaaccttttgcaaacaaaaattcacaatattggcgcaacactcgtaggggttgacaagtttggaaacaagtactatgagaaactgcatgacactcagcatggaaggcataggtgggtagaatatgcagagaaagatcgttacaatgcatcccaagtgcctcctgaatggcatggatggctgcatcacatcacagatagcactggtgatcagctgctggcccagaagactgctaggtacctcgtggagcacaagcagaactactccggtgagggcgaggagctgatctaccactccaaggggcacgccctgaacccgggacagagggactggacgaggtaccagccctgggagccaaagaaagagcaagcctagtaaaatgtcgtgtctgatcggggaggaaggaacgccctgtttgtgttttctcgctttcttgccttgggccaggtgttgctgagctgaataatc

SEQ ID NO: 47211 - protein, 159 aa, Panicum virgatum
  misc_feature: Ceres CLONE 2034772
  misc_feature (48)..(154): Pfam Name: NDUFA12 Pfam Description: NADH ubiquinone oxidoreductase subunit NDUFA12
MAAVVRGVLRGIKEKGLANFLRDAREEGYLNCLLDGNLLQTKIHNIGATLVGVDKFGNKYYEKLHDTQHGRHRWVEYAEKDRYNASQVPPEWHGWLHHITDSTGDQLLAQKTARYLVEHKQNYSGEGEELIYHSKGHALNPGQRDWTRYQPWEPKKEQA

SEQ ID NO: 47212 - DNA, 726 bp, Panicum virgatum
  misc_feature: Ceres CLONE 2034782
  misc_feature: Encodes the peptide sequence at SEQ ID NO. 47213
ctcgcgaatgccctagctctcggcgctccctccgctctcccaccccccgcgagatatcgccgtcgcggtcgaccaagccctcggagcgcgagagatggcggatcaggagaccccagttgccgttgaggcacctacccccgttctcggagagccgatggacttgatgactgctctgcagctcgtcatgaagaagtcaagtgctcatgatgggcttgtcaagggtcttcgtgaggcggccaaggccattgagaagcatgctgctcagctttgcgtgcttgctgaggactgtgagcggcctgattatgttaagctggtgaaggcactctgtgctgagcacgatgttcacctggttactgtgcctagcgctaaaactcttggcgagtgggctgggctttgcaagattgactctgagggcaaggcagggaaggttgtgggctgctcctgtgttgtcgtcaaggactacggtgaagaatctgagggccttaacatagtccaggagtatgtcaaatcacactaaatgcagtgtggttcagtatctggaacaagttctacattttgaacctgagtttaaaatttatgcttggttgtatggtgcttgctaggggactagaacaattttcaagtgtgagcctaggagatgtgaacaattaatggagtctgaactcttgtttagagtgctgcgttacctgctgtcaatgagaatcatgaaaatctgagtttctgctg

SEQ ID NO: 47213 - protein, 140 aa, Panicum virgatum
  misc_feature: Ceres CLONE 2034782
  misc_feature (25)..(120): Pfam Name: Ribosomal_L7Ae Pfam Description: Ribosomal protein L7Ae/L30e/S12e/Gadd45 family
MADQETPVAVEAPTPVLGEPMDLMTALQLVMKKSSAHDGLVKGLREAAKAIEKHAAQLCVLAEDCERPDYVKLVKALCAEHDVHLVTVPSAKTLGEWAGLCKIDSEGKAGKVVGCSCVVVKDYGEESEGLNIVQEYVKSH

SEQ ID NO: 47214 - DNA, 695 bp, Panicum virgatum
  misc_feature: Ceres CLONE 2034805
  misc_feature: Encodes the peptide sequence at SEQ ID NO. 47215
aacaacaaaccaagtgcagaccaccacaaaagctccacctccctgccgaagaatgaatattcataggctctcctgcccatgtacatggaagatctccgtgctctctattctcacatacatcctcttggtcacacccagctctctatctaatagttatagtgatttcttggctctcttgtctctcaaatcccacataaccagtgatccacgacaggcactctcctcgtgggatggtgttcgcaatgacaccaatacaccagttcctgatttctgccaatggaatggagtgacctgtggcggtcgtcgctacccaggccacgttactgccatacatcttcaagactatggcctagcaggcatcatctctcaagatattggcaacctcacatacctccacttccttgatctatcgtcaaacaacctggtaggtgatattccatcaactcttggcaactgtagaaaactttatacaatgaatttgggcgctaatcacttctctggtttggtcccgtctccgctgggtcacctgtcaaagctcaaaatttttgatgtcagccacaatagtctgactggtgaaattcccacaacactattaaacatcacaatgctaacgatccttagaatcgggggggactccttccatggacaaattcttagctggctgagcaacctaacatcattgactgacttgtttc

SEQ ID NO: 47215 - protein, 214 aa, Panicum virgatum
  misc_feature: Ceres CLONE 2034805
  misc_feature (34)..(82): Pfam Name: LRRNT_2 Pfam Description: Leucine rich repeat N-terminal domain
  misc_feature: SWISSPROT Homolog: EC 2.7.11.1 Non-specific serine/threonine protein kinase
MNIHRLSCPCTWKISVLSILTYILLVTPSSLSNSYSDFLALLSLKSHITSDPRQALSSWDGVRNDTNTPVPDFCQWNGVTCGGRRYPGHVTAIHLQDYGLAGIISQDIGNLTYLHFLDLSSNNLVGDIPSTLGNCRKLYTMNLGANHFSGLVPSPLGHLSKLKIFDVSHNSLTGEIPTTLLNITMLTILRIGGDSFHGQILSWLSNLTSLTDLF

SEQ ID NO: 47216 - DNA, 730 bp, Panicum virgatum
  misc_feature: Ceres CLONE 2034808
  misc_feature: Encodes the peptide sequence at SEQ ID NO. 47217
aagagccgccagttcgacaaaccccggccccgcagcaaggatttctgcgccgaatcccttcgggacccaatgggagaggcctcgccgtcgatcgccagggatgtcaccgagttgatcgggaacacgccgctggcgtacctcaacaaggtgacagatgggtgcgtcggccgcgtcgccgccaagctcgagtccatggagccctgctccagcgtcaaggataggattggctacagcatgatcactgacgcagaggagaagggcctgatcactccaggcacggtgggtgaatgaacctttccgagcatttcctttgttgtttgaaggaaaataacttgtgtcttgatttcaagtgtccgctgccttagttcagacatatatgttcaattggaatattaagtcttatatttccatcaaatccagaagcatgtgcttgctgccatttttcgttttagaggatctagtctgcataagaaaattatctaatgtgctggtctgcatgttccatatctggtggttatttttgtggagttgactacagaattaatttattctacattcttttgtgcctagtagtaccttactagtggagcagatgcttcagttagaagtatttgcttctgatctgtccatatggtgaagtcacaataaataaattggtgtgactagtcttcaaacgttacatagtgtagtgtgtacatcattaacatagttctttgatcagtatctattt

SEQ ID NO: 47217 - protein, 73 aa, Panicum virgatum
  misc_feature: Ceres CLONE 2034808
  misc_feature: SWISSPROT Homolog: EC 2.5.1.47 Cysteine synthase
  misc_feature: Functional homolog of the protein sequence given in SEQ ID NO 51108
  misc_feature: Useful for making plants with modulated cold sensitivity
MGEASPSIARDVTELIGNTPLAYLNKVTDGCVGRVAAKLESMEPCSSVKDRIGYSMITDAEEKGLITPGTVGE

SEQ ID NO: 47218 - DNA, 718 bp, Panicum virgatum
  misc_feature: Ceres CLONE 2034826
  misc_feature: Encodes the peptide sequence at SEQ ID NO. 47219
aaatggacaacctggttccattcatctcccaaggctatgcttgctctatcctggttccattcatctcccaaggctatgcttgctctatataattttgacgaagtgttattttccctttgtgcagtctactcgctatcgctgaggagaccttggcagagttcatgtccaaggcgactggcactgccgtcaactgggtgcaaatggttgggatgaagcctggtccggattccattggaatcatcgctgtttcacacaactgcagtggcgtagcagcacgagcttgcggccttgtgagccttgagcccacaaaggttgcggagatccttaaggatcgcccatcgtggtatcgcgattgtcggcatgttgaaatcgtccatgttgtacctacgggtaatggtggaacgattgagctcatctatatgcagacatatgccctgacaactctgatgggaccgcgcgacttttggacgctccgatacaccagtggtcttgacgatggcagtcttgtgatctgtgaaaggtcattgactcagtccactggaggtccttgtggacctaatgctccgacatttatcagagctgaggtcctacctagtggttatcttattcgaccatgcgatgggggaggctccatgatttacattgtggatcatgttgatctgaatgctaagagtgtgcctgaggttcttcgaccactctatgaaatcactaagatact

SEQ ID NO: 47219 - protein, 185 aa, Panicum virgatum
  misc_feature: Ceres CLONE 2034826
  misc_feature (1)..(185): Pfam Name: START Pfam Description: START domain
  misc_feature: Functional homolog of the protein sequence given in SEQ ID NO 50330
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
MSKATGTAVNWVQMVGMKPGPDSIGIIAVSHNCSGVAARACGLVSLEPTKVAEILKDRPSWYRDCRHVEIVHVVPTGNGGTIELIYMQTYALTTLMGPRDFWTLRYTSGLDDGSLVICERSLTQSTGGPCGPNAPTFIRAEVLPSGYLIRPCDGGGSMIYIVDHVDLNAKSVPEVLRPLYEITKI

SEQ ID NO: 47220 - DNA, 723 bp, Panicum virgatum
  misc_feature: Ceres CLONE 2034828
  misc_feature: Encodes the peptide sequence at SEQ ID NO. 47221
cttagctaccttgcatccccgcccgtccgcccccttcccccaattcgccgacccgccgctcctgaatcccatccaaattcttccgcatcttttcaaagatcgggttttgggaggggcacggcccccagatcggggagaaatccccgttccgtctggtgggtcggcctccgctgcccgtttcttggctattttccccttctcaagggcggctcttggatgggctgcctgccgtgcttcgggtcggctggtgagggggcagccaagaagggcggcgcgcgcaaggacggctcgtcggatcgccgcgtcacccgcgtcggatcagataaatcaaagccacagggtggatcagactctaagaaggatgcagttatcctaagggatgggaacaatcaacatattgcagcacacactttcacttttcgtgaacttgctgctgccactaagaacttcagacaagattgcttattgggggaaggaggttttggtcgtgtttataaaggacgtttggagaatgggcaggttgttgcagtgaagcaacttgatcgcaatggccttcaaggaaatagggagtttcttgttgaagttctaatgctgagcctattgcaccatgacaacctggtgaacctaattggatattgtgctgacggagaccaacgtcttcttgtatacgagtttatgccattgggatcacttgaggatcatttgcacgatattccacctgat

SEQ ID NO: 47221 - protein, 168 aa, Panicum virgatum
  misc_feature: Ceres CLONE 2034828
  misc_feature (78)..(168): Pfam Name: Pkinase_Tyr Pfam Description: Protein tyrosine kinase
  misc_feature: SWISSPROT Homolog: EC 2.7.11.1 Non-specific serine/threonine protein kinase
MGCLPCFGSAGEGAAKKGGARKDGSSDRRVTRVGSDKSKPQGGSDSKKDAVILRDGNNQHIAAHTFTFRELAAATKNFRQDCLLGEGGFGRVYKGRLENGQVVAVKQLDRNGLQGNREFLVEVLMLSLLHHDNLVNLIGYCADGDQRLLVYEFMPLGSLEDHLHDIPP

SEQ ID NO: 47222 - DNA, 669 bp, Panicum virgatum
  misc_feature: Ceres CLONE 2034847
  misc_feature: Encodes the peptide sequence at SEQ ID NO. 47223
ctcgtcgtcctctcccgcttccctccaaactcgaacagcactcaacccgacgattccttgcaagaagcaaattccagcctgatttcagcgcaggaaccttggcgggtcgaagcagaaccaaatcgaatccgcgccgcgcgccgcaatgggaatccgcctgcgttatatcctcgtcgcctcgctcgtcctctgttctatcgccgggctcgcggccaaaaccgtagacccttacaaggttcttggagttgacaagaatgcaagccaacgggatattcagaaagcttttcacaagctctctctaaaatatcaccctgacaagaataaaggcaagggtgcacaggagaaatttgaagagataaacaacgcgtatgagattctgtctgatgaagagaagaggaaaaactatgatctctacggggatgagaagggtaacccgggatttgatggtggaaattttgggaatcgtgagggttacacatacttcactggcggtggtcccaaaaacagctatttcacatctggtgatggatggcagacaatgggtggtggtccgggaaattcaaaaacattttccttttcatttggtggtaacccaggtgccagtggtggaagcccatttggatttgatcttggtgatgttttctccaacttttttggtggtggatcaat

SEQ ID NO: 47223 - protein, 174 aa, Panicum virgatum
  misc_feature: Ceres CLONE 2034847
  misc_feature (27)..(88): Pfam Name: DnaJ Pfam Description: DnaJ domain
MGIRLRYILVASLVLCSIAGLAAKTVDPYKVLGVDKNASQRDIQKAFHKLSLKYHPDKNKGKGAQEKFEEINNAYEILSDEEKRKNYDLYGDEKGNPGFDGGNFGNREGYTYFTGGGPKNSYFTSGDGWQTMGGGPGNSKTFSFSFGGNPGASGGSPFGFDLGDVFSNFFGGGS

SEQ ID NO: 47224 - DNA, 724 bp, Panicum virgatum
  misc_feature: Ceres CLONE 2034851
  misc_feature: Encodes the peptide sequence at SEQ ID NO. 47225
gtcccgcccagtgccagccgccgcggccagtgccagccagcctcccccgtgcgctagctgtgcgcgggctcgctcgccgctccgccgcccggtaaccggtctatatataggtggttcgtggtgatcagagccacacaggcaagatggcgacctttcacaagatcacccttgttctcatattctgcctggtaaccttggggagatcagagtatctcaagtacaaggatccgaagcagcctgttgctgttcgtgtcaaggatctgcttagtcggatgactcttgctgaaaagattggccagatgacccaaattgagctgaaaaatgccacagccgatgtattggctaagttcttcataggcagtgtacttagtggtggaggcactgtgcctgctcctcaagcatctgctcaggcttgggcctccacggtgactgagctgcaaaagggcgctctttccacccgccttggcattccgttcatctatggtatagatgctgtgcatggtcacaacaatgcctacaaagctactatcttcccccacaacgttggtcttggagctactagggaccctgatcttgtcaagagaataggagaagcaacagctcttgaagttagagctactggaattcaatatgtctttgctccctgtattgcggtttgtagagatccaagatggggacgctgctacgagagctacagtgaggacccgaagattgtcagtctatg

SEQ ID NO: 47225 - protein, 193 aa, Panicum virgatum
  misc_feature: Ceres CLONE 2034851
  misc_feature (101)..(193): Pfam Name: Glyco_hydro_3 Pfam Description: Glycosyl hydrolase family 3 N terminal domain
  misc_feature: SWISSPROT Homolog: EC 3.2.1.21 Beta-glucosidase
MATFHKITLVLIFCLVTLGRSEYLKYKDPKQPVAVRVKDLLSRMTLAEKIGQMTQIELKNATADVLAKFFIGSVLSGGGTVPAPQASAQAWASTVTELQKGALSTRLGIPFIYGIDAVHGHNNAYKATIFPHNVGLGATRDPDLVKRIGEATALEVRATGIQYVFAPCIAVCRDPRWGRCYESYSEDPKIVSL

SEQ ID NO: 47226 - DNA, 623 bp, Panicum virgatum
  misc_feature: Ceres CLONE 2034880
  misc_feature: Encodes the peptide sequence at SEQ ID NO. 47227
ggtggaggagggagcggcggcggagggagcggcggagggagcggcggcacaggcggcgggacaggaagcggtcggtgccccatcgacgtcctgaagctgggcgtgtgcgccaacgtgctgagcgggctgatcaacgtgaccctggggacgccgtcgcagacgccgtgctgcacgctgatccaggggctcgcggacctggaggcggcggtgtgcctctgcacggcgctgcgtgccaacgtgctgggcatcaccctcaacctgcccatcaacctcagcctcctcgtcaactactgcggcaggcgcgtcccctcgggcttccagtgcgcctagcgccctagcctacctagctagctcatggatggatccgatcttgcctgcagatcgacaagcctagctagctagcacctgatactactcgatcctaatacatacgtaccatgcgtaccatgctatgcatgcacatgtgtgtgtgtgtgttcaataattcaacaagctatgtatctatctcatcatcatctatagctactgtaatttgtgagtaagaatgtgtgtgtgtgtgtgttcttttactgtataatccattcatccatatcacatagtatgcatgtatgcagtgtttaatt

SEQ ID NO: 47227 - protein, 109 aa, Panicum virgatum
  misc_feature: Ceres CLONE 2034880
  misc_feature (26)..(108): Pfam Name: Tryp_alpha_amyl Pfam Description: Protease inhibitor/seed storage/LTP family
  misc_feature: Functional homolog of the protein sequence given in SEQ ID NO 50172
  misc_feature: Useful for making plants with modulated biomass
  misc_feature: Useful for making plants with modulated flowering time
  misc_feature: Functional homolog of the protein sequence given in SEQ ID NO 50545
  misc_feature: Useful for making plants with modulated oxidative stress sensitivity
GGGGSGGGGSGGGSGGTGGGTGSGRCPIDVLKLGVCANVLSGLINVTLGTPSQTPCCTLIQGLADLEAAVCLCTALRANVLGITLNLPINLSLLVNYCGRRVPSGFQCA

SEQ ID NO: 47228 - DNA, 316 bp, Panicum virgatum
  misc_feature: Ceres CLONE 2034882
  misc_feature: Encodes the peptide sequence at SEQ ID NO. 47229
ctgcaccacgactacgtcgctgcacttctgcaagacgggtactacctggaggccctgcgctacgccagaaaatacaaggttattaccgtgcagcccgctctgttcctggagaaagccgtggcgagcaacagcgcccagaacctggccacagtgctgagcttcttctgcgagttcacgccgagtttcaagaccacgtcggacttcggcagataccggcacattctatccgaaatggtttgagcggctgtgttgtacaatcttcttgcgcccaaatgacttcagcccgttatatataatagttaacattactggggag

SEQ ID NO: 47229 - protein, 79 aa, Panicum virgatum
  misc_feature: Ceres CLONE 2034882
  misc_feature (1)..(66): Pfam Name: Mic1 Pfam Description: Colon cancer-associated protein Mic1-like
LHHDYVAALLQDGYYLEALRYARKYKVITVQPALFLEKAVASNSAQNLATVLSFFCEFTPSFKTTSDFGRYRHILSEMV

SEQ ID NO: 47230 - DNA, 684 bp, Panicum virgatum
  misc_feature: Ceres CLONE 2034905
  misc_feature: Encodes the peptide sequence at SEQ ID NO. 47231
aaaaaaaaaaactcttccgacaccaccagcagcagcagctgggcgtcgacgggccccgggtcggcaagccggtgcggcggcggtcccgcgcgtcgcggcgcgcgcccgtgacgctgctgaacacggacgcggccaacttccgcgccatggtgcagcagttcacgggcatccccgcgccccccgccggcgcgttcggggccccggtcatcagcttcgcgggcgactacggcttcccgccgccctcgggcgtcatgtccttcgaccacctccaccggagccacgcccccgcgccggcgccgctccaggaccagctgatccgcacgcagccgcagtacaccggcggggccttcggctacagcaacagcagcctcctgcacggcggcggcggcgacctgttcgcctcctcccacgggctcgcgtcggcggccgaggaccggatgctcctgcagagcatccagcaggcgacgacggcccaccaccacatgccgccgccggcgtccgccgctaacgccaccgctaatggcttcttcgcctgagcaagcaaaccgatcgagatgccggagagctgaagtgaaggatcaacatgaaaattaaaaaaaaaaagttcagtcaggatcgatcaagtttcttcttggcatgtgatgcttagtttcctcctccgcttgttcaaatagttcttcatgc

SEQ ID NO: 47231 - protein, 177 aa, Panicum virgatum
  misc_feature: Ceres CLONE 2034905
  misc_feature (32)..(62): Pfam Name: VQ Pfam Description: VQ motif
KKKLFRHHQQQQLGVDGPRVGKPVRRRSRASRRAPVTLLNTDAANFRAMVQQFTGIPAPPAGAFGAPVISFAGDYGFPPPSGVMSFDHLHRSHAPAPAPLQDQLIRTQPQYTGGAFGYSNSSLLHGGGGDLFASSHGLASAAEDRMLLQSIQQATTAHHHMPPPASAANATANGFFA

SEQ ID NO: 47232 - DNA, 722 bp, Panicum virgatum
  misc_feature: Ceres CLONE 2034921
  misc_feature: Encodes the peptide sequence at SEQ ID NO. 47233
aaggtcagcccaaaaaggagcggcgtcgtcttcttcaccgccggcggcggtcgagccgcacctcccgagtcctaaacgcctctagcccgagcaggcacctcgaactcctcctccctcattgccctcgttattctcctcctccaaaccccatctgctggtgctttgtgagcgtgcgtgcggtggagatccatacggacttcaaggaaggcaaacaaggattttgggaaagcccagtttctcgaaaatgaacaagggcaagattttcaagttagcaaagggatttaggggaagggcgaaaaattgcataaggatagcaagggagagggttgagaaagccttgcaatattcctacagggacaggcggaacaagaagagggatatgagatctctttggattgagcgcattaatgctggtacacgattacatggggtgaactatggcaactttatgcatggattagtgaaggaaaacatccaactcaacaggaaggtgctctcagagctgtcaatgcatgaaccttacagcttcaaagcacttgttgatgtttctcgcacgtcatttccagggaacagcactgccaaaaaggagggtttagcagctatactttgaaacagtttgtcgaataagtctctaaacttgtgatattctttccatcctcgcagttgaaacctactactcctattgaatgttagattgtatacctcagtgactcatgtaattt

SEQ ID NO: 47233 - protein, 121 aa, Panicum virgatum
  misc_feature: Ceres CLONE 2034921
  misc_feature (5)..(98): Pfam Name: Ribosomal_L20 Pfam Description: Ribosomal protein L20
MNKGKIFKLAKGFRGRAKNCIRIARERVEKALQYSYRDRRNKKRDMRSLWIERINAGTRLHGVNYGNFMHGLVKENIQLNRKVLSELSMHEPYSFKALVDVSRTSFPGNSTAKKEGLAAIL

SEQ ID NO: 47234 - DNA, 717 bp, Panicum virgatum
  misc_feature: Ceres CLONE 2034945
  misc_feature: Encodes the peptide sequence at SEQ ID NO. 47235
tacagaagaatttgttttcaaatattatgaaagaagaagagttttggacacataccgatagagcaatcaccaaagcttacgagaaaacagaccaagctattttgtcgcatactccagatttgggacaaggtggctccactgccgtaactgccattcttgtaaatggcaggaagttatgggtagctaatgttggggattcaagagctgttcttttgaaaggtggtgagcccatacagatgtcagtagaccatgatccgaatgttgagcgcagcgtaattgaaaataggggtggctttgtttcaaacatgccaggagatgttcctcgggtatgtggtcagttggctgtctcccgagcttttggagacaggaatctaaaatcactattgagatcagagcccgatataaaagtcgaagacatagatcacactgcggagctacttgtcctcgcgagcgatggcctttggaaggtgatgaacaatcatgaggttgtcgatttggccaaaaggtacaaggatccatatgcagctgccaggcaattaaccgccgaagcgttaaaaagagagagtaaagatgacatatcatgcattgttgttcggttcaaggcgtaaatggatcacagactcacggaggattccatggagagcagaaaactagtaagttaggctgcctgacaacatattggtaatcaaatggatgaataatcgcagggggcattgg

SEQ ID NO: 47235 - protein, 201 aa, Panicum virgatum
  misc_feature: Ceres CLONE 2034945
  misc_feature (1)..(192): Pfam Name: PP2C Pfam Description: Protein phosphatase 2C
  misc_feature: SWISSPROT Homolog: EC 3.1.3.16 Phosphoprotein phosphatase
QKNLFSNIMKEEEFWTHTDRAITKAYEKTDQAILSHTPDLGQGGSTAVTAILVNGRKLWVANVGDSRAVLLKGGEPIQMSVDHDPNVERSVIENRGGFVSNMPGDVPRVCGQLAVSRAFGDRNLKSLLRSEPDIKVEDIDHTAELLVLASDGLWKVMNNHEVVDLAKRYKDPYAAARQLTAEALKRESKDDISCIVVRFKA

SEQ ID NO: 47236 - DNA, 742 bp, Panicum virgatum
  misc_feature: Ceres CLONE 2034949
  misc_feature: Encodes the peptide sequence at SEQ ID NO. 47237
gaagtttccagacacgagccgactaatcgaagcgctcctccagtcctcctccccctccccctccccctcgagctgccgactgatccgtcctcgtttgcgatcaatatgagaaggggctacagttacagtccttcaccaccaaggggttacgggagaagggctcgcagcccaagcccccgtgatcattatggtggccgtggtagagatctcccaaccagtcttttggtcaggaatctccgtcgggactgcaggccagaagaccttcgtcgcccattcggacagtttgggcgacttaaagatatatatctaccaagagattattacactggggagccccgaggatttggttttgtccagtattatgatccagaagatgctgctgatgcaaagtactacatggatgggcagctggttcttggcaggcaaataactgttgtatttgcagaggagaataggaagaagcctcaagagatgagagttagggacagagtcagaggtcgttcttatgatcggaggtactctcgctctaggtcccctctttattccaggggccgttctccttcccgcagctactcaaggtctccttcacctccgaatcccaaacacagactcagggagaggtcgtactcccgctcgcctgttgacagcagatcaagaagcgggagcccctatgaggagcaataccgcagatcctcccgaagagagaggtctctctgtgttgccggatgaagtagtgttagtg

SEQ ID NO: 47237 - protein, 207 aa, Panicum virgatum
  misc_feature: Ceres CLONE 2034949
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50855
  misc_feature: Useful for making plants with altered terpenoid content
MRRGYSYSPSPPRGYGRRARSPSPRDHYGGRGRDLPTSLLVRNLRRDCRPEDLRRPFGQFGRLKDIYLPRDYYTGEPRGFGFVQYYDPEDAADAKYYMDGQLVLGRQITVVFAEENRKKPQEMRVRDRVRGRSYDRRYSRSRSPLYSRGRSPSRSYSRSPSPPNPKHRLRERSYSRSPVDSRSRSGSPYEEQYRRSSRRERSLCVAG

SEQ ID NO: 47238 - DNA, 662 bp, Panicum virgatum
  misc_feature: Ceres CLONE 2034963
  misc_feature: Encodes the peptide sequence at SEQ ID NO. 47239
taacgctttacttagcaatttccctcgtctaagggtcactgaacctgctacattatgcattcctcatcttgtaacgtcccttaaaactggttctgaggcaactcaagaagcagcactggattcactatatcttctcaggcaagcttggtcagcttgcccagctgaagtattcaaagctcagtctgtggctgcctctgaggctattcctttacttcagtacttgatacagtctggcccaccccggtttcaagaaaaagcagaactgcttcttcagtgcttgcccgggacacttacagttaccataaagcgcggcaacaatctaagacaatcagttggaaatcctagtgcattctgcaagcttactcttggaaataatacgccgaggctgacaaagattgtatccactggcgcaactcctgaatgggatgaagcctttgcatgggcctttgacagccctcccaaaggccagaaactccatatctcctgcaaaaacaacagcaaatttggaaagaaatcatttgggaaagtgacgatccaaatcgaccgggttgtgatgctgggctcagtcgcgggcgagtacaccttgctacccgagagcaaaagcggtcccaatagaaacctggaaatcgagttccagtggtcaaacaaataactgtatacgg

SEQ ID NO: 47239 - protein, 216 aa, Panicum virgatum
  misc_feature: Ceres CLONE 2034963
  misc_feature (97)..(177): Pfam Name: C2 Pfam Description: C2 domain
  misc_feature: Functional homolog of the protein sequence given in SEQ ID NO 51074
  misc_feature: Useful for making plants with altered cell wall content and/or composition
NALLSNFPRLRVTEPATLCIPHLVTSLKTGSEATQEAALDSLYLLRQAWSACPAEVFKAQSVAASEAIPLLQYLIQSGPPRFQEKAELLLQCLPGTLTVTIKRGNNLRQSVGNPSAFCKLTLGNNTPRLTKIVSTGATPEWDEAFAWAFDSPPKGQKLHISCKNNSKFGKKSFGKVTIQIDRVVMLGSVAGEYTLLPESKSGPNRNLEIEFQWSNK

SEQ ID NO: 47240 - DNA, 695 bp, Panicum virgatum
  misc_feature: Ceres CLONE 2034966
  misc_feature: Encodes the peptide sequence at SEQ ID NO. 47241
aaccctgatctcctcccaatctctcgcaaaccctagccaaatcccagatccggcttagctccgacgcgcagcgatggggaacccggagaagctgatgaaccagatcttcgacctcaagttcacgtccaagtcgctgcagcggcaggcgcgcaagtgcgagaaggaggagaaggagcagaagctcaaggtgaagaaggcgatcgagaagggcaacatggacggcgcccgcatctacgctgagaacgccatccgcaagcgcaccgagcacatgaactacctccgcctcgcctcccgcctcgacgccgtcgtagcccgcctcgatacgcaggccaagatgcaggtcatcggcaggtccatgcagtccatcgtcaagtcgctcgactcagcgctcaacaccggaaacctccagaagatgtccgagaccatggaccagtttgagcgccagttcgtcaacatggaggtgcaggccgagttcatggagggcgccatggcggggtccacctccctctccacgcccgagaccgaggtcaacagcctcatgcagcaggtcgcagacgactacggcctagaggtctctgtcggcctgccgcaggctgccgcgcatgccatccctgctgcaaaagataaggagaaggttgatgaggacgacctctctcgccgcctcgccgagctcaaggctcgcggctgagcgcttt

SEQ ID NO: 47241 - protein, 204 aa, Panicum virgatum
  misc_feature: Ceres CLONE 2034966
  misc_feature (9)..(179): Pfam Name: Snf7 Pfam Description: Snf7
MGNPEKLMNQIFDLKFTSKSLQRQARKCEKEEKEQKLKVKKAIEKGNMDGARIYAENAIRKRTEHMNYLRLASRLDAVVARLDTQAKMQVIGRSMQSIVKSLDSALNTGNLQKMSETMDQFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 47242 - DNA, 718 bp, Panicum virgatum
  misc_feature: Ceres CLONE 2034976
  misc_feature: Encodes the peptide sequence at SEQ ID NO. 47243
ggcgacacgacgttcttcgcgagccactgaaaaagcttctgtttctttctcgaccctctcttctagtgttcttgatcttcagaaccatcacgagcaacctcgcccgtccttcctaagcttggttgcagcggcagtgtgtaatggcgccgggggagaagaagatcctggtggcgaggaagggccggctgcggcagcgctacgacggcgaacaccgcctcgtggccgggtgcgtgccgtaccgcgtcggcgccgacggccaccccgagctgctcatggtctccacgcccaacagggacgacctcgtcttccccaagggcgggtgggaggacgacgaggacgtgcacgaggcggcctgccgcgaggcgctggaggaggccgggatcaagggcgccatcaacagaaccgcgctggggatgtgggtgttcaggagcaagagcagcccggtgagcggcgacagcccccggggcgcctgcaagggctacatcttcgcgctggaggtcgccgaggagctcgagcaatggccggagcaggacacgcacggcaggcggtgggtctcaccggcggacgcgtaccgcctgtgccggtacgactggatgcgcgaggcgctgtcggcgctgctggagcggctggcggaggcgaagcccgccgcgccgggagctgatgaccacagcggcgtgtacatgatggtgaaggcggccgctgccaccgccgaccgagc

SEQ ID NO: 47243 - protein, 192 aa, Panicum virgatum
  misc_feature: Ceres CLONE 2034976
  misc_feature (24)..(162): Pfam Name: NUDIX Pfam Description: NUDIX domain
  misc_feature: SWISSPROT Homolog: EC 3.6.1.52 Diphosphoinositol-polyphosphate diphosphatase
MAPGEKKILVARKGRLRQRYDGEHRLVAGCVPYRVGADGHPELLMVSTPNRDDLVFPKGGWEDDEDVHEAACREALEEAGIKGAINRTALGMWVFRSKSSPVSGDSPRGACKGYIFALEVAEELEQWPEQDTHGRRWVSPADAYRLCRYDWMREALSALLERLAEAKPAAPGADDHSGVYMMVKAAAATADR

SEQ ID NO: 47244 - DNA, 753 bp, Panicum virgatum
  misc_feature: Ceres CLONE 2034987
  misc_feature: Encodes the peptide sequence at SEQ ID NO. 47245
ccaaagaggaacgcccaacacacagagataacaaagccttcttcttacagcgcacttgcaatccacagacagagctcagctcatccaagcacacagagcaccagcaatgtcgctcgtcaggcgcagcaacgtgttcgaccccttctccatggacctctgggaccccttcgacagcatgttccgctccgtcgtcccgtcgtcgtcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaacgtgctggtcatcagcggccagcgcagcaaggagaaggaggacaagaacgacaggtggcaccgcgtggagcgcagcagcggccagttcatgaggcgcttccgcctgcctgaggacgccaaggtggagcaggtcaaggccgggctggagaacggcgtgctcaccgtcaccgtgcccaaggccgagggcaagaagcccgaggtgaagagcatccagatctccggttaggcgaccgtggggacggacggtgaggtggtgagcgtgtgcggcggaggaactgccggttcgagctactagtctcgttgctctgctttggtgtgtttggtttgtactgttcagtcctttcagcctgcagactgtgtcatgtactcctactactctgtgctagcatctttcctgtttggtgagatcgggtg

SEQ ID NO: 47245 - protein, 152 aa, Panicum virgatum
  misc_feature: Ceres CLONE 2034987
  misc_feature (48)..(151): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFSMDLWDPFDSMFRSVVPSSSSSDSDTAAFANARIDWKETPEAHVFKADLPGVKKEEVKVEVEDGNVLVISGQRSKEKEDKNDRWHRVERSSGQFMRRFRLPEDAKVEQVKAGLENGVLTVTVPKAEGKKPEVKSIQISG

SEQ ID NO: 47246 - DNA, 508 bp, Panicum virgatum
  misc_feature: Ceres CLONE 2035000
  misc_feature: Encodes the peptide sequence at SEQ ID NO. 47247
cttgaaaagctaggttcacctttgtcatgggagcacattactaatcagattggaatgttctgctacagcgggatgacaccggaacaagttgaccggttgacaaatgaattccatatttacatgacccgcaacgggaggataagcatggctggtgtaactacaggaaacgttgaatacttggcaaatgctattcacgaggttaccaaatcgaaatgaggttggccctctgtcggcgatgaaatgaggctttcaagtggctttttttggtgcctgcatcaacattatcattctcgagaaataagttaagcctatttgggctgtccaagggcgaatttcacatggacgagaactatagatgtgaaacttcagtcttgagacctacattaatcctgtttcttttcttttttctttcttttttccccaagcttatcatggcaatttttacacttagccgcaaatcgttgtggcatgatctacagttctgaagaaaataaatatagcgaaattg

SEQ ID NO: 47247 - protein, 71 aa, Panicum virgatum
  misc_feature: Ceres CLONE 2035000
  misc_feature: SWISSPROT Homolog: EC 2.6.1.1 Aspartate transaminase
  misc_feature: Functional homolog of the protein sequence given in SEQ ID NO 50594
  misc_feature: Useful for making plants with modulated nitrogen use efficiency
LEKLGSPLSWEHITNQIGMFCYSGMTPEQVDRLTNEFHIYMTRNGRISMAGVTTGNVEYLANAIHEVTKSK

SEQ ID NO: 47248 - DNA, 754 bp, Panicum virgatum
  misc_feature: Ceres CLONE 2035015
  misc_feature: Encodes the peptide sequence at SEQ ID NO. 47249
gttgttccaaactcagagaaaggcaagcaggcagggatggagctcaccaacatcccctatcttgcatcatcttcctcctccagcttcttctactccagctgcagtcgctgtacctgcaggtgatgctagcaacttcgctcatttcttatgcaaatgattcagttatgtgtgcgtggaagcaaatgacttgagaaatcatgacttgcaggggcaaaagggctgggaacctggtaataacagcttctgcagctggtggtaggtgtgctgctgatttggcatgttcacagcttgtcgagcaggaaaatgaagatgccctttcaggtcctagatcttcctggcattatagaaggagagagtttgcttctgccattttgctcccttttctgcttcctcatgttgacgtctcaagtgcagctgagacatacaatgaatcaatcattcgaagtggcgtgaggaatgttttaaccaagggcaaggctgctggcgtgcttcgtttggttttccatgatgcagggacttttgatgttagtgacaaatcaggtggcatgaatggctctataatatatgaagttgacagacctgaaaatactgggctaaatagatccataaagatattaggaaaagcaaaagcaggaatcgatgatattcagaaagtgtcatgggcggacttgatcgctgtggctggtgctgaggcagttgcactctgtggtgggcctgaaatccagtaaggctaggacgattagattccagtact

SEQ ID NO: 47249 - protein, 176 aa, Panicum virgatum
  misc_feature: Ceres CLONE 2035015
  misc_feature: SWISSPROT Homolog: EC 1.11.1.11 L-ascorbate peroxidase
MTCRGKRAGNLVITASAAGGRCAADLACSQLVEQENEDALSGPRSSWHYRRREFASAILLPFLLPHVDVSSAAETYNESIIRSGVRNVLTKGKAAGVLRLVFHDAGTFDVSDKSGGMNGSIIYEVDRPENTGLNRSIKILGKAKAGIDDIQKVSWADLIAVAGAEAVALCGGPEIQ

SEQ ID NO: 47250 - DNA, 738 bp, Panicum virgatum
  misc_feature: Ceres CLONE 2035029
  misc_feature: Encodes the peptide sequence at SEQ ID NO. 47251
aagactcggactctctcctccctttgctcttccttccctggcggcgacgactgggtgagcggcggcgctatctgtcctgtcttcgcccagccctttgccggcgacgagcgcatcctccttctccagatctgagacatgcctaagataaagacaagccgtgtgaaatatccagaaggatgggagcttattgaaccaacacttcgtgatttggaggccaaaatgagggaagctgaaaatgatccacatgatgggaagaggaagtgtgaagctttatggcccatcttccgtatttctcatcagaagagtcgctacatatatgatctttactatcgaaggaaggaaatatccaaagagctatatgagttttgcttggaccaaggctacgcagatcgcaatctgattgcgaagtggaaaaagccaggttatgagcgcctctgctgcctccgctgcatacaaacacgagaccacaactttgcaaccacctgcgtctgcagggtccccaagcatctcagggaggagaaagtgatagaatgcgtccactgcggatgcagggggtgtgccagcggcgattaaagcctcaatctcgtggttggaaaataatctcaaaactaatcacgctagatgtctcgttatacttggacgagcctcctatgggaacttaaaaacaaacaccttatgagcatgaccaggtgattacaacttgcgcaatggtacgggtgtggagatgtgccactgcca

SEQ ID NO: 47251 - protein, 145 aa, Panicum virgatum; identical to SEQ ID NO: 34283
  misc_feature: Ceres CLONE 2035029
  misc_feature (1)..(143): Pfam Name: G10 Pfam Description: G10 protein

SEQ ID NO: 47252 - DNA, 764 bp, Panicum virgatum
  misc_feature: Ceres CLONE 2035031
  misc_feature: Encodes the peptide sequence at SEQ ID NO. 47253
acgcgagcaaccgattcaaatgtttcctccgccccatccgcttcctcgcgggctcctcggctgcgcggtctcaagatgatcggctccctcattaccggagctctaacccttgttcttggatatgcataccctgcctatgactgctacaagacagtggagctaaacaggcccgaggttgagcagctacggttctggtgtcagtactggattttacttgcagttctcactgtactggagagagttggggaaaatttcgtgtcatggttgccaatgtatagtgaagcaaagctggcatttatcgtgtacttgtggtatccaaatacacgtgggactgcctacgtgtatgagactttctttaagccatacattgcaaaacatgaaactgagattgatcgaaatctgcttgagttgaggacaagagccggtgatatggcagttgtttacttccagagggttgcaaactatgtacagacaaggtcctatgaaatcttgcagtatattgcctcacagtcaccgtctcaaagacctcgccctcagggacagcaacagcagcagcgcccacctccaccacggactcggcaggtgaaccctggacctccacctgttcccgcgccatcggctcctccgttgccaccacagcctgcccaagcccaagttcctccggcaccaccaaggcccccagttccagttgcccctcctggtgcagtgcctcccacccagccacaggcaccacctgcttctggagctgccgccatcaatggtcc

SEQ ID NO: 47253 - protein, 229 aa, Panicum virgatum
  misc_feature: Ceres CLONE 2035031
  misc_feature (3)..(98): Pfam Name: TB2_DP1_HVA22 Pfam Description: TB2/DP1, HVA22 family
MIGSLITGALTLVLGYAYPAYDCYKTVELNRPEVEQLRFWCQYWILLAVLTVLERVGENFVSWLPMYSEAKLAFIVYLWYPNTRGTAYVYETFFKPYIAKHETEIDRNLLELRTRAGDMAVVYFQRVANYVQTRSYEILQYIASQSPSQRPRPQGQQQQQRPPPPRTRQVNPGPPPVPAPSAPPLPPQPAQAQVPPAPPRPPVPVAPPGAVPPTQPQAPPASGAAAING

SEQ ID NO: 47254 - DNA, 587 bp, Panicum virgatum
  misc_feature: Ceres CLONE 2035044
  misc_feature: Encodes the peptide sequence at SEQ ID NO. 47255
tgataaaaaaagcaagtaacaagagaagatgaccgacgttgtgatgaccatcagtactaccacggatttggaaagagaactgaataaacccgacaagctgttcatggcgccgtggagcgagccatgcaaggtcatgaaggaaccttataggcgaatcgccagagcaagaaaagacagagtcaacttctacacgctcaacgtcgacaagttcaaagatttggcggaggaagctggcgtggaggcgctaccgacgtacgttctactgaagaatgacgatgtgatggacatggtcgttggcgtcaggaggcacgagctcgagaacgccataaaaaacaatacctaacgactgatccgatcagatcatccatgcgtcgagaacgaacgggaaatgaatgattcatagttaaatagtacacatcccatgtgttgtatcacggatactgaaactcgtgtgtgcatgtacacatcctagctagctcagccgccgtagcagctagctacgatgcattgtacgtatggatctcgattatcgattgtcccatgtttgatttcctaaacttctgtggaactagatccccatgttatgc

SEQ ID NO: 47255 - protein, 104 aa, Panicum virgatum
  misc_feature: Ceres CLONE 2035044
  misc_feature (4)..(103): Pfam Name: Thioredoxin Pfam Description: Thioredoxin
  misc_feature: SWISSPROT Homolog: EC 1.8.1.8 Protein-disulfide reductase
MTDVVMTISTTTDLERELNKPDKLFMAPWSEPCKVMKEPYRRIARARKDRVNFYTLNVDKFKDLAEEAGVEALPTYVLLKNDDVMDMVVGVRRHELENAIKNNT

SEQ ID NO: 47256 - DNA, 712 bp, Panicum virgatum
  misc_feature: Ceres CLONE 2035060
  misc_feature: Encodes the peptide sequence at SEQ ID NO. 47257
gagggcatccaaaacttgcagtgatatccaacagcaagcgggctcgtcagtacgtttagccaaagctcacgtgtcgagatggttaagattggactctggggtggagatggaggccagccacgcgacgtggatcaggaacgtcgtcccagccagctgagccgtgttattgtttacagcaagggacaagcgatcaatgctatctccttcgagtatatagacactaaaggggagagggtgagcgtgccagcatggggtggttctcgaggcagcactggaacgattattgatcttggtccagcggagtatatcaaggaaatttctggaacatttggtcgacttggaaatatggcaaacattgtaaccagccttaggtttcttacaaacgagaacaacgagtacaacagtggctgcgctacaggcgaggctttcaagatccagctccatgaaggcagcatcctgggcttctttggacgtgccggggatttccttgatgcaattggcatttactgtgcatgatgggctgatgcatgctgattcatcgaggctcaggtcatagatctgctgcaaccactacgtactccgttatgtttgttgatgcaataaaaccaagggaactcgtctatcccttcaccagcgacgcacatgcagctacgctgtgcgcatgttatgtttgaatgtcgtgtgtatgctctgtatggcttccatgtatata

SEQ ID NO: 47257 - protein, 145 aa, Panicum virgatum
  misc_feature: Ceres CLONE 2035060
  misc_feature (12)..(145): Pfam Name: Jacalin Pfam Description: Jacalin-like lectin domain
MVKIGLWGGDGGQPRDVDQERRPSQLSRVIVYSKGQAINAISFEYIDTKGERVSVPAWGGSRGSTGTIIDLGPAEYIKEISGTFGRLGNMANIVTSLRFLTNENNEYNSGCATGEAFKIQLHEGSILGFFGRAGDFLDAIGIYCA

SEQ ID NO: 47258 - DNA, 662 bp, Panicum virgatum
  misc_feature: Ceres CLONE 2035061
  misc_feature: Encodes the peptide sequence at SEQ ID NO. 47259
acgcacggtgctgctaggagcccagtaccagtctgctggccaggtattaccctctagctgatcatagcatcatcattgcaaaccttgccaagctgccgtcacttgtgcagcagctcgtgcgtgctaccagcctaccaccagccgtggttgcagcatcgtcgttctagccacgcttctcgtgtgagcgctgggtgcaatgtagtgggcgtgccgtgctggttggaagtgatcgtgatggagcagcagcggagccggaggccggaggagcagagggcggggccctcatgcgggcggcgcgcgcgggcggagacgcggcacccggtgtaccgcggggtgcggctccgcgcggggaagtgggtgtcggagatccgcgagctgcggaagcccagcaggatctggctcggcacgtacccgacgcccgagatggccgccgcggcctacgacgccgccgcgtcggcgctgcggggcgccggcgccgcgctcaacttccccgacgccgcgcggtcgctcccggcgccggcctccgcgtccccggaggacgtccgggccgcggccgccgaggcggcggcggcgatggacggccgcctccgtcatcgcgagccgcgcggcgacggcggcggcgcggacgacgccatggcgatcgtggacgaggacgacctgtt

SEQ ID NO: 47259 - protein, 142 aa, Panicum virgatum
  misc_feature: Ceres CLONE 2035061
  misc_feature (29)..(79): Pfam Name: AP2 Pfam Description: AP2 domain
  misc_feature: The sequence is a functional homolog of SEQ ID NO 1050 in the 10/666,642 US patent application
  misc_feature: The sequence is a functional homolog of SEQ ID NO 1233 in the 10/374,780 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: The sequence is a functional homolog of SEQ ID NO 692 in the 11/435,388 US patent application
  misc_feature: Functional homolog of the protein sequence given in SEQ ID NO 51286
  misc_feature: Useful for biocontainment applications
  misc_feature: Useful for making plants with modulated flowering time
  misc_feature: Functional homolog of the protein sequence given in SEQ ID NO 50529
  misc_feature: Useful for making plants with altered terpenoid content
  misc_feature: The sequence is a functional homolog of SEQ ID NO 1380 in the 11/479,226 US patent application
  misc_feature: The sequence is a functional homolog of SEQ ID NO 646 in the 10/412,699 US patent application
  misc_feature: The sequence is a functional homolog of SEQ ID NO 159 in the 11/479,226 US patent application
  misc_feature: The sequence is a functional homolog of SEQ ID NO 2218 in the 10/374,780 US patent application
  misc_feature: The sequence is a functional homolog of SEQ ID NO 36 in the 10/412,699 US patent application
  misc_feature: The sequence is a functional homolog of SEQ ID NO 466 in the 11/435,388 US patent application
  misc_feature: The sequence is a functional homolog of SEQ ID NO 492 in the 10/225,066 US patent application
  misc_feature: The sequence is a functional homolog of SEQ ID NO 1318 in the 11/479,226 US patent application
  misc_feature: The sequence is a functional homolog of SEQ ID NO 164 in the 10/225,068 US patent application
  misc_feature: The sequence is a functional homolog of SEQ ID NO 1816 in the 10/412,699 US patent application
  misc_feature: The sequence is a functional homolog of SEQ ID NO 188 in the 10/374,780 US patent application
  misc_feature: The sequence is a functional homolog of SEQ ID NO 28 in the 10/225,068 US patent application
  misc_feature: The sequence is a functional homolog of SEQ ID NO 740 in the 10/225,066 US patent application
  misc_feature: The sequence is a functional homolog of SEQ ID NO 1226 in the 10/374,780 US patent application
  misc_feature: The sequence is a functional homolog of SEQ ID NO 2602 in the 10/374,780 US patent application
  misc_feature: The sequence is a functional homolog of SEQ ID NO 656 in the 11/435,388 US patent application
  misc_feature: The sequence is a functional homolog of SEQ ID NO 68 in the 10/225,066 US patent application
  misc_feature: Functional homolog of the protein sequence given in SEQ ID NO 51039
  misc_feature: Useful for making plants with modulated biomass
  misc_feature: The sequence is a functional homolog of SEQ ID NO 1225 in the 10/374,780 US patent application
  misc_feature: The sequence is a functional homolog of SEQ ID NO 698 in the 11/435,388 US patent application
  misc_feature: The sequence is a functional homolog of SEQ ID NO 1238 in the 10/374,780 US patent application
  misc_feature: The sequence is a functional homolog of SEQ ID NO 770 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 780 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: Functional homolog of the protein sequence given in SEQ ID NO 51026
  misc_feature: Useful for making plants with modulated water use efficiency
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 2 in US patent 7253000
  misc_feature: The sequence is a functional homolog of SEQ ID NO 1248 in the 10/374,780 US patent application
  misc_feature: The sequence is a functional homolog of SEQ ID NO 1247 in the 10/374,780 US patent application
  misc_feature: The sequence is a functional homolog of SEQ ID NO 746 in the 11/435,388 US patent application
  misc_feature: The sequence is a functional homolog of SEQ ID NO 1244 in the 10/374,780 US patent application
  misc_feature: The sequence is a functional homolog of SEQ ID NO 744 in the 11/435,388 US patent application
MEQQRSRRPEEQRAGPSCGRRARAETRHPVYRGVRLRAGKWVSEIRELRKPSRIWLGTYPTPEMAAAAYDAAASALRGAGAALNFPDAARSLPAPASASPEDVRAAAAEAAAAMDGRLRHREPRGDGGGADDAMAIVDEDDL

SEQ ID NO: 47260 - DNA, 667 bp, Panicum virgatum
  misc_feature: Ceres CLONE 2035069
  misc_feature: Encodes the peptide sequence at SEQ ID NO. 47261
gcaaggatgttagaccataaagaagctatcatatctcatttaagttgggctagcctcttcctaggattccataccttaggcctttatgttcataacgacgtcatgcttgcttttggtactccagaaaagcaaatcttgatcgaacctatatttgcccaatggatacaatctgctcatggtaagacgacatatgggttcgatatactcttatcttcaacgaatggccctgctttcaatgcaggtcgaagcatatggttgcccggatggttgaatgctgttaatgagaatagtaattcgcttttcttaacaataggacccggagatttcttggttcaccatgctattgctctaggtttgcatacaactacattgattttagtaaagggtgctttagatgcacgcggttccaaattaatgccggataaaaaagatttcggatatagttttccttgcgacggcccagggcgcggtggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctgtggttaaactcttcacaac

SEQ ID NO: 47261 - protein, 222 aa, Panicum virgatum
  misc_feature: Ceres CLONE 2035069
  misc_feature (1)..(222): Pfam Name: PsaA_PsaB Pfam Description: Photosystem I psaA/psaB protein
ARMLDHKEAIISHLSWASLFLGFHTLGLYVHNDVMLAFGTPEKQILIEPIFAQWIQSAHGKTTYGFDILLSSTNGPAFNAGRSIWLPGWLNAVNENSNSLFLTIGPGDFLVHHAIALGLHTTTLILVKGALDARGSKLMPDKKDFGYSFPCDGPGRGGTCDISAWDAFYLAVFWMLNTIGWVTFYWHWKHITLWQGNVSQFNESSTYLMGWLRDYLWLNSSQ

SEQ ID NO: 47262 - DNA, 749 bp, Panicum virgatum
  misc_feature: Ceres CLONE 2035075
  misc_feature: Encodes the peptide sequence at SEQ ID NO. 47263
ctcgcgccgccactcccctcccgttccgctcgcccaaaaccctagcgctccccaccgctcgccgccgccgcagcgagcgcctcctctccctccgtcagccatggcgacccagatcagcaagaagaagaagttcgtcagcgatggtgtgttctacgcggagctgaacgagatgctgacgcgggagctcgcggaggatggttactccggcgtggaggtgcgcgtcaccccgatgcgcacggagatcatcatccgcgccacgcgcacccagaacgtgctcggcgagaagggccgcaggatcagggagctcacctccgtagtccagaagcggttcaacttccccgagaacggcgtcgagctctacgccgagaaggtcgtcaaccgcggcctctgtgccatcgcccaggccgagtccctccgctacaagctccttggaggcctcgccgtccgcagggcttgctatggtgttcttcgctttgttatggagagtggtgccaagggttgtgaggtcattgtgagtggaaagctcagggcccaaagagccaagtccatgaagttcaaggatggctacatgatctcttctggtcagcctgtgaacgagtacattgactctgctgtcagacacgtccttctcagacagggtgttcttggcatcaaagttaagatcatgctcgactgggacccgaagggcaagcttggcccggtcaccccgcttacggaccctggtcaccatccacgcccccaaagaagga

SEQ ID NO: 47263 - protein, 216 aa, Panicum virgatum
  misc_feature: Ceres CLONE 2035075
  misc_feature (104)..(188): Pfam Name: Ribosomal_S3_C Pfam Description: Ribosomal protein S3, C-terminal domain
  misc_feature (45)..(102): Pfam Name: KH_2 Pfam Description: KH domain
  misc_feature: Functional homolog of the protein sequence given in SEQ ID NO 51097
  misc_feature: Useful for making plants with modulated biomass
  misc_feature: Functional homolog of the protein sequence given in SEQ ID NO 51096
  misc_feature: Useful for making plants with modulated water use efficiency
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSAVRHVLLRQGVLGIKVKIMLDWDPKGKLGPVTPLTDPGHHPRPQRR

SEQ ID NO: 47264 - DNA, 738 bp, Panicum virgatum
  misc_feature: Ceres CLONE 2035122
  misc_feature: Encodes the peptide sequence at SEQ ID NO. 47265
aggacctcgattattctgttcgctcaccaagtctacttccggtcgtctcccctccctctcgtccccagccacgcagccgccgcaggccggagggggcgccatggccgcgtcggatctggggagcaaggccaaggaggccttcgtcgacgacgacttcgagctcgccgccgagctgtacacccaggccatcgacgccgggcccgccaccgccgacctctacgccgaccgcgcccaggcgcacatcaagctcggcaactacactggtaaggccgcgctcttcccctacccagcctctgcccccaccctccccgctgccgcccggccgagggcccgattcgcccgtgtgtgtatgtggtgccatgtgcggatgtggttcggcgcgcgcgcgggtgtccggtgtggtcgcgatcggctgagaactcgagatgccgtagggcggtcctaggaggagaagcctggttcgaatcgcggtttgtcgttgcgtcgcgggctatctcgtgcgattctagggtagttcggtttgggaggtcaacgtcaaccagagtgtaggcctgagtgagcgtgggttcgttttttgtgggctgtggcgacgagcttcgtgtgattcgaacttcaaggaggctcctaggtgattaggttgctgaaatgactgtgttgagagtctgattactcagaattgacttgtttgtattccggcgtttcaactatagaggatgaaggttcagattgtctgaaatg

SEQ ID NO: 47265 - protein, 114 aa, Panicum virgatum
  misc_feature: Ceres CLONE 2035122
  misc_feature: SWISSPROT Homolog: EC 3.1.3.16 Phosphoprotein phosphatase
MAASDLGSKAKEAFVDDDFELAAELYTQAIDAGPATADLYADRAQAHIKLGNYTGKAALFPYPASAPTLPAAARPRARFARVCMWCHVRMWFGARAGVRCGRDRLRTRDAVGRS

SEQ ID NO: 47266 - DNA, 747 bp, Panicum virgatum
  misc_feature: Ceres CLONE 2035125
  misc_feature: Encodes the peptide sequence at SEQ ID NO. 47267
acacaaggtagataagcctttccagatcatactaaaccaagcagccacttcacactagggcacttggatcacacaagaaagttcaggtcggaagaagatgcaggccgccgccgctacagcagtcgggttctctgctgcggcgcccgtgaagggcgggccggcggcgaggagcacggtggtcgctcgtgtcccagccacaaggaggagcgttcgcgccgccgtggccgccgccatcgtcgcggcggagcccgccgaggtcgactacagctcgagcttctccgtgttccccatggaggcctgcgagctgctcggcggcgacgcctgcagcgcgcagatgtacccggaggctaagctcgccggctcggcggaggcggccggcaggagggaggaggaggtggagagggactacctgtcctacgacgagccgaagacggtgttccccggcgaggcgtgcgacgacctcggcggcgagttctgcgaggcgctgtaccaggccggcgtgtccagggagctggcggcctggcgcacgcctgatcgggtcgaagggtgattggaagctagcagatgatgcttacgcggtagatggggagctagcgtacgcgcacgtacagaataacagcagcctagcaaggccaaggacttgtcacgtgtgtaaatgtgcatgtctctttggtcgtgtcagctgcctgtctgtagaaactaaaagatgaaatatatgggtactggtggtgatgctgttttacagtt

SEQ ID NO: 47267 - protein, 150 aa, Panicum virgatum
  misc_feature: Ceres CLONE 2035125
  misc_feature (1)..(130): Pfam Name: Lir1 Pfam Description: Light regulated protein Lir1
MQAAAATAVGFSAAAPVKGGPAARSTVVARVPATRRSVRAAVAAAIVAAEPAEVDYSSSFSVFPMEACELLGGDACSAQMYPEAKLAGSAEAAGRREEEVERDYLSYDEPKTVFPGEACDDLGGEFCEALYQAGVSRELAAWRTPDRVEG

SEQ ID NO: 47268 - DNA, 724 bp, Panicum virgatum
  misc_feature: Ceres CLONE 2035140
  misc_feature: Encodes the peptide sequence at SEQ ID NO. 47269
accacaccaaagcgagggcgactccttcctcgcagcagccgcccgccccgaccccgatcgccacgcctctgctcgctgcggcgcggcgcagtatccgcgcgtacccggccggcctctctgtgggggcgcatctggtggctaccttgccaggctagggttgggtagccgtcttctaccttcgtatcacgcgagcaggctccggtcgcgcgtcatcgtctctcgctctctccggttgcgaccgtgtgttgtgcccccgcgagcttcctcgtgccacgggagggccgctgctgccgttccgtccaccggtggattatccgacagtctacagatggctggatatatgtcaagagggcccccaaacggttcagtttacgtgtgcaacctgcctcctggaactgatgagactatgctagctgaatattttggcaccatagggttgctaaagaaggacaagaggactgggcgtccaaaaatttggatatatagggacaaggttaccaatgaaccaaagggtgatgcaacggtcacctatgaggatccacatgctgcttcagctgcggttgactggttcaataacaaagatttccatgggagtattatccaggttcacatagctgagtcaaaaagtaaagatacatttgatagttccacaaatttggccatcactgctgaccttggtggacaagatgaattggataatggtgttggcagaggtagaggacgc

SEQ ID NO: 47269 - protein, 131 aa, Panicum virgatum
  misc_feature: Ceres CLONE 2035140
  misc_feature (14)..(93): Pfam Name: RRM_1 Pfam Description: RNA recognition motif. (a.k.a. RRM, RBD, or RNP domain)
MAGYMSRGPPNGSVYVCNLPPGTDETMLAEYFGTIGLLKKDKRTGRPKIWIYRDKVTNEPKGDATVTYEDPHAASAAVDWFNNKDFHGSIIQVHIAESKSKDTFDSSTNLAITADLGGQDELDNGVGRGRG

SEQ ID NO: 47270 - DNA, 633 bp, Panicum virgatum
  misc_feature: Ceres CLONE 2035158
  misc_feature: Encodes the peptide sequence at SEQ ID NO. 47271
aacaagcagagcagagcctagcttcttcctgaacccaactccatcaaccaacgcaggctcgtcctagctagttccaccagcaacatgtcggacaagtgcggcaactgcgactgtgctgacaggagcaagtgcacgaagggcaacagctatggcgtcgtcgtagtcgacaccgagagccgcgtcgagcgccgcgaggaggaggaggtcgccgccggcgagaacgacggcaagtgcaagtgcggcaccagctgcggctgcggcgccagctgcaactgcggccactgaagaagcccgccgcgtcgtccatggcctgcgtgcacactccccatccagtacccatcctgtacctgtatgtacgtcgtcgatcacagcgtataaataaaattaaataaaccgccatgcccgtgttgaatacgtacgtacgtcgtgtcctatgtgacctgctgcgtctccgctgctgtcgtgcatgtgaccagcagccacctgtagctacctacctgctggctgcctctgttgtggggcctagctagtatttttttttagggtatatactacgtgtctttgtgacgacgcatgcatgtacgtatctctgttatgtgcaatgaaatctactgtgtgctttgactactaagt

SEQ ID NO: 47271 - protein, 66 aa, Panicum virgatum; identical to SEQ ID NO: 15723
  misc_feature: Ceres CLONE 2035158
  misc_feature (2)..(64): Pfam Name: Metallothio_2 Pfam Description: Metallothionein

SEQ ID NO: 47272 - DNA, 690 bp, Panicum virgatum
  misc_feature: Ceres CLONE 2035161
  misc_feature: Encodes the peptide sequence at SEQ ID NO. 47273
gtataaaaagcgccaagcaagcaaagcacccgcacaacgcacaacaaactcgcccgccgcaccacctcagctttgctctgctctcccctgctcctcttgccccatggcggcggacgcccccacccccaccctcacggcgctgctcaagaaggcggccgccgccttcccggcccgccgcgccgtctccgtcccgggcaagatcgagctcacccacgccgacctcgacgcgctcgtcgacgccgcggccgcgcgcctcgccgccgacgccggggtccgcccgggacacgtcgtcgcgctctccttccccaacaccatcgagctggtgatcatgttcctggcggtgatccgcgcccgcgccgtggcggcgccgctcaacccggcttacacccaggacgagttcgagttctacctccccgactccgagtcccgcctcctcatcaccaacgccgagggcaaccccgccgcgcaggccgccgccgccaagctcggcctaccccacgccgcggccaccctcaaggacgccgccggccccgtccacctcgccggcctgggctgcgccgccgccaacgggaacgcgaacgcgaacggctcgcactccaacaaacaagacaacgagccgtccgacgtggcccttttcctgcacacctccggcacgacgagccggcccaagggggtgccgctcacgcaggg

SEQ ID NO: 47273 - protein, 195 aa, Panicum virgatum
  misc_feature: Ceres CLONE 2035161
  misc_feature: SWISSPROT Homolog: EC 5.1.1.11 Phenylalanine racemase (ATP-hydrolyzing)
MAADAPTPTLTALLKKAAAAFPARRAVSVPGKIELTHADLDALVDAAAARLAADAGVRPGHVVALSFPNTIELVIMFLAVIRARAVAAPLNPAYTQDEFEFYLPDSESRLLITNAEGNPAAQAAAAKLGLPHAAATLKDAAGPVHLAGLGCAAANGNANANGSHSNKQDNEPSDVALFLHTSGTTSRPKGVPLTQ

SEQ ID NO: 47274 - DNA, 713 bp, Panicum virgatum
  misc_feature: Ceres CLONE 2035165
  misc_feature: Encodes the peptide sequence at SEQ ID NO. 47275
aggtaagcaacgagcatcagcaaccaacagctccgacgatctcaaagactcgaacgttctcaggcctcagcatttcagttcctagactagactagactaagtagcgcgatggcagctgctccgtttgcgatcgccagccgcctcaccccggccgcgcgcctccttgtacgcgcatggagggcggcgaggccggcgcccgggctggcgtcgtcggggaaagcccgctccctctccgtggcgtccgcggcacaggagaacagggacaacaccgccgttgacgtccaggtcaaccagaacggcggcaaccggcagcagggcaacgccgtccagcgccgcccgcgccgcgcggcgccactcgacatctccccgttcgggttggttgatccgatgtcaccgatgcggacgatgcggcagatgctggacacgatggaccggctgttcgacgacgccgtggggttccccatggcgacgcggaggtccccggcggcggccggcgaggtgcgcctgccgtgggacatcatggaggacgagaaggaggtgaagatgcggttcgacatgccggggctggcgcgtgacgaggtgaaggtgatggtggaggacgacaccctggtgatccgcggcgagcacaagaaggaggagggcgcggagggcgacggcgacgggtggtggaaggagcgcagcgtgagctcgtacgacatgcggctggcgctgcc

SEQ ID NO: 47275 - protein, 201 aa, Panicum virgatum
  misc_feature: Ceres CLONE 2035165
  misc_feature (136)..(201): Pfam Name: HSP20 Pfam Description: Hsp20/alpha crystallin family
  misc_feature: Functional homolog of the protein sequence given in SEQ ID NO 51699
  misc_feature: Useful for making plants with modulated heat sensitivity
MAAAPFAIASRLTPAARLLVRAWRAARPAPGLASSGKARSLSVASAAQENRDNTAVDVQVNQNGGNRQQGNAVQRRPRRAAPLDISPFGLVDPMSPMRTMRQMLDTMDRLFDDAVGFPMATRRSPAAAGEVRLPWDIMEDEKEVKMRFDMPGLARDEVKVMVEDDTLVIRGEHKKEEGAEGDGDGWWKERSVSSYDMRLAL

SEQ ID NO: 47276 - DNA, 686 bp, Panicum virgatum
  misc_feature: Ceres CLONE 2035185
  misc_feature: Encodes the peptide sequence at SEQ ID NO. 47277
gaaacctcatccaaatccaaagcaaagccaagacacgtttcatttcatcatttggctcactcgctcactcacctgtctgtccatcgctctagctcagctcccagtgatagctgcaagcgacagcacagccagcgccaccaagagctgggagaggaaggcagcgccaccaagagctgggagaggaaggttgtagacgatggggaagctctggacgatcctcactcacctccactccctcgcagggccaacggtcatgctcctgtaccccctgtacgcgtcggtgcaagcgatggagagcccgtcgaagcttgacgacgagcagtggctcgcctactggatcctctactccttcatcacgctcatggagatggtgctcgagtccctcatctactggatcccgatttggtacgagctgaagctgctgttcatcgcgtggctggtgctccccaacttcaggggcgcggccttcatctacgacaagttcgtcagggagcagctccggaagcacggcctcaccgccggcggcggcaaggtcaagaaggaggacaagtcgccctcgtcttctcccaaggacaaggagaagcccaagagcaagttccttgccttcgtcacccccaagaaggtgacctgacctgaactccgcaccatgagagattcagctttttccacgcttgcagttcacaggc

SEQ ID NO: 47277 - protein, 144 aa, Panicum virgatum
  misc_feature: Ceres CLONE 2035185
  misc_feature (4)..(101): Pfam Name: TB2_DP1_HVA22 Pfam Description: TB2/DP1, HVA22 family
MGKLWTILTHLHSLAGPTVMLLYPLYASVQAMESPSKLDDEQWLAYWILYSFITLMEMVLESLIYWIPIWYELKLLFIAWLVLPNFRGAAFIYDKFVREQLRKHGLTAGGGKVKKEDKSPSSSPKDKEKPKSKFLAFVTPKKVT

SEQ ID NO: 47278 - DNA, 714 bp, Panicum virgatum
  misc_feature: Ceres CLONE 2035251
  misc_feature: Encodes the peptide sequence at SEQ ID NO. 47279
aaaaaaacgccactgagaaatccgcttgcataacgagcacgccgaaacctgcggaggacgaggcgaagaaggcagaggaggggaagaaggcgaggaagccgcggagcaggaagcccaggtccgccgggccgcaccacccgccctacttcgagatgatcaaggaggcgatcctgtcgcaggacagcaaggcgggggcgagcccgtacgcgatcgccaagcacatgggggagaagcaccgggacgtgctcccggccaattaccgcaaggtgctggccgtgcagctgcgcaacttcgccgccaagggccgcctcgtcaaggtcaaggcctccttcgggctcgccgcggccgaggagaagaaggccgcctccgtcgcgaaggcgaaggcgaaggcgccggcgccggcggcagcggctcccaagcgcaagagggcggctgcctccgccgcgcccgccaagaagaagaagccggcggcccccgcggaggcgaagaaggcgcgcgcgaagcgggcgaggaaggcggccccggcgcagccgaagccgaagcagcggcagcagaccaggcccgtccgcgccgccgtcgccaagaaggccgccgccaacaaggccagcgcctgatgaaccgccgccgccagctctttgtttcgttttggtcccgtacgcgcgtgatcgcgtgttgtattgtaaataccgaaaccccgcggggtgtgatgccaat

SEQ ID NO: 47279 - protein, 203 aa, Panicum virgatum
  misc_feature: Ceres CLONE 2035251
  misc_feature (44)..(114): Pfam Name: Linker_histone Pfam Description: linker histone H1 and H5 family
KNATEKSACITSTPKPAEDEAKKAEEGKKARKPRSRKPRSAGPHHPPYFEMIKEAILSQDSKAGASPYAIAKHMGEKHRDVLPANYRKVLAVQLRNFAAKGRLVKVKASFGLAAAEEKKAASVAKAKAKAPAPAAAAPKRKRAAASAAPAKKKKPAAPAEAKKARAKRARKAAPAQPKPKQRQQTRPVRAAVAKKAAANKASA

SEQ ID NO: 47280 - DNA, 738 bp, Panicum virgatum
  misc_feature: Ceres CLONE 2035266
  misc_feature: Encodes the peptide sequence at SEQ ID NO. 47281
aagggaagtttctcgtctacgagtatgtacccaataacagcctcgacaaattctggtacaaagcatgttcccagtcacagaagctagaatgggctacatggttcaacatcatcttaggggtagctcgcggcctccggtttctccacgacaaggggatcatccacagagatctcaagccacacaatgtgcttctcgatgaaaacttcaaccccaagatcgccgacttcgatctcatgagggtgtacgataaacagaggacccacgagagcacggagaaggtcgccggaacatttggttacatagcgccggagtgcacgtccggccggaagttcctgctgtcgatcaagtccgacgtgtacagctacggggtcctggtgctggaggtcatcaccggccacaagatctacacgttcgaaggccaaaaatccgaaggcctcgtcgaatacgtgtggcagcactggaaagagaagagagcaggagacatcgtggacggcgacctaggcgtcgaggggcaggaggtcgcggcgcggcaggcactgaggtgcgtgcacgtcgcgctgctctgcgtgcagtcagatcgctctaggaggccgaccatggggcaggtcatcgccatgctgacaagtgaagacgacgacgacgggatggagctgccggagccgtctctgcccgggtacctcatcatccatccaagggcggcgtctggttcggtccggctgccgtgtctcgggtgtaggt

SEQ ID NO: 47281 - protein, 245 aa, Panicum virgatum
  misc_feature: Ceres CLONE 2035266
  misc_feature (1)..(206): Pfam Name: Pkinase Pfam Description: Protein kinase domain
  misc_feature: SWISSPROT Homolog: EC 2.7.11.1 Non-specific serine/threonine protein kinase
GKFLVYEYVPNNSLDKFWYKACSQSQKLEWATWFNIILGVARGLRFLHDKGIIHRDLKPHNVLLDENFNPKIADFDLMRVYDKQRTHESTEKVAGTFGYIAPECTSGRKFLLSIKSDVYSYGVLVLEVITGHKIYTFEGQKSEGLVEYVWQHWKEKRAGDIVDGDLGVEGQEVAARQALRCVHVALLCVQSDRSRRPTMGQVIAMLTSEDDDDGMELPEPSLPGYLIIHPRAASGSVRLPCLGCR

SEQ ID NO: 47282 - DNA, 704 bp, Panicum virgatum
  misc_feature: Ceres CLONE 2035268
  misc_feature: Encodes the peptide sequence at SEQ ID NO. 47283
agccccgttgccttgcctcctctcccatttctaatccccccctcccgaagcccaaaccctaaacctaaacctctcaccccagccgccgccaccaccgctttcgccgccgccgcgactcccctccctgccgccgacgtcccccgcctcggatcgaagcaatgtcgtcggacgatgaggtccgggaggagaaggagctcgacctctcatccaacgacgtcgtcaccaagtataaggccgccgccgaaatcctcaacaacgctctgaagctggttgtatctgagtgcaagccgaaagccaagattgttgacctttgtgagaagggtgatgctttcattagagagcaaactgggaatgtctacaagaatgcaaagaggaagattgaaaggggcattgctttcccaacctgtgtatctgtgaataacacagtctgccatttctcaccgcttgccactgatgaggcagttctggaagaaaatgatatggttaaaatagatatgggctgtcacattgatggttttattgctgtggtggctcatactcatgtaattacgaatgggccggtcactggaagagcagctgatgttcttgctgctgccaacaccgcagcagaagtcgcaatgaggcttgtgagacctgagaagaagaacaaggatgtcactgaagcaatccagaaagtagctgctgcttatgattgcaaaattgtc

SEQ ID NO: 47283 - protein, 181 aa, Panicum virgatum
  misc_feature: Ceres CLONE 2035268
  misc_feature (22)..(181): Pfam Name: Peptidase_M24 Pfam Description: metallopeptidase family M24
  misc_feature: SWISSPROT Homolog: EC 3.4.11.18 Methionyl aminopeptidase
MSSDDEVREEKELDLSSNDVVTKYKAAAEILNNALKLVVSECKPKAKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPEKKNKDVTEAIQKVAAAYDCKI

SEQ ID NO: 47284 - DNA, 689 bp, Panicum virgatum
  misc_feature: Ceres CLONE 2035284
  misc_feature: Encodes the peptide sequence at SEQ ID NO. 47285
ctacaaaggaaggctggcagatggttcattagtagctgtcaagagactaaaggaggagagaacacctggtggggaactacaatttcaaacagaagttgagatgattagtatggctgtacatagaaaccttttgcgtcttcgtggattttgtatgacaccaacggaaaggttgcttgtgtatccatacatggccaatggaagtgttgcgtctcgtttaagagaacggccggaatcagaacctccactagattggcaaacacgaaggaggattgcattgggttctgccaggggcctgtcctatctacatgatcattgtgatccgaagattatccatcgtgatgtcaaagctgcgaatattttgttagatgaagactttgaagctgtagttggagattttggattggccaaactaatggattacaaggatacccatgtaactacagcagttcgtggaacaattggccatatcgcgcccgaatatctttcaacaggaaaatcctctgagaaaactgatgtatttggttatggaattacgcttttggagcttattacaggacaacgtgcctttgatcttgctcgccttgccaatgatgacgatgtcatgctgcttgattgggtcaaggggttgctcaaggagaagagactggagagtctggttgatgaagatctacagcacaactacatttgat

SEQ ID NO: 47285 - protein, 228 aa, Panicum virgatum
  misc_feature: Ceres CLONE 2035284
  misc_feature (1)..(228): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50524
  misc_feature: Useful for making plants with modulated nitrogen use efficiency
YKGRLADGSLVAVKRLKEERTPGGELQFQTEVEMISMAVHRNLLRLRGFCMTPTERLLVYPYMANGSVASRLRERPESEPPLDWQTRRRIALGSARGLSYLHDHCDPKIIHRDVKAANILLDEDFEAVVGDFGLAKLMDYKDTHVTTAVRGTIGHIAPEYLSTGKSSEKTDVFGYGITLLELITGQRAFDLARLANDDDVMLLDWVKGLLKEKRLESLVDEDLQHNYI

SEQ ID NO: 47286 - DNA, 701 bp, Panicum virgatum
  misc_feature: Ceres CLONE 2035287
  misc_feature: Encodes the peptide sequence at SEQ ID NO. 47287
ggcaggactcgcggggaaggagcagcaagcaagcaacaagcgagagccggtcaactcaaggggcttgtcaagagcaagaagatgggcagcgcacagcagcagctgctcctgctctgcttcttgttcttcctcctatctgcggtcgccccgcaggtagtcagagcagtgaaaccaatcccaaattccattctcggggtcgaggagggagacaattctaaaggaatcatccagaaggacatcatagagacggtcaacaagcatcccgatgctgggtggacggctgcacacaatccttactttgcaaactatactattgcacaatttaaacgtatccttggagtgaagcccacaccaccgagtgtgctgactgatgttcctaccaaaacttattcaagatcactgaaacttccaaaggagttcgacgccagatctaagtggtctcattgcagcacaattgggaagatacttgatcaaggtcattgtggctcctgttgggcttttggtgctgtggagtgcctccaggatcgtttttgcattcatatgaacacggtgaccgaatataaccgtcatggatatactcatactgttttaaactggcattgttggtccttttttgaataaactattgtttcttttccttgcagagcatttcactatcagtcaatgacctactggcatgctgcggttttatgtgcggtgat

SEQ ID NO: 47287 - protein, 179 aa, Panicum virgatum
  misc_feature: Ceres CLONE 2035287
  misc_feature (49)..(92): Pfam Name: Propeptide_C1 Pfam Description: Peptidase family C1 propeptide
  misc_feature: SWISSPROT Homolog: EC 3.4.22.1 Cathepsin B
MGSAQQQLLLLCFLFFLLSAVAPQVVRAVKPIPNSILGVEEGDNSKGIIQKDIIETVNKHPDAGWTAAHNPYFANYTIAQFKRILGVKPTPPSVLTDVPTKTYSRSLKLPKEFDARSKWSHCSTIGKILDQGHCGSCWAFGAVECLQDRFCIHMNTVTEYNRHGYTHTVLNWHCWSFFE

SEQ ID NO: 47288 - DNA, 650 bp, Panicum virgatum
  misc_feature: Ceres CLONE 2035295
  misc_feature: Encodes the peptide sequence at SEQ ID NO. 47289
gcggccttcgggagttcgggggaagaagaggagaggaaaagggagatgaaggcgtgcgcgaaggcggcgggggaaaggctcccgctccccctggttcgtcctcccaccgggcgggcgctggctcggagctttgttaaggtaagcagattaccctctcaacggacaaagtctcaagtatcctgctacactggggtgtcggaaaatgcagtgcatagaatagaagccacagcagagaacattttcccagcaaccaaagatcatgtcacaaaagcaactgatgcaattaacagaggagaagtgatcgcagtgcccactgatacaatatacgggtttgcttgcgatgcctgctctgcaggagcagttaatcgcatttatgagatcaaagggcgcatacaaacacgccctctggcaatctgtgttgctgatgtctcagacatatcacgatttgctttagtagatcacctgccacatggattgcttgatagtctacttcctgggcctgtcactgttgttctaaaacgaggtgaagacagtatattagacagatcacttaatcctggcttggatagcattggagttcgtgtgccagatctggatttcatacaatccattgctcgtggtgctggaagtgcacttgcacttactagtgc

SEQ ID NO: 47289 - protein, 201 aa, Panicum virgatum
  misc_feature: Ceres CLONE 2035295
  misc_feature (77)..(201): Pfam Name: Sua5_yciO_yrdC Pfam Description: yrdC domain
MKACAKAAGERLPLPLVRPPTGRALARSFVKVSRLPSQRTKSQVSCYTGVSENAVHRIEATAENIFPATKDHVTKATDAINRGEVIAVPTDTIYGFACDACSAGAVNRIYEIKGRIQTRPLAICVADVSDISRFALVDHLPHGLLDSLLPGPVTVVLKRGEDSILDRSLNPGLDSIGVRVPDLDFIQSIARGAGSALALTS

SEQ ID NO: 47290 - DNA, 598 bp, Panicum virgatum
  misc_feature: Ceres CLONE 2035302
  misc_feature: Encodes the peptide sequence at SEQ ID NO. 47291
gcaccatcgcccttccctcggtaaggaatccctacctcgatccgtctcagctctgcaagaatatcacttttccgcgccgggagcatttagatcgggggtcgttcttgcgaggatccatccgagatccattctttttcccccctcctcttcacccggatcttggttcttggttcgtggcagaggatggattggcaggggcagaagctcgcggagatgctgatgcaggtgctgcttgtggcgtcggccgtggcggcgttcctggcgggctacgtgcgcggggacttccagctcatgctgctcgtctacgccgctggcgtcgtgctcacggcgctcgtcaccgtccccaactggcccttcttcaaccgcaacccgctcaagtggctcgacgccgccgaggccgagcgccacccgcgcccgcaggtcagcgccaccggcgcgggggcagggggtaagaagaagtccgggaagaacaagtagttggtctttcagaggcaatatgtgttgtcggcccatatgactcgacttgttttggtactgttttcagagctatatatgacattgaaatattagacaattgcggtactaagttaacagatcg

SEQ ID NO: 47291 - protein, 97 aa, Panicum virgatum; identical to SEQ ID NO: 46024
  misc_feature: Ceres CLONE 2035302
  misc_feature (1)..(80): Pfam Name: SPC12 Pfam Description: Microsomal signal peptidase 12 kDa subunit (SPC12)

SEQ ID NO: 47292 - DNA, 629 bp, Panicum virgatum
  misc_feature: Ceres CLONE 2035303
  misc_feature: Encodes the peptide sequence at SEQ ID NO. 47293
acgcgcgcccgattcgagttcatgcgtgcggcgccgcggccaaggtggcgaacgcgcgggggggaggagggctcgccgcagaggccggaggcgatgctggagtcgcaggcgctggcgggcggcggggaagaggacgagcaggcgtggtggatgctgtccgggtacgagcggagccaggaggcgtccgtgatggtggaagcgctagcgcgggtggtcgcgggcggggagcctcgccgggagggtgtcgcagtcgcgccggcggcgggcggctggcagggctacggcggctacggcgagatggcgccgccgcctcacgagtacggcagagcagcgacgccggcgcagcactcgcccgcggcgtcggcgtcggcgggcccgagcggggagatcccgtcgccgtcctctgcggagagcagcggcggcggcgggccgcggcggcggtaccgcggcgtgcggcagcggccgtgggggaagtgggcggcggagatccgggacccgcacaaggcggcgcgcgtgtggctgggcaccttcgacaccgccgaggcggcggcgcgggcctacgacgaggcggcgctcgggttccgcggcagccgcgccaagctcaacttcccggagtccgccgcgctccg

SEQ ID NO: 47293 - protein, 178 aa, Panicum virgatum
  misc_feature: Ceres CLONE 2035303
  misc_feature (115)..(166): Pfam Name: AP2 Pfam Description: AP2 domain
  misc_feature: The sequence is a functional homolog of SEQ ID NO 1769 in the 10/374,780 US patent application
  misc_feature: The sequence is a functional homolog of SEQ ID NO 1755 in the 10/374,780 US patent application
  misc_feature: The sequence is a functional homolog of SEQ ID NO 1756 in the 10/374,780 US patent application
  misc_feature: The sequence is a functional homolog of SEQ ID NO 34 in the 10/225,068 US patent application
  misc_feature: The sequence is a functional homolog of SEQ ID NO 348 in the 10/374,780 US patent application
MLESQALAGGGEEDEQAWWMLSGYERSQEASVMVEALARVVAGGEPRREGVAVAPAAGGWQGYGGYGEMAPPPHEYGRAATPAQHSPAASASAGPSGEIPSPSSAESSGGGGPRRRYRGVRQRPWGKWAAEIRDPHKAARVWLGTFDTAEAAARAYDEAALGFRGSRAKLNFPESAAL

SEQ ID NO: 47294 - DNA, 696 bp, Panicum virgatum
  misc_feature: Ceres CLONE 2035305
  misc_feature: Encodes the peptide sequence at SEQ ID NO. 47295
ctctgcatctctccctccctctctctgctcagatctttgtgagaagcgattcgattcctctcgcgcgtcatggacgacgacggcgactggatcacggcgaggtacctcctcgcgtccatcctcgggcgggacccaatggtcgtggactacgtcgacgaggagtccttccccgtcgaccctcctcccgcccgccttgcggaggcgccggcgccggcgccggccgtttcagcgccgccggcggtgcgggcgcccgcgggcgtggccggcacggtgtgcgcggtgtgcacggaggagatcgcggcggcggacgccgtggtgcggctgccgtgcgcgcactggtaccacgaccgctgcatcgcgccgtggctcgggatccgcggcacctgccccacgtgccgcgccgaggtcccgcgcagggacgccgccgccggcgaggaggaggaggaggcccgccgcgctaagccgccggcgcgcgcccgggccgggaccagcggcaacgttgccggcgcaagcgcccgcgcgcggcgggacgcggcgtacgagcacctcgccggcggcgtgctgtcgggctgatcgatgtccccgtgtgggggcggcgccgacgccggcgccggccgagtggatcagcaggcgcgtggaccgcgtcgtcgtgcgctcggggttcagaagaaatggggactacgggaaagggtaata

SEQ ID NO: 47295 - protein, 167 aa, Panicum virgatum
  misc_feature: Ceres CLONE 2035305
  misc_feature (69)..(109): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MDDDGDWITARYLLASILGRDPMVVDYVDEESFPVDPPPARLAEAPAPAPAVSAPPAVRAPAGVAGTVCAVCTEEIAAADAVVRLPCAHWYHDRCIAPWLGIRGTCPTCRAEVPRRDAAAGEEEEEARRAKPPARARAGTSGNVAGASARARRDAAYEHLAGGVLSG

SEQ ID NO: 47296 - DNA, 631 bp, Panicum virgatum
  misc_feature: Ceres CLONE 2035312
  misc_feature: Encodes the peptide sequence at SEQ ID NO. 47297
atactgtcgaacaatggaagccaaggtcttccggtttctgaagctcgtgggggtcggtttcaaagcaaggtcagagagccaaggccgtgagctgttcctgaaactgggctacagccatgaggtgcagttcaccgccccacccgccgtccgcgtcttctgcttcaagcccaacataatctgctgcaccggcatcgacaaggacagggttcaccagttcgccggcgccgtccggagctgcaaacccccagaggtgtacaaggggaagggcatactgtacattgacgaggtcatcaagctgaagcccgggaagaagcaaaagaagtgacagcgagatggtgctgtaacattatatttggcttttaacctcttgagaatcagttctgctgcgcatttgtagcgatgcgggtttgatgtgatttcttgtgctaagcagatcagcgttgtcccagatttgcctatgtagtgtcaggcaatgcaatgtacgcgaggtgtgtaatggagttgtatggccatgaataggaataagttgccagttaaaattttgttgatgtcaagctggaacattactctgaatctggacttcagttatattggaatgtttccttcctaattcattgtagaggttccaaac

SEQ ID NO: 47297 - protein, 103 aa, Panicum virgatum
  misc_feature: Ceres CLONE 2035312
  misc_feature (12)..(89): Pfam Name: Ribosomal_L6 Pfam Description: Ribosomal protein L6
MEAKVFRFLKLVGVGFKARSESQGRELFLKLGYSHEVQFTAPPAVRVFCFKPNIICCTGIDKDRVHQFAGAVRSCKPPEVYKGKGILYIDEVIKLKPGKKQKK

SEQ ID NO: 47298 - DNA, 724 bp, Panicum virgatum
  misc_feature: Ceres CLONE 2035319
  misc_feature: Encodes the peptide sequence at SEQ ID NO. 47299
atccaactcaaaaaaccgccagttcaagcagtacgccaccaggcaaaactaagcagaaaagcactggccgtattctgcgcttcggccttacttccgaagaaaaattccccaaggtttcttacatggatctcgctcaagccacggggagcttctctaacttggttgggagaggaagctatggttccgtgtacagaggaaagctaatcccctctgaactggaagtggcagtgaaggttcttgaccttgaaactcatggtgcagagaaaagcttcttgtccgagtgtgaagcattgaggggcatcaaacatcgaaaccttcttcccatcataactgcatgctcaacggtagacatcaatgccagccctttcaaagctcttgtttatccattcatgcttaacgggaatctagacacatggttgcatcatgaagaggatgggaaagctcaaaaaaatctaagcttaactcaaagaataagcatagctgttgacatagccgatgcattggattatttacataatgacactgaaagggccattatacattgcgacttgaaaccaagcaatatcctcctagatgatgatatgagtgctcatctaggggatttcggcatcgcaagtttctatgttgattcgggatcgtctgcatcaattgaagatccaaatacggcccgttcaagatgcatcggctcaattggtgtgaagggtaccataggatatatagctcc

SEQ ID NO: 47299 - protein, 240 aa, Panicum virgatum
  misc_feature: Ceres CLONE 2035319
  misc_feature (49)..(239): Pfam Name: Pkinase_Tyr Pfam Description: Protein tyrosine kinase
  misc_feature: SWISSPROT Homolog: EC 2.7.11.1 Non-specific serine/threonine protein kinase
PTQKTASSSSTPPGKTKQKSTGRILRFGLTSEEKFPKVSYMDLAQATGSFSNLVGRGSYGSVYRGKLIPSELEVAVKVLDLETHGAEKSFLSECEALRGIKHRNLLPIITACSTVDINASPFKALVYPFMLNGNLDTWLHHEEDGKAQKNLSLTQRISIAVDIADALDYLHNDTERAIIHCDLKPSNILLDDDMSAHLGDFGIASFYVDSGSSASIEDPNTARSRCIGSIGVKGTIGYIA

SEQ ID NO: 47300 - DNA, 428 bp, Panicum virgatum
  misc_feature: Ceres CLONE 2035332
  misc_feature: Encodes the peptide sequence at SEQ ID NO. 47301
acctgaagctccatcagccatggcattcacgcccgccacggcctgctgcaatccctcgctgctggcggcgccccgggcgccgacgcgcggctcgtcgccccgcgcgcaggcggcgctcctcggcgcggtctccacctccacgttccgcggcgtccgggcgaccgcggccgccgcggcggtcccgcggaggcgccacgcggcagcatctacgggcatcagaagcggcaaggtgaccaagggcagcatgccatccaacttcgctctgaaggaccagaacgggaggcccgtgtctctgaacaagatcaagggcaagccagtggagaaaaactacaaccacactgacgagacgctcggatgcaccaaacaggcgtgcgcgttgcgcgactaagactaaaagtccaagaaggccagcgcggagatgctgggca

SEQ ID NO: 47301 - protein, 122 aa, Panicum virgatum
  misc_feature: Ceres CLONE 2035332
  misc_feature: SWISSPROT Homolog: EC 1.11.1.15 Peroxiredoxin
MAFTPATACCNPSLLAAPRAPTRGSSPRAQAALLGAVSTSTFRGVRATAAAAAVPRRRHAAASTGIRSGKVTKGSMPSNFALKDQNGRPVSLNKIKGKPVEKNYNHTDETLGCTKQACALRD

SEQ ID NO: 47302 - DNA, 709 bp, Panicum virgatum
  misc_feature: Ceres CLONE 2035339
  misc_feature: Encodes the peptide sequence at SEQ ID NO. 47303
gggattttcttacaggagctgccgccgccgccgccgccgccagtgaccgcctcgccgcgtgaatcgcacggaatcgccgctgtgagatggcggtctcctccgcgttcgagccctccgcggagatggagcggttcctctgcgagcgactgctggacgcggaccagcccatcgcggagcgcttccgggcgctcttctccctccgcaacctccgcggggacgccccgcgccgcgccctcctccaagctgcaagggatccttctaacttgctgacccatgaggctgcatttgcactagggcagatgcaggatgctgaggctattcccgcattagtggcagttctcaaagatctttctctacatccaattgtacgccatgaggctgccgaagctcttggagctattggcctggaaaagagcatccccctgttggaggaaagtttaacagctgatcctgctgtggaggtacaagaaacttgtgagctggcactaagacggatagaagagcagaagaaagttaatggggctgagagtacaaccacttcaccgtatctctcagttgatccagcactgcctgcgaaacatggactttcagtagaccaattaagggatcttctcctcaatgagcaagaaagcatgtacgaacgttatgcagctctttttgcacttaggaatgatggtggagatgctactgtttctgctattgttgcagc

SEQ ID NO: 47303 - protein, 207 aa, Panicum virgatum
  misc_feature: Ceres CLONE 2035339
  misc_feature (61)..(87): Pfam Name: HEAT_PBS Pfam Description: PBS lyase HEAT-like repeat
  misc_feature (94)..(120): Pfam Name: HEAT_PBS Pfam Description: PBS lyase HEAT-like repeat
  misc_feature: SWISSPROT Homolog: EC 1.14.99.29 Deoxyhypusine monooxygenase
MAVSSAFEPSAEMERFLCERLLDADQPIAERFRALFSLRNLRGDAPRRALLQAARDPSNLLTHEAAFALGQMQDAEAIPALVAVLKDLSLHPIVRHEAAEALGAIGLEKSIPLLEESLTADPAVEVQETCELALRRIEEQKKVNGAESTTTSPYLSVDPALPAKHGLSVDQLRDLLLNEQESMYERYAALFALRNDGGDATVSAIVA

SEQ ID NO: 47304 - DNA, 684 bp, Panicum virgatum
  misc_feature: Ceres CLONE 2035345
  misc_feature: Encodes the peptide sequence at SEQ ID NO. 47305
acacagcaaacggggaatcggaaacccggatagagcgccgccccgccccacccccgcccggcgacgagattccgctcccgcgccgccaccgcaccgagccgaaaggaaggcgaggagggaggtgaaacatgacgaccatccgccggttctgctgcgacgacctcctccgcttcgcctccgtcaacctcgaccacctcaccgagacgttcaacatgtcgttctacatgacgtacctggctcgctggcccgactacttccacgccgccgtcagccccgcggaccgcgtcatgggatacatcatgggcaaagtggaaggacaaggtgaatcttggcacggtcatgttacagccgtgtctgttgcatcagaattccgtaggcagaagttagccaagaagcttatgcatttgctggaggaaatcagtgataagatggataaggcctactttgtggatctctttgtaagagcatctaatatgccagcaataaggatgtatgaaaagcttggttacgttgtttatcggagggtgcttcggtactactcaggggaagaagatggccttgatatgcgtaaagcactgtcacaagatgttgaaaagaagtccattataccgctcaagaggccaatcacacctgatgaacttgaatatgattgatgctgaaaatctagctagtgcagtatggtat

SEQ ID NO: 47305 - protein, 174 aa, Panicum virgatum
  misc_feature: Ceres CLONE 2035345
  misc_feature (45)..(128): Pfam Name: Acetyltransf_1 Pfam Description: Acetyltransferase (GNAT) family
  misc_feature: SWISSPROT Homolog: EC 2.3.1.88 Peptide alpha-N-acetyltransferase
MTTIRRFCCDDLLRFASVNLDHLTETFNMSFYMTYLARWPDYFHAAVSPADRVMGYIMGKVEGQGESWHGHVTAVSVASEFRRQKLAKKLMHLLEEISDKMDKAYFVDLFVRASNMPAIRMYEKLGYVVYRRVLRYYSGEEDGLDMRKALSQDVEKKSIIPLKRPITPDELEYD

SEQ ID NO: 47306 - DNA, 689 bp, Panicum virgatum
  misc_feature: Ceres CLONE 2035355
  misc_feature: Encodes the peptide sequence at SEQ ID NO. 47307
acagccagtctttcactcggtcactcccttgctggctgctgcgcaccggcgaagggaagacaagctcggcggcagcatttctgccggcaaaggattgggcgcacggcacagcgacgctgctcctcgattccccaatcctccaaatcctaggagacttaattttgaggccatgagttctgtcaaaaaggccaatgtgacacctacatttgctgtgacttcggaccaaattagcagtctacctctggagctaaagggcaaaatcctctctaaattgaatgtagaagaggctgttagagctagtgtcctatcgagtgcttggaggaatgtgtggactactatgccaagaatatgtctgagggaaaacaacttcgtttcctctaaagctcctacaagtgcttcctctagatttcctttaagtggacaatcaaagtttgttacattggtcgatctagcactatcacttcacaagggatctctagattcttttacgatttgggggaagcaaaactacaatgatgtatttccaaggtggatgtacatgctttcaaccaaaagaccaagattcattaaaatcaagctaatttctggcccaaagcataagattccgtcgaacattttctcaatcagcgagttaaagcatctgtgctgaagaaactgcatcatcagcttgcctaaggattttgaaggtt

SEQ ID NO: 47307 - protein, 159 aa, Panicum virgatum
  misc_feature: Ceres CLONE 2035355
  misc_feature (18)..(65): Pfam Name: F-box Pfam Description: F-box domain
MSSVKKANVTPTFAVTSDQISSLPLELKGKILSKLNVEEAVRASVLSSAWRNVWTTMPRICLRENNFVSSKAPTSASSRFPLSGQSKFVTLVDLALSLHKGSLDSFTIWGKQNYNDVFPRWMYMLSTKRPRFIKIKLISGPKHKIPSNIFSISELKHLC

SEQ ID NO: 47308 - DNA, 686 bp, Panicum virgatum
  misc_feature: Ceres CLONE 2035367
  misc_feature: Encodes the peptide sequence at SEQ ID NO. 47309
atgtggcgcactcgcactcgattgcattgcagcgcaacatcgcattcacacggcgcccaaattagcaagtgatcgaagcaccaagcaagccgggcggcatggcggaccagctcatctccacggccgtgcacgaccagctgccggagaactacgtccggccggagacgcagcgcccacgcctccacgaggtcgtctccgacgcgcagatccccgtcgtggacctcgccgaccccgacctcgccgccgtcgtcgcccggatcggcgaggcctgcgccacccacggcttctttcaggtgctcaaccatggggtgcccgtggagctgatggacgccatgctggcggtggcgtacgacttcttccggctcccgccggaggagaaggccaagctgtactccgacgacccggccaagaagacgcgcctgtccaccagcttcaacgtgcgcaaggagacggtgcacaactggcgcgactacctccgcctccactgccacccgctcgagcagtacgtccccgactggccggccaatccgccgtccttcagggagatcgtgagcgcctactgccgagaggtccgggggctcgggttccggctgtacgcggccatctccgcgagcctgggcctggaggaggagtacgtgaagaaggcgctgggcgagcaggagcagcacatggcagtgaacttctac

SEQ ID NO: 47309 - protein, 195 aa, Panicum virgatum
  misc_feature: Ceres CLONE 2035367
  misc_feature: SWISSPROT Homolog: EC 1.14.11.9 Flavanone 3-dioxygenase
MADQLISTAVHDQLPENYVRPETQRPRLHEVVSDAQIPVVDLADPDLAAVVARIGEACATHGFFQVLNHGVPVELMDAMLAVAYDFFRLPPEEKAKLYSDDPAKKTRLSTSFNVRKETVHNWRDYLRLHCHPLEQYVPDWPANPPSFREIVSAYCREVRGLGFRLYAAISASLGLEEEYVKKALGEQEQHMAVNF

SEQ ID NO: 47310 - DNA, 704 bp, Panicum virgatum
  misc_feature: Ceres CLONE 2035369
  misc_feature: Encodes the peptide sequence at SEQ ID NO. 47311
agccgctgccaattcctccactccattgagcctccccgcacgcacgcagtgggaagtggcgcgcgcgactccgccatggctctcgccgcctcccaccatggcctcgccgcagtcgccccctccgcatcttccgcctccgcggcctcccgcgtgccgcgaggagggttcctccgcttccacgccgctccccctgccccgctcgcgaccgcacggagagtatgttgccagtctatcaattcagctaatgtgctgggagcttcttcatcaaaagctgatgaggcagtcccagttccagttgtcatgatagatcaagattcagaccgtgattcaaccattgtgcagttgagttttggagaccggttgggggctttgcttgacacgatgaaggcactcaaggaccttggccttgatgtcaagaaaggaactgtgacaactgactctgatgtcacacaaacaaagttccacattatgcgattcgggcgcaaagttgaggaccctgacatgttagagaggatacggctaactgtcattaacaaccttctgaaataccatcctgaatcaagtgagaagttagcaatgggtgaattttttgggataaaacctcctgagaagaaggttgatattgatattgcaactcatgtggttgttgaagatgacggaccaaaaagaagcacgctttacatagagaacgctgatcggcctgg

SEQ ID NO: 47311 - protein, 209 aa, Panicum virgatum
  misc_feature: Ceres CLONE 2035369
  misc_feature: Functional homolog of the protein sequence given in SEQ ID NO 50834
  misc_feature: Useful for making plants with altered alkaloid content
  misc_feature: Useful for making plants with altered lignin content
MALAASHHGLAAVAPSASSASAASRVPRGGFLRFHAAPPAPLATARRVCCQSINSANVLGASSSKADEAVPVPVVMIDQDSDRDSTIVQLSFGDRLGALLDTMKALKDLGLDVKKGTVTTDSDVTQTKFHIMRFGRKVEDPDMLERIRLTVINNLLKYHPESSEKLAMGEFFGIKPPEKKVDIDIATHVVVEDDGPKRSTLYIENADRP

SEQ ID NO: 47312 - DNA, 727 bp, Panicum virgatum
  misc_feature: Ceres CLONE 2035387
  misc_feature: Encodes the peptide sequence at SEQ ID NO. 47313
atatcgccagggccaccattccaccaagctcttccccttgctcagcacttcagcagtcagcagcggcctccccatcagaagcctagctagcagctcttcctcgccccaacagccgtttcccagatctttttcagcaccggcactccaccagggcacagcaagggcatctactctgcacttcgcctgatccagtccaaccggagagggtggaaaccattggactctgcatagaagcttcctgatatttctaagggacgataaggcagggaatgagtacaaccaaggtgaagagacgtgtggggaagtatgagctcggtcggaccataggtgaaggcacattcgcaaaggtcaggttcgcgaaggacactgagacaggcgaacctgtagctatcaagatcatagataaggagaaggtcctcaagcacaagatggttgagcagattaagcgggaaatttcaacaatgaagttgatcaagcatcctaatgttgttcgcatatatgaggtgatgggaagtaaaacaaagatatacattgtgttagaatttgctacaggtggtgagctctttgacataattgctaaccatggtcgaatgagggaagatgaggcaaggaggtatttccaacaattaatcaatgcagttgattattgtcatagcaggggtgtgtaccaccgggatctaaaagtctccgactttgggctgagcgctctatctcagcagatcaagga

SEQ ID NO: 47313 - protein, 152 aa, Panicum virgatum
  misc_feature: Ceres CLONE 2035387
  misc_feature (13)..(151): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MSTTKVKRRVGKYELGRTIGEGTFAKVRFAKDTETGEPVAIKIIDKEKVLKHKMVEQIKREISTMKLIKHPNVVRIYEVMGSKTKIYIVLEFATGGELFDIIANHGRMREDEARRYFQQLINAVDYCHSRGVYHRDLKVSDFGLSALSQQIK

SEQ ID NO: 47314 - DNA, 687 bp, Panicum virgatum
  misc_feature: Ceres CLONE 2035391
  misc_feature: Encodes the peptide sequence at SEQ ID NO. 47315
gcaacttccatgatctccccaataattttttctggtccttccatgccatgccaattctttttaccggaaatggaaaagtttggaaggaccatgagctagcagctgccatccactacctcactccctcttcccctcagccctcacacctcactcactcactcactcactccaccaacttgcttcagagtcctaaccatcttcctctccccttacccaacaagaaccccaaggctgtgaagggcatgtgggttgatctgctccaagaacttgttgtcgatctcggcgtggtttcagtttgagctgtcgtttgatttaccgggcattagctatggcaggctgatgttccacaagcgatgaaactgcacactgcagtgtttgttcatcttgacctcggtgatcttgattgagcacaccagttaccagttaccacccagctgggtcatggcgtattccgggcaaaggcacggtggtgttgggagctcatcaaggccagggaatggcttcaaggggcctgccaactcggtcgagtttctgggaaggggaatactggaaatgcaattgagcgatgccaaagcagatgctgatgatgaaagggacatggggtcaggctcagatgtgactgataattctagtaatgaagctagtcacataaaagcgactacaattcgtggggcacaagggcccggc

SEQ ID NO: 47315 - protein, 81 aa, Panicum virgatum
  misc_feature: Ceres CLONE 2035391
  misc_feature: SWISSPROT Homolog: EC 2.7.11.1 Non-specific serine/threonine protein kinase
MAYSGQRHGGVGSSSRPGNGFKGPANSVEFLGRGILEMQLSDAKADADDERDMGSGSDVTDNSSNEASHIKATTIRGAQGP

SEQ ID NO: 47316 - DNA, 682 bp, Panicum virgatum
  misc_feature: Ceres CLONE 2035402
  misc_feature: Encodes the peptide sequence at SEQ ID NO. 47317
agttccagcacgatccgtgcatcagtgaccagtccccagtctcgccaactcgccgctccttctgcaccaccacttgctagctccacagatcttgccgtcgtcttcgatccagtgcagtacgttgagctcgcaacagcagcttcgcctctcgatcgactccgactacttagcatggcgcgttgcggcgtcgacgtgacgctgctcttggtggctctctgtaccctgttgccggcagtcaccgttgccgatctccaggaaggcttctacaagagcagcaccaactgcagcgtcgacgtcgaggccaccgtgacgagcgtcgtccagcagtacgtctccgcggaccgcggcgtcggcgcggggctcatccgcctccacttccacgattgcttcgtcaaggtccgtacccaatcttgggcgagtagagtagcttgacacgaagctgaattgatgtgtgcaacgtgccagggctgcgatgcttcggtgctcatcgatccgagccccgtccacccggaccccgagaaggggtcgccgtcgaacggcggcctccgcgggctcgaggtgatccacgacgccaagcggcggctcgagggcgcgtgcccggggaccgtgtcctgcgccgacatcctcgccttcgccgcgcgcgacgcggccaacgtcctgagcgccggggcgatcaactacg

SEQ ID NO: 47317 - protein, 78 aa, Panicum virgatum
  misc_feature: Ceres CLONE 2035402
  misc_feature: SWISSPROT Homolog: EC 1.11.1.7 Peroxidase
  misc_feature: Functional homolog of the protein sequence given in SEQ ID NO 51005
  misc_feature: Useful for making plants with altered carbohydrate content
  misc_feature: Functional homolog of the protein sequence given in SEQ ID NO 51733
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51417
  misc_feature: Useful for making plants with modulated oxidative stress sensitivity
MCATCQGCDASVLIDPSPVHPDPEKGSPSNGGLRGLEVIHDAKRRLEGACPGTVSCADILAFAARDAANVLSAGAINY

SEQ ID NO: 47318 - DNA, 718 bp, Panicum virgatum
  misc_feature: Ceres CLONE 2035408
  misc_feature: Encodes the peptide sequence at SEQ ID NO. 47319
caagcctgcaactagctgatgcgagacagtggtgaccacgcaccgacgagcaacgagtgagacctctgcatcaacgaccaaccgcgagccaagcgacgaccgacactagctagctggtagcaaccaagcaggatggcagcgcatcacctcctcctgctgctcgccgcgctgctcccggcggcggcaacggcagaccccgacgccgtgcaggactactgcgtgccggacgccggcgggcgcgggcggccgctggagctggcgctgctgccgtcgtacccgtgccggagccccggcaacctgacggcggccgacttcgcgttcgccggcgtgcgcgccgcgggcaacttctccgcggacacgggcttcgcgggggtgtccgtcacgcccgcgcagttcccggcgctgcacaccctgggcgtctccttcgcccgcgccgacctctccgcggcgggcggggtgaaccctccgcactaccacccgcgcgccaccgagacggcgctcgtcctggcgggccgcgtctacgcgggcttcgtcgactccggcggccgcatcttcgccaaggtgctcgagaaaggggaggtcatggtgttccccagggccatggtgcacttccagatgaacgtcggcgacgagccggccaccgtgtacggcacgttcaacagcgagaaccccggcatcgtgcgcatcccggccaccgtgttcgggtccgggatcagcg

SEQ ID NO: 47319 - protein, 195 aa, Panicum virgatum
  misc_feature: Ceres CLONE 2035408
  misc_feature (64)..(190): Pfam Name: Cupin_1 Pfam Description: Cupin
  misc_feature: SWISSPROT Homolog: EC 1.2.3.4 Oxalate oxidase
MAAHHLLLLLAALLPAAATADPDAVQDYCVPDAGGRGRPLELALLPSYPCRSPGNLTAADFAFAGVRAAGNFSADTGFAGVSVTPAQFPALHTLGVSFARADLSAAGGVNPPHYHPRATETALVLAGRVYAGFVDSGGRIFAKVLEKGEVMVFPRAMVHFQMNVGDEPATVYGTFNSENPGIVRIPATVFGSGIS

SEQ ID NO: 47320 - DNA, 618 bp, Panicum virgatum
  misc_feature: Ceres CLONE 2035420
  misc_feature: Encodes the peptide sequence at SEQ ID NO. 47321
cccacccaacagctcgcatccggtcgctcgccatggacgcagccgtcgccgcgcagcaggcgaggcgccggatccggccgccggagccgctcgtgatggccgcggcgccgccgacgccggccgcgttccggtgcccgatctcgctggaggtgatgcggtcgccggtcagcctccccaccggcgccacgtacgaccgcgcgtccatacagcggtggctcgattccggccaccgcacctgccccgctacgcggctgccgctggcgtccaccgacctggtccccaacctgctcctgcgccgcctcatccacctgcacgccgccacgatgccgccgtcgccgtcgcccgaggaggtgctgtcgcagctcgcggccgcggacggggagcccgcggcggcggagaaggccgtgcgctcgctcgcggccaagatcgcgccggataaagggaagcgcgcgtccgtcgcgtcggcggtcgccgccgatctcgactccgcggtgccggcgctcctctccttcgcgaagggcggggcgggcgccgacgcgcgcgtggacgccgtgaggatcctggctaccgtggccccggagctggtcgcttatctctcgggaggatgggatggagaaa

SEQ ID NO: 47321 - protein, 195 aa, Panicum virgatum
  misc_feature: Ceres CLONE 2035420
  misc_feature (29)..(101): Pfam Name: U-box Pfam Description: U-box domain
  misc_feature: SWISSPROT Homolog: EC 5.2.1.8 Peptidylprolyl isomerase
MDAAVAAQQARRRIRPPEPLVMAAAPPTPAAFRCPISLEVMRSPVSLPTGATYDRASIQRWLDSGHRTCPATRLPLASTDLVPNLLLRRLIHLHAATMPPSPSPEEVLSQLAAADGEPAAAEKAVRSLAAKIAPDKGKRASVASAVAADLDSAVPALLSFAKGGAGADARVDAVRILATVAPELVAYLSGGWDGE

SEQ ID NO: 47322 - DNA, 664 bp, Panicum virgatum
  misc_feature: Ceres CLONE 2035446
  misc_feature: Encodes the peptide sequence at SEQ ID NO. 47323
gtctctcccatttcctttcttcccgtgggatccaagccgccgccgcgagaagaagagctcggcgactcacggtctcacgagaagatgccgaagcagatccatgagatcaaggacttccttctcaccgcgaggaggaaggatgcccggtctgtgaagatcaagaggagcaaggatgttgtcaaattcaaggtgcgctgctccaagtacttgtacaccctctgcgtcttcgatgctgagaaggcaatcaagttgaagcaatctcttcccccaggtttgaccgtccaggaggtttgaagggacacaacaagacaacatcaagatgggaactaccaaagcttccttatcatcagcagcgcattctcgtctatgtacctttggaacctatgcttttagacctgtcagtcatggatttgtagatcttggattttgggagaaataccattttaccgtattccaggatgcagcttttcaatttgattctttaatgagctccatgctgcttgagaatttcaccctgttcggctgctgggcggctgcggctgctcggctgctgctggcgcctgcggcgtgagtgtagaaccagcccagagcagccggccgggcaccagccaagcaaccagccgaacacaggcttgtttgttctacttcttttcggtttaccact

SEQ ID NO: 47323 - protein, 69 aa, Panicum virgatum; identical to SEQ ID NO: 43350
  misc_feature: Ceres CLONE 2035446
  misc_feature (2)..(69): Pfam Name: Ribosomal_L38e Pfam Description: Ribosomal L38e protein family

SEQ ID NO: 47324 - DNA, 656 bp, Panicum virgatum
  misc_feature: Ceres CLONE 2035452
  misc_feature: Encodes the peptide sequence at SEQ ID NO. 47325
agaacaaaagacaaccagacatctgatccacaacaccacactcgctaggtagcgagacctgtcgagaggaaccaccgaccggtgcaacatggagtacggccagcaggggcagcacggccacggaaccactggccgcgtcgaccagtacggcaacccggtgggcggcgttgggcacggcaccgggaccgggaccggcggcatgggccagctgggggagcacggcggcgccggcatgggtggcggccagttccagcctgcgagggaggagtacaagaccggcggcgtcctgcaccgctccggcagctccagctccagctcggtaactaaccacttgcatccttccttttttgttttctcagcatcttctcccaggcattaattgcttaacttgattgatcctttctttcgtgatttgtagtccgaggacgacggcatgggcgggaggaggaagaagggcattgaggagaagatcaaggagaaattgcccggaggccacaaggacgaccagcacaccacggccaccggcggtgcctacgggcagcagggacacaccggcatgactggcacgggaaccggcggcgccgcctacaccgagggcaccggcgagaagaagggcatcatggacaagatcaaggagaagctgcccggacagcact

SEQ ID NO: 47325 - protein, 96 aa, Panicum virgatum
  misc_feature: Ceres CLONE 2035452
  misc_feature (14)..(96): Pfam Name: Dehydrin Pfam Description: Dehydrin
MEYGQQGQHGHGTTGRVDQYGNPVGGVGHGTGTGTGGMGQLGEHGGAGMGGGQFQPAREEYKTGGVLHRSGSSSSSSVTNHLHPSFFVFSASSPRH

SEQ ID NO: 47326 - DNA, 699 bp, Panicum virgatum
  misc_feature: Ceres CLONE 2035454
  misc_feature: Encodes the peptide sequence at SEQ ID NO. 47327
aagtttccttttttcttcttttgttggttatagggaaaccattctttgttgtttggctattcttaaaagtttaaatgggatcagaaggaccttcagctgtgactgtccatgttactggattcaagaagtttattggagttcctgagaaccctactgagaaaatagtgagcaatcttcaatcttatatggaaaagaaaggcttgccaaaaaaccttgtactcggcagctgcactgttctcgaagctgcagggcagggtgcacttggcacactatatgaagttttagagtctgctatttcaaacagacaggaagggtcgcaaataatttggatccactttggggttagtggtggtttaccaagatttgcgcttgagaatcaagctgttaatgatgccacattcgcttgtcctgatgagctaggatggaaacctcagagggtccctattgtagcatctgatggaaacatctcacgggttagaaagactacccttccagttaatgaattagtcaagattcttcgaaagattggccatgatgtgatgcgttcagatgatgctgatcgatttttatgcaactatgtgtattatcattctctccgcttcgccgaggaacatggcatcaaatctctgtttgtgcatgtgcccctcttctcgacaattgatgaagcagttcagatgcattttgttgcttcccttcttg

SEQ ID NO: 47327 - protein, 208 aa, Panicum virgatum
  misc_feature: Ceres CLONE 2035454
  misc_feature (11)..(208): Pfam Name: Peptidase_C15 Pfam Description: Pyroglutamyl peptidase
  misc_feature: SWISSPROT Homolog: EC 3.4.19.3 Pyroglutamyl-peptidase I
MGSEGPSAVTVHVTGFKKFIGVPENPTEKIVSNLQSYMEKKGLPKNLVLGSCTVLEAAGQGALGTLYEVLESAISNRQEGSQIIWIHFGVSGGLPRFALENQAVNDATFACPDELGWKPQRVPIVASDGNISRVRKTTLPVNELVKILRKIGHDVMRSDDADRFLCNYVYYHSLRFAEEHGIKSLFVHVPLFSTIDEAVQMHFVASLL

SEQ ID NO: 47328 - DNA, 680 bp, Panicum virgatum
  misc_feature: Ceres CLONE 2035455
  misc_feature: Encodes the peptide sequence at SEQ ID NO. 47329
ctagccattcccctcctctcccgcgccgccgccgccgccgtttttgccctcctcgcggtcccgccgtccgtcgaggtaaggtcagcatggtgagggtcagtgtgctcaacgatgcactgaagtccatgtacaatgctgagaagagggggaaaagacaggtcatgatcaggccgtcatccaaggttatcatcaagttcttgttggtcatgcagcgtcatggctacattggtgagttcgaatatgtggatgaccaccgtgctggaaagattgtggtggaactgaatggaagactaaacaaatgtggtgtgatcagccctcgctttgatgttggtgtaaaggagattgaaggttggactgccaggctgctcccatctcgtcagtttggctacatagtgttgacaacttctgctggcattatggaccatgaggaggcccggcggaagaatgttggtggcaaggtgctaggtttcttctactgaagcgagtacaatgaaagtattaggatattcccaagaactcatctgagcttgtgttttttggtctgaatagagtgccttgttaagattctggaatgtgttatgtacttcagaaattgggaaccttgttatgagctgtgcctgccgttaattatcatgacatatttgcccatcttaaattttccatctggccatcacaaagga

SEQ ID NO: 47329 - protein, 130 aa, Panicum virgatum; identical to SEQ ID NO: 31874
  misc_feature: Ceres CLONE 2035455
  misc_feature (5)..(130): Pfam Name: Ribosomal_S8 Pfam Description: Ribosomal protein S8

SEQ ID NO: 47330 - DNA, 732 bp, Panicum virgatum
  misc_feature: Ceres CLONE 2035538
  misc_feature: Encodes the peptide sequence at SEQ ID NO. 47331
cttactccattcccaccctccccgccgccaccgccgccgccgcagccaaaaccctaaaacctacacccaccgatggcggcgagcagcgcggacctcgctgacgatggcttcgctgcgccgcgcctcttctcccagggcgtctcctacacctacgacgacgtcatcttcctcccgggctacatcggcttccccgccgacgccgtcgacctctccacccgcctctcccgtcgcctgcctctctccatcccctgcgtcgcgtcccccatggacaccgtgtccgaggcagccatggccgcggccatggcctcgctaggcgccgccgccgtagtgcactgcaacaccgagcccgaggcccaggccgccatcatccgcgccgccaagtcccgccgcctccctttcgtgtcatccgtgcccttcttcgccccgtcctccgctccgacgctcaacgattttgctggcaatgaatacgccatcgttaccgagcgcggggattcgctctccaggctcgtcggcgtcgctgttgcagccgatgcggcctctcgcgaggttcctgcccctgtctcggaatacatgcggcccgctccccgctcagcatccgcctccttcgacttcgagcaagcagccgccttccttgccgacgagggtttggattacgcccctctcgtttccgacgacggcgaggttattgatctgatcaccgccaaggatgtcgagcgcatccggagctatccc

SEQ ID NO: 47331 - protein, 219 aa, Panicum virgatum
  misc_feature: Ceres CLONE 2035538
  misc_feature (23)..(218): Pfam Name: IMPDH Pfam Description: IMP dehydrogenase / GMP reductase domain
  misc_feature: SWISSPROT Homolog: EC 1.1.1.205 IMP dehydrogenase
MAASSADLADDGFAAPRLFSQGVSYTYDDVIFLPGYIGFPADAVDLSTRLSRRLPLSIPCVASPMDTVSEAAMAAAMASLGAAAVVHCNTEPEAQAAIIRAAKSRRLPFVSSVPFFAPSSAPTLNDFAGNEYAIVTERGDSLSRLVGVAVAADAASREVPAPVSEYMRPAPRSASASFDFEQAAAFLADEGLDYAPLVSDDGEVIDLITAKDVERIRSY

SEQ ID NO: 47332 - DNA, 685 bp, Panicum virgatum
  misc_feature: Ceres CLONE 2035544
  misc_feature: Encodes the peptide sequence at SEQ ID NO. 47333
agcggcacattagccgactcggaagtcgctttgagtcgtcatcagaagctagcccatgggcagtagttctcaggacaccagcccggtatatgtgtgggttcatcgttacggcatcagcagggcttcagcccagcccacacaatgctgcaggcgaggtaacgcatcgaattatcgatctccatccagctcgaggaaattctcaaaaaaaaaaaaaatccagctcgaggcatctcctataattcctaaagacgtcagatggttcgctggctacggaccagggcgtcttggagcagatggcctctgattttttcagggatttgttcacagcacaagagcagctgcagccggacctggtgtgccaatacgtcccgcgcaaggtctcggcccatatgggggagatgctcgagaggccttttactgcagatgagattaaagtggccatctcccaaatgaagcctgggaaagctccgggggaggacggtttcacggcaggttttttccagaaacactgggagctggtaaaaaatgatattacacaagcagttcttggttttcttaatgggggagacatgccggaggtaattaatagaacgatcttggtcttgattccgaaggtagctaacccgcaagaattaactcaattccggcctatttctctgtgcaatgttatttacaaaatctgctc

SEQ ID NO: 47333 - protein, 130 aa, Panicum virgatum
  misc_feature: Ceres CLONE 2035544
  misc_feature: SWISSPROT Homolog: EC 2.7.7.49 RNA-directed DNA polymerase
MASDFFRDLFTAQEQLQPDLVCQYVPRKVSAHMGEMLERPFTADEIKVAISQMKPGKAPGEDGFTAGFFQKHWELVKNDITQAVLGFLNGGDMPEVINRTILVLIPKVANPQELTQFRPISLCNVIYKIC

SEQ ID NO: 47334 - DNA, 673 bp, Panicum virgatum
  misc_feature: Ceres CLONE 2035550
  misc_feature: Encodes the peptide sequence at SEQ ID NO. 47335
aacatgaaaacgtgactcaattggtcttagttagtcttcgggacggagtggaagaagggcggagactctcgaacgaggaaaaggatcccttcgaaataattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatgtggggtcaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaat

SEQ ID NO: 47335 - protein, 56 aa, Panicum virgatum
  misc_feature: Ceres CLONE 2035550
  misc_feature (1)..(55): Pfam Name: Ribosomal_S7 Pfam Description: Ribosomal protein S7p/S5e
MSRRGTAEKRTAKSDPIFRNRLVNMVVNRIMKDGKKSLAYQILYRAVKKIQQKTET

SEQ ID NO: 47336 - DNA, 691 bp, Panicum virgatum
  misc_feature: Ceres CLONE 2035557
  misc_feature: Encodes the peptide sequence at SEQ ID NO. 47337
aaaattcgacgacgcgaggaatcgaagcagcaacagcaaactaacagcacagcagcagcatcaagttcaggttcgctctcaggcaggctttcagctaactccatctgccatgtcgctggtgcggagcggcggcggcgtgttcgacccgctgtcgctggacttctgggcgtcggcggacccgctgggcgtcgtccgcccgctggcggagcagtgccccgtgctcaccaacgtgtgcgtggactggaaggagacccccgccgcgcacgtgctcagggccgacctgccgggcgtcggcaaggacgccgcccgggtagaggtggaggacggcggcgtgctcgtcatcagcggcgagcgcgccagggaggagccccgcgagggcgaggcgtggcgccgcgtcgagcgcagcagcggcaggttccagcgccgcttccgcctcccgcgcggggcaaggctggaccaggtgagcgcggccatggaggacggcgtgctcaccgtcaccgtgcccaaggaggaggccaagaagccgcaggtcaagaccgtcgagatctcgggctgatccgatccatcggttttcgttggacggccatgaacgatgatcgagatcagagcctctgttgatgttcatcaactgcaagtctgcaagtactacgtcccgtgtcgtgtcgttcgtattattggtgtctcatgtagt

SEQ ID NO: 47337 - protein, 148 aa, Panicum virgatum
  misc_feature: Ceres CLONE 2035557
  misc_feature (44)..(147): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRSGGGVFDPLSLDFWASADPLGVVRPLAEQCPVLTNVCVDWKETPAAHVLRADLPGVGKDAARVEVEDGGVLVISGERAREEPREGEAWRRVERSSGRFQRRFRLPRGARLDQVSAAMEDGVLTVTVPKEEAKKPQVKTVEISG

SEQ ID NO: 47338 - DNA, 722 bp, Panicum virgatum
  misc_feature: Ceres CLONE 2035562
  misc_feature: Encodes the peptide sequence at SEQ ID NO. 47339
atctcctccgccccctccccgcgccgccgctcgcctccgcccgcgacgccacctgcagatacctgaatggctgccgcaaggggcattaaccagcttctgaggagaactctccagaaccagtcatctggttcatcgctgctttcttcgtttcggggaaagcatgaagagtcctctgctggactcagagcattggctcttcttggagttggtgcctctggtcttttcagttttgctacaatagcatctgcagatgaagctgagcatggcttggcagccccagattacccctggccacatgctggaatcatgagctcttatgatcatgcatcaattcggcgtggacaccaagtttacacacaagtttgtgcctcttgtcactccatgtccttgatttcgtaccgtgatttggttggggtagcgtatactgaagaggaaacaaaggcaatggctgctgagattgaggtagttgatggtcctaatgatgagggtgaaatgttcacccgccctggtaaactgagtgaccgcttcccacagccctatgcaaatgagcaagcagcccgatttgcaaatggtggtgcataccctccagacctcagtcttatcacaaaggcgaggcacaatggtcagagctacgtttttgctctccttactggttatcgtgagccacctgctggagttcagattcgtgagggtctgcattacaatccctactttccctggtg

SEQ ID NO: 47339 - protein, 218 aa, Panicum virgatum
  misc_feature: Ceres CLONE 2035562
  misc_feature (69)..(217): Pfam Name: Cytochrom_C1 Pfam Description: Cytochrome C1 family
  misc_feature: Functional homolog of the protein sequence given in SEQ ID NO 51401
  misc_feature: Useful for biocontainment applications
  misc_feature: Useful for making plants with modulated biomass
MAAARGINQLLRRTLQNQSSGSSLLSSFRGKHEESSAGLRALALLGVGASGLFSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQSYVFALLTGYREPPAGVQIREGLHYNPYFPW

SEQ ID NO: 47340 - DNA, 676 bp, Panicum virgatum
  misc_feature: Ceres CLONE 2035572
  misc_feature: Encodes the peptide sequence at SEQ ID NO. 47341
ggttgctgaagagctgatctttggggaagacaatgttacaactggggcacgaaatgatcttcatactgcaacggagcttgcccagtacatggtatcaaactgtgggatgagtgatgctattggtcctgtgcatgtgaaagagcggccaagtgtagagatgcaatcgaggatagatgctgaggtagtgaagctcctaagagaggcttatgggcgggtcaagcgtttgcttaagaagcatgagaagcaattacatgcgttagcaaatgcgctgctggagcatgaaacacttactgcggatgagatcaacaaagtagttcatccataccaagaagagccccagttctccttccaagatgaggagtttgccctcacttaaaagattctttcgttacatccggacagcattcaccaactgtgaattgtaaatccatgtacagtaaatggtgcctagatgaaccatggaagttctttcagacatcccccttctgtaaaatggggtacaaaacctgtggtgcattttcttcacggcaccattttcatttggtgaacaggcaagcatcagaagaagatatttgcaaagggtgatacaagcttatggataattctttcattggaagaccaccatggtccctggcgaagctttggattgcaaagccccctcatactttttagttag

SEQ ID NO: 47341 - protein, 124 aa, Panicum virgatum
  misc_feature: Ceres CLONE 2035572
  misc_feature (1)..(104): Pfam Name: Peptidase_M41 Pfam Description: Peptidase family M41
  misc_feature: Functional homolog of the protein sequence given in SEQ ID NO 51612
  misc_feature: Useful for making plants with modulated heat sensitivity
VAEELIFGEDNVTTGARNDLHTATELAQYMVSNCGMSDAIGPVHVKERPSVEMQSRIDAEVVKLLREAYGRVKRLLKKHEKQLHALANALLEHETLTADEINKVVHPYQEEPQFSFQDEEFALT

SEQ ID NO: 47342 - DNA, 615 bp, Panicum virgatum
  misc_feature: Ceres CLONE 2035579
  misc_feature: Encodes the peptide sequence at SEQ ID NO. 47343
acacaccagtcaactttttcaaatcatctgcaactctaaggagagacagtacactagctagctgtgctgatcgagtctagaacactctagaaggttccattggatcgacgatggaccgcgtggcgaggctggcgtcggagcgggcggtggtggtgttcacggcgagcaactgcagcatgtgcgacgtggtgacgtcgctgctgggcagcctgggcgtgaacgcggccgtgcacgagctggacagggacccccgcggccgggagatggagcgggagctcgccaggaggctcggcgccggcgccggcggtgccgtgcgcggcggcgtcacacccaccgtgccggcggtgttcgtgggcggcgacctcgtcggcggcaccaacagagtcatggcgctgcacctcgccggcgagctcgtgcccatgctcaggaacgccggcgcgctctggctctaggagctcagaacgccggcggcgctcatgcaaagcatgtcttagctttttttcgtcagacgtgtacgagtgcgtgaatgccaggttttttttgtatcctgtgcttgtaataagtcaaataaatatcgcatcagtattaaacatgattttcgatatctattacttt

SEQ ID NO: 47343 - protein, 113 aa, Panicum virgatum
  misc_feature: Ceres CLONE 2035579
  misc_feature (13)..(86): Pfam Name: Glutaredoxin Pfam Description: Glutaredoxin
MDRVARLASERAVVVFTASNCSMCDVVTSLLGSLGVNAAVHELDRDPRGREMERELARRLGAGAGGAVRGGVTPTVPAVFVGGDLVGGTNRVMALHLAGELVPMLRNAGALWL

SEQ ID NO: 47344 - DNA, 718 bp, Panicum virgatum
  misc_feature: Ceres CLONE 2035615
  misc_feature: Encodes the peptide sequence at SEQ ID NO. 47345
acaggagcccgcggagtgatcaaaaaagcaagtaacaagagaagatgaccgacgttgtgatgaccatcagtactaccacggatttggaaagagaactgaataaacccgacaagctggtatcaagcttttctctcgcgtttttttttcttttttttattgagactctaatttatgtaaaatttatctatctttgtctctcttcccctatctctctcccccactttgaaagattgtgctggagttcatggcgccgtggagcgagccatgcaaggtcatgaaggaaccttataggcgaatcgctagagcaagaaaagacagagtcaacttctacacgctcaacgtcgacaagttcaaagatttggcggaggaagctggcgtggaggcgctaccgacgtacgttctactgaagaatgacgatgtgatggacatggtcgttggcgtcaggaggcacgagctcgagaacgccataaaaaacaatacctaacgactgatccgatcagatcatccatgcgtcgagaacgaacgggaaatgaatgattcatagttaaataagcccactactgtacgtcccatgtgttgtatcacggatactgaaactcgtgtgtgcatgtacacatcctagctagctcagccgccgtagcagctagctacgatgcattgtacgtatggatctcgattatcgattgtcccatggttgatttcctaacttctggggaac

SEQ ID NO: 47345 - protein, 79 aa, Panicum virgatum
  misc_feature: Ceres CLONE 2035615
  misc_feature: SWISSPROT Homolog: EC 1.8.1.8 Protein-disulfide reductase
MAPWSEPCKVMKEPYRRIARARKDRVNFYTLNVDKFKDLAEEAGVEALPTYVLLKNDDVMDMVVGVRRHELENAIKNNT

SEQ ID NO: 47346 - DNA, 707 bp, Panicum virgatum
  misc_feature: Ceres CLONE 2035639
  misc_feature: Encodes the peptide sequence at SEQ ID NO. 47347
acgccattgaacgctccgggcctttcttcccactctcgcgtccgcgtccgcgtccatcgcttcccttccttaatcccgcgctccttgccccgcttcgatccctcccccaccaccaggctcatggcggatcagctcaccgacgaccagatcgccgagttcaaggaggccttcagcctcttcgacaaggacggggatgggacggatgtaacttttcgagatgaatctaatgacggttgcatcacaaccaaggagctgggtactgtcatgcgttccctgggccagaaccctacagaggctgagctccaggacatgatcaatgaggttgatgccgatggcaacggcaccatcgattttccagaatttctcaatcttatggctcgcaagatgaaggacactgactcagaggaagagcttaaggaggccttccgtgtgtttgacaaggaccaaaatggcttcatctccgcagctgagctccgccatgtcatgacaaatcttggtgagaagctaactgatgaggaggtggatgagatgatccgtgaggctgatgtcgatggcgatggtcagatcaactatgaggagtttgtcaaggtcatgatggccaagtgagccactgaaccataatctgaaggcggagaagattgtgcattgcatattagtcaagatgcaactcttatttcatcaacttgctgtgaaacattctattagct

SEQ ID NO: 47347 - protein, 161 aa, Panicum virgatum
  misc_feature: Ceres CLONE 2035639
  misc_feature (133)..(161): Pfam Name: efhand Pfam Description: EF hand
  misc_feature (97)..(125): Pfam Name: efhand Pfam Description: EF hand
  misc_feature (60)..(88): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity
MADQLTDDQIAEFKEAFSLFDKDGDGTDVTFRDESNDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 47348 - DNA, 401 bp, Panicum virgatum
  misc_feature: Ceres CLONE 2035650
  misc_feature: Encodes the peptide sequence at SEQ ID NO. 47349
agacctgaataaccccgacgagctggcgccatggagcgagccatgcaaggtcatgaaggaaccttataggctaatcgccagagcaagaaaagacagagtcaacttctacacgctcaacgtccagaagttcaaagatttggcggaggaaactggcatggaagcgctaccgacgttcattctactgaagaatgacgatgtgatggacatgatcgctggcgtccggaggcacgagctcaagaacgccataaaaaaaatgacctaccgactgatccgatcagatattccgtgcgtcgagaacgaacgggaaatgaatgattcatactgcaatagcacacgtccgatgtggtgtgtcacggatactgaaacacgagtgtgcatgtgcgcgtcctagctagctcagc

SEQ ID NO: 47349 - protein, 129 aa, Panicum virgatum
  misc_feature: Ceres CLONE 2035650
  misc_feature: SWISSPROT Homolog: EC 1.8.1.8 Protein-disulfide reductase
DLNNPDELAPWSEPCKVMKEPYRLIARARKDRVNFYTLNVQKFKDLAEETGMEALPTFILLKNDDVMDMIAGVRRHELKNAIKKMTYRLIRSDIPCVENEREMNDSYCNSTRPMWCVTDTETRVCMCAS

SEQ ID NO: 47350 - DNA, 704 bp, Panicum virgatum
  misc_feature: Ceres CLONE 2035665
  misc_feature: Encodes the peptide sequence at SEQ ID NO. 47351
gaagcagtccgccagcgtgcagatgctctcatgctttctggtgagtcagccatgggaaggtatccagagaaggctctcagtgtccttaggagtgttagtctcaggattgaaaagtggtggagagaagagaaacgccatgaggcactggagcttcaagatgtctcgtcttccttctctgataagatatcagaggaaatatgcaattcagcagcgaaaatggccaacaacttgggagtcgatgctgttttcgtctacaccaagcatggccacatggcctccctgctctcacgatgccgccctgactgcccaatcttcgcattcacgtcctcgacgtctgtcaggagacggctgaacctacagtggggtctcatcccgttcaggctcagtgactccgatgacatggagagcaacctcaaccgcaccttctccctgctcaaggccaggggtatggtacagtccggtgacctggtgatcgcgctttccgacatgctgcagtccatccaagtgatgaatgtaccctaggaatagtttccccgtgtcctgtcatttcctgtgcaatcattatcccaatcaattttgaaactgatctgtactgtagcatgaaagggcaattttcttttgtgagttgtgagacttgagagcttgttatattgtgttgatgttcaatggtgcacacttgaatatactgcattcgcttgctatcc

SEQ ID NO: 47351 - protein, 173 aa, Panicum virgatum
  misc_feature: Ceres CLONE 2035665
  misc_feature (63)..(169): Pfam Name: PK_C Pfam Description: Pyruvate kinase, alpha/beta domain
  misc_feature: SWISSPROT Homolog: EC 2.7.1.40 Pyruvate kinase
EAVRQRADALMLSGESAMGRYPEKALSVLRSVSLRIEKWWREEKRHEALELQDVSSSFSDKISEEICNSAAKMANNLGVDAVFVYTKHGHMASLLSRCRPDCPIFAFTSSTSVRRRLNLQWGLIPFRLSDSDDMESNLNRTFSLLKARGMVQSGDLVIALSDMLQSIQVMNVP

SEQ ID NO: 47352 - DNA, 457 bp, Panicum virgatum
  misc_feature: Ceres CLONE 2035679
  misc_feature: Encodes the peptide sequence at SEQ ID NO. 47353
aaggcttagggtttgttggttggacggagaagcttgtaatagatccttcgttagggagtcgccatgagccggtcggggcagcctccggatctgaagaagtacatggacaagaagctccaaatcaagctgaatgcaaaccgtgtagtcattggcacgctgcgtggatttgatcagttcatgaatctggtcgtggacaacacagtggaggtcaatggaaacgacaagaatgacatcggaatggtggttatcagggggaacagtgttgtcatgatcgaagccctcgaaccggttgccaaagctcagtgaactgtcagcctgctttggtagttaataagttggtagtgttaatttaaaactgatgtatgccgttgggcaccattgtatcctgagttcctaacccttattcatgtgcaagtgttaagcacttttgtatagttgagcctgtgtttcgactttc

SEQ ID NO: 47353 - protein, 80 aa, Panicum virgatum; identical to SEQ ID NO: 46278
  misc_feature: Ceres CLONE 2035679
  misc_feature (8)..(72): Pfam Name: LSM Pfam Description: LSM domain

SEQ ID NO: 47354 - DNA, 663 bp, Panicum virgatum
  misc_feature: Ceres CLONE 2035706
  misc_feature: Encodes the peptide sequence at SEQ ID NO. 47355
atcgacaggcagagactccaagtcactcgccactgactgactcaaacaaagcttcccttccaccaccgcttggtcctcgtcggcgactagccggagatggccttctgccgccggagcacggtctgctccaccaccaccgtgctgttagttctccaccttctcaccgcctcctgcgcttcgtcgccaccgcaggagcaggacagggcggctctccttgagctcaaggccggcctctcctccggctccggcgaccctctctgccagtgggcgttggaatccggcgtccaccactgctcctggccgggggtcacctgcgactcgcggtcccgccgcgtcgtggccctctcgcccccgtccccacccggccggcgcctcgccgtcgccggggagctctcgccggcggtcgctcgcctcaccgagctcagagcgctctcctttcccgccgtcgggctccgcggcgagattcctcaggaggtctggcggctgcggcacctcgaggtgctccacctggccggcaactccctccgtggcggcctgccggccaccttcccggaaggtctgaaaagcttggaccttgccgggaaccggctttcggggacaatccctccggggctggggagctgcgcggcactccggcgcctgcggctgtcctccaatcgctgg

SEQ ID NO: 47355 - protein, 188 aa, Panicum virgatum
  misc_feature: Ceres CLONE 2035706
  misc_feature (32)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MAFCRRSTVCSTTTVLLVLHLLTASCASSPPQEQDRAALLELKAGLSSGSGDPLCQWALESGVHHCSWPGVTCDSRSRRVVALSPPSPPGRRLAVAGELSPAVARLTELRALSFPAVGLRGEIPQEVWRLRHLEVLHLAGNSLRGGLPATFPEGLKSLDLAGNRLSGTIPPGLGSCAALRRLRLSSNR

SEQ ID NO: 47356 - DNA, 327 bp, Panicum virgatum
  misc_feature: Ceres CLONE 2035722
  misc_feature: Encodes the peptide sequence at SEQ ID NO. 47357
atcatcacacgcgaatccgagcaccctacaagccgcactccaccttgatcggccgcgctacctgcttccttccttggtcgtgatcaccgataggatatgtcttgctgcggcggcaactgcggatgcggctcctgctgtaattgcggaaacggatgcggcggctgcaagatgtctcctgacctggacgcctcctccaccaccaccgctaccatggtcatctccgccctcagccgcgctgcgagctccgacggctcgaggctgccaccgaggggagggggtgcaactgctaaatgtgcaagtgcggcaccaaccggagctgctcctgct

SEQ ID NO: 47357 - protein, 76 aa, Panicum virgatum
  misc_feature: Ceres CLONE 2035722
  misc_feature (1)..(66): Pfam Name: Metallothio_2 Pfam Description: Metallothionein
MSCCGGNCGCGSCCNCGNGCGGCKMSPDLDASSTTTATMVISALSRAASSDGSRLPPRGGGATAKCASAAPTGAAP

SEQ ID NO: 47358 - DNA, 406 bp, Panicum virgatum
  misc_feature: Ceres CLONE 2035724
  misc_feature: Encodes the peptide sequence at SEQ ID NO. 47359
gtgacagatgctgctgcgctcacgtgccgtcgtcctcctcccaccctacctcgctccgcctcctcgcttcattcgccgcctgccgcacccgcgcgccgtctcctcctccccgtttcagccgccgcctcggatggaggccacctacaagttcgggccctacaagatcgacgccagggaggtcttccacgccacgcccctctcatacgccatggtcaacctccgccccctcctccctggtaatatcccccactctctttccacttcgcctttgccgatgcttttgcttggttgatgatgtacccgccgccacgctccgacatctgctcgcgagagaaatcatttttagtttgtcggtgctagaacagtagccatcgcgaatcgcgagagaaagggggggggggggggg

SEQ ID NO: 47359 - protein, 53 aa, Panicum virgatum
  misc_feature: Ceres CLONE 2035724
  misc_feature: SWISSPROT Homolog: EC 3.6.1.29 Bis(5'-adenosyl)-triphosphatase
MEATYKFGPYKIDAREVFHATPLSYAMVNLRPLLPGNIPHSLSTSPLPMLLLG

SEQ ID NO: 47360 - DNA, 684 bp, Panicum virgatum
  misc_feature: Ceres CLONE 2035760
  misc_feature: Encodes the peptide sequence at SEQ ID NO. 47361
accaccactctcttctccccctcgtccccacctaaaacctcacgcaccccgcgccgccgccgccggctgctgccgcgatgaccgctcctctcgccctcgggggcgggcggggcctccggtggctgctcccgctcctcctgctcctaatcaccgcgctcgcgcctccggcggcgtcgcagctgccggccaccccgcggctgcaggaggcgtacgcggcgctgcagtcgtggaagcgcacggccatcttctccgaccccttcaacttcaccgccaactgggtcggccccaacgtctgcgcctacaacggcgtcttctgcgcgccgcacccggccggcggcgggctcaccgtcgccggcatcgacctcaaccacgccgacatcgcgggctacctccccgccgacctgccccggggcctccccgacctcgcgctgctccacctcaactccaaccgcttctgcggcgtgctcccggacgccttcctccacctccgcctcctccacgagctcgacctcagcaacaaccgcttcgtcgggcccttcccgcgggtgctcctcgcgctgccggcgctcaggtacctcgacctccgcttcaacgacttcgaggggcccatcccgcccgcgctcttcgacagcccgctcgacgccatcatcctcaacaacaaccgcctcacgcgccccatcccgc

SEQ ID NO: 47361 - protein, 202 aa, Panicum virgatum
  misc_feature: Ceres CLONE 2035760
  misc_feature: SWISSPROT Homolog: EC 2.7.11.1 Non-specific serine/threonine protein kinase
MTAPLALGGGRGLRWLLPLLLLLITALAPPAASQLPATPRLQEAYAALQSWKRTAIFSDPFNFTANWVGPNVCAYNGVFCAPHPAGGGLTVAGIDLNHADIAGYLPADLPRGLPDLALLHLNSNRFCGVLPDAFLHLRLLHELDLSNNRFVGPFPRVLLALPALRYLDLRFNDFEGPIPPALFDSPLDAIILNNNRLTRPIP

SEQ ID NO: 47362 - DNA, 686 bp, Panicum virgatum
  misc_feature: Ceres CLONE 2035761
  misc_feature: Encodes the peptide sequence at SEQ ID NO. 47363
gaaagtttcaatctagagtgtcgcttgtttcaaatccatcccttgcttcccctccccgcttcctcgtaccaaatctagggtttccgatcgaaatcctccgcctccgccgccaccgccggtgataatgtcggccagcgccgagcccgagaaggacgccgcggccgcggccgccgagggcgacgaggacgcggagacgaagggcagcgcctccggctgggagctgctgtactgcggcgggacgagcttcgacaccatgggccggaaggtggtgggcggggcacagggcaacctggtgtccccgacgcgattgcggccgctgatgggcgtcgacatccgcttcgtcggctctggctgcactgcttgccattgtgttgctttggatgctgaaggcagatgttatacatggggtcgcaatgagaagggacagctagggcatggggatactcttctgcgtaacctgccaactgttgtttcacaactatcaaaatacaaaatcatcaaagcaagcgttggcagaaaccatacagtggttgtagctgatgatgggaaatccttctcttttggccacaataagcatgggcagttagggacgggctccttgaggaatggttggtaccattacttcttatttatctctgagtaaccacagaagtgcctgcacataccattttggttctgaaggattg

SEQ ID NO: 47363 - protein, 172 aa, Panicum virgatum
  misc_feature: Ceres CLONE 2035761
  misc_feature (88)..(137): Pfam Name: RCC1 Pfam Description: Regulator of chromosome condensation (RCC1)
  misc_feature: SWISSPROT Homolog: EC 2.7.11.1 Non-specific serine/threonine protein kinase
MSASAEPEKDAAAAAAEGDEDAETKGSASGWELLYCGGTSFDTMGRKVVGGAQGNLVSPTRLRPLMGVDIRFVGSGCTACHCVALDAEGRCYTWGRNEKGQLGHGDTLLRNLPTVVSQLSKYKIIKASVGRNHTVVVADDGKSFSFGHNKHGQLGTGSLRNGWYHYFLFISE

SEQ ID NO: 47364 - DNA, 691 bp, Panicum virgatum
  misc_feature: Ceres CLONE 2035780
  misc_feature: Encodes the peptide sequence at SEQ ID NO. 47365
gccggcagaaaccaagaacagctcgctcaaaagttcgagctcctcctaggtaggagctgtggcattgcgttgagctaactatatcgattaggttaggttctagctacagctagcagcttgcctggagtagagtagccatgggtgagcggagctgcggccgcgacggcgtccgatgcgatgtcaggtcgagaagagagcgacggcgaggtggaggtcggcctgtgccgtcgccgctggtgatcctcctgctgctgctggcggcgtcgccggcgcgagggcagcgctcggacggcgtggtgatcgcgcaggcggacctgcagggcctgcaggccatccgccaggcgctggtggacccgcgcgggttcctctccggctggaacggcacgggtctcgacgcctgctccggcggctgggccggggtcaagtgcgcgggcggcaaggtcgtggccatccagctccccttcaagggcctcgccggcgcgctctccgacaaggtcggccagctcaccgcgctgcgccggctcagcctccacgacaacatcatcgggggccaggtgccagccgcgataggcttcctccgcgacctccgcggggtgtacctccacaacaaccgcttcgccggcgccgtgcccccggcgctcggcggctgcgcgctcctgcagacgctcgacctcagcgggcactacctctc

SEQ ID NO: 47365 - protein, 184 aa, Panicum virgatum
  misc_feature: Ceres CLONE 2035780
  misc_feature (56)..(98): Pfam Name: LRRNT_2 Pfam Description: Leucine rich repeat N-terminal domain
  misc_feature: SWISSPROT Homolog: EC 2.7.11.1 Non-specific serine/threonine protein kinase
MGERSCGRDGVRCDVRSRRERRRGGGRPVPSPLVILLLLLAASPARGQRSDGVVIAQADLQGLQAIRQALVDPRGFLSGWNGTGLDACSGGWAGVKCAGGKVVAIQLPFKGLAGALSDKVGQLTALRRLSLHDNIIGGQVPAAIGFLRDLRGVYLHNNRFAGAVPPALGGCALLQTLDLSGHYL

SEQ ID NO: 47366 - DNA, 714 bp, Panicum virgatum
  misc_feature: Ceres CLONE 2035816
  misc_feature: Encodes the peptide sequence at SEQ ID NO. 47367
atctcctcctccctcttcctcattctcggcatcccttcacccgtcgcagacttgcagtctccttcctcctccgcttgccctttcctagctcgctccgttcacagcggctagcggagtaggagcgaaagcaaaaaaaggccatgggtgccctcctgctcttcgtctgcctcctggcgccgttcgtgctcgcctgcgccgcccgcggcaggcgccggcgggcggcggcgccggcgtcgtcggcgtgcggcaaggcgctgccgctgccgccggggtccatggggtggccgtacgtgggcgagacgttccagctctactcctccaagaaccccaacgtgttcttcgcccggaagcagaaccggtccgggcccatcttcaagacgcacatcctggggtgcccctgcgtgatggtgtccagcccggaggcggcgcgcttcgtgctcgtcacgcaggcgcacctcttcaagcccaccttcccggccagcaaggagcgcatgctgggcccgcaggccatcttcttccagcagggcgactaccacgcccacctccgccgcctcgtctcccgggccttctccccggaggccatccgcgcctccgtgccggccatcgaggccatcgcgctgcgctcgctccgctcctgggacggccagctcgtcaacacctttcaggagatgaagctggtgagcggctattatttgcttgcttctagctgctgct

SEQ ID NO: 47367 - protein, 191 aa, Panicum virgatum
  misc_feature: Ceres CLONE 2035816
  misc_feature: SWISSPROT Homolog: EC 1.14.13.93 (+)-abscisic acid 8'-hydroxylase
MGALLLFVCLLAPFVLACAARGRRRRAAAPASSACGKALPLPPGSMGWPYVGETFQLYSSKNPNVFFARKQNRSGPIFKTHILGCPCVMVSSPEAARFVLVTQAHLFKPTFPASKERMLGPQAIFFQQGDYHAHLRRLVSRAFSPEAIRASVPAIEAIALRSLRSWDGQLVNTFQEMKLVSGYYLLASSCC

SEQ ID NO: 47368 - DNA, 693 bp, Panicum virgatum
  misc_feature: Ceres CLONE 2035865
  misc_feature: Encodes the peptide sequence at SEQ ID NO. 47369
aaggctggcggcttctgcccactgggcgtcgccctgaatagtggagattcccacccccatttcccaattatggatagccagcagccagcgggggaggactgaggccgctcgccattgctcccatttgagcttagcaacctgttcagcaaaatgaggccttcagatgacagggcgcagctctcaggctttgcacaatcagaagaatcaacacttgatgtggaggggcattgctaccaccaacagtcattcccttgttctccgtcaatgcaaccaattgcttctgggtgcacacacacagagaatagcgcggcatacttcttatggccgacatcaaacctacagcattgtgcagctgaggggcgtgcaaactactttggcaacctttcaaaaggactccttcccaagtctggcaagttgccaaagggccagcaagcaaatagcttgcttgacttgatgactataagagctttccatagcaagatattacgatgttttagccttgggaccgcagtgggattccgcatcaggaaaggggttctgacagatatccctgctattcttgtctttgttgctcgcaaggttaacaagaaatggcttaatccgacccaatgccttcctgcaatcgttgagggtccaggaggtgtttggtgtgatgttgatgttgttgaattctcgtactatggcgcaccagct

SEQ ID NO: 47369 - protein, 180 aa, Panicum virgatum
  misc_feature: Ceres CLONE 2035865
  misc_feature: Functional homolog of the protein sequence given in SEQ ID NO 51147
  misc_feature: Useful for making plants with altered protein content
MRPSDDRAQLSGFAQSEESTLDVEGHCYHQQSFPCSPSMQPIASGCTHTENSAAYFLWPTSNLQHCAAEGRANYFGNLSKGLLPKSGKLPKGQQANSLLDLMTIRAFHSKILRCFSLGTAVGFRIRKGVLTDIPAILVFVARKVNKKWLNPTQCLPAIVEGPGGVWCDVDVVEFSYYGAP

SEQ ID NO: 47370 - DNA, 635 bp, Panicum virgatum
  misc_feature: Ceres CLONE 2035898
  misc_feature: Encodes the peptide sequence at SEQ ID NO. 47371
gcccccacactctcgtccactcacctcagctggctcaccgccgtcttgccgtcttgctctgcctctccgcgccgcagcagagcaatggcgctcccacggcgcgccctcctcgtcgccgggctcctcgccgcggcgctgccgctgctcctccttcgcccggcagaggcggggactgtgggcgtgaactatggccgggtcgcgaacaacctgccgaacccggcggcggtggtgcagctgctcaagcagcagggcatcacgcaggtgaagctctacgacgccgaccccaccgtgctgcgagcgctcgccaacactggcatcaaggtggtggtcgcgctgcccaacgagcagctcgccgccgcggcgtcgcgcgcctcctacgcgctcctgtgggtgcgccggaacgtggcggcctactacccggccacgcagatccagggcatcgccgtggggaacgaggtcttcaccaccgccaagaacgtcacggcgcagctcgtgccggccatggtcaacgtgcacgccgcgctggcccggctcaacctggacaagtccgtgaaggtgtcgtcccccatcgcgctcgtcgctctcgcgacgtcgtacccgtcctccgccggcgcgttccgggaggacctcgcgca

SEQ ID NO: 47371 - protein, 183 aa, Panicum virgatum
  misc_feature: Ceres CLONE 2035898
  misc_feature (31)..(183): Pfam Name: Glyco_hydro_17 Pfam Description: Glycosyl hydrolases family 17
  misc_feature: SWISSPROT Homolog: EC 3.2.1.73 Licheninase
  misc_feature: Functional homolog of the protein sequence given in SEQ ID NO 50689
  misc_feature: Useful for making plants with altered carbohydrate content
  misc_feature: Functional homolog of the protein sequence given in SEQ ID NO 51178
  misc_feature: Useful for making plants with altered cell wall content and/or composition
MALPRRALLVAGLLAAALPLLLLRPAEAGTVGVNYGRVANNLPNPAAVVQLLKQQGITQVKLYDADPTVLRALANTGIKVVVALPNEQLAAAASRASYALLWVRRNVAAYYPATQIQGIAVGNEVFTTAKNVTAQLVPAMVNVHAALARLNLDKSVKVSSPIALVALATSYPSSAGAFREDLA

SEQ ID NO: 47372 - DNA, 694 bp, Panicum virgatum
  misc_feature: Ceres CLONE 2035905
  misc_feature: Encodes the peptide sequence at SEQ ID NO. 47373
actgggcgccacacgcggcgcaagcgcaaacagcacgccatctgttcgtgctgtcgctctccccaggagcgaagcataaaccccagtggcctcgtagaaatccgggttggaaatcgaaatccgacgagggtggcagcatggattcacgagcccgcgggagctcgattccctctccttgtttttgatctctcgcagtccctgatccgcctccctgttgctgttttccttttgggattttttttctggattttttcgtgtgtgtatttttttttgttggtgtttcgtttcaggaccgcgcggcttctgcgatttcgcggcggctggtttttggacccgcgggttggagaaggctggtgctcgctaggccctgctgagatcgctcctcgcagtcgttgtcacaatgtcgacatatcctatgttgaacgaccggccaattgatcagtggatggttactgagttgaaggatgagcttctgcgaaggaatctgcctgtcactggtttgaaggatgatcttgtgaagaggctctttgaggccatccaggataagatacttcatggtagggaaaaaacaagtggtggaattcctgaggacctgaaagggggtgaaattcctggttctgttgatgcatctgttaaccaggcttcaatcgaagaacatattggtgaagttgcttctgaggttacgggacagggg

SEQ ID NO: 47373 - protein, 97 aa, Panicum virgatum
  misc_feature: Ceres CLONE 2035905
  misc_feature (12)..(46): Pfam Name: SAP Pfam Description: SAP domain
MSTYPMLNDRPIDQWMVTELKDELLRRNLPVTGLKDDLVKRLFEAIQDKILHGREKTSGGIPEDLKGGEIPGSVDASVNQASIEEHIGEVASEVTGQ

SEQ ID NO: 47374 - DNA, 675 bp, Panicum virgatum
  misc_feature: Ceres CLONE 2035908
  misc_feature: Encodes the peptide sequence at SEQ ID NO. 47375
agtcgtacggtcgcgtgctcgtgttactcgtgcgagcgttgtcagtgtgtgtcgagagctctgcgcgcggatccaggcgggactgtgccgccgccgcgatgccgatctgcgcgccgtcgtcggactcctcggcctcgtcgacctccggtggccgcgggtggatagtccacgggctggcgctcggcgcggcggcggcggcggccgcggccgcggcgtacctgtaccgccggccgagcgggttccgcagccgcgcggtgggcatcatacccgcgcgcttcgcctcctcgcgcttcgagggcaagccgctcgcgcacatcctcggcaagcccatgatccaggtccgccccctgcttacccttatcttatcgcgtccgacagagagagcaaggggagccttgcggtagaaaatcatattggggaagttgtaaattgtaatagcaagtcgcgtttgggattgcgaaggaaggtcgaatcgagttacgctgtttcatcacctggatttaggctgcagtgtcaggtgatcatgtcggtgtcgtgcataacatttcagtgagtgcaagatggtgttcttttggttacctatactatagaattgccgtatcatgttcgtccggactttagattacctacacggcacctccgctatatcaagtttcattagatcgaatagtatta

SEQ ID NO: 47375 - protein, 101 aa, Panicum virgatum
  misc_feature: Ceres CLONE 2035908
  misc_feature: SWISSPROT Homolog: EC 2.7.7.38 3-deoxy-manno-octulosonate cytidylyltransferase
MPICAPSSDSSASSTSGGRGWIVHGLALGAAAAAAAAAAYLYRRPSGFRSRAVGIIPARFASSRFEGKPLAHILGKPMIQVRPLLTLILSRPTERARGALR

SEQ ID NO: 47376 - DNA, 725 bp, Panicum virgatum
  misc_feature: Ceres CLONE 2035913
  misc_feature: Encodes the peptide sequence at SEQ ID NO. 47377
tccactccgcactcctccgcgcactggagtcgagttgagcgcacgctccccgcactcgcattcccaccgaccacatccttcgctaagcaaaccccctagatctccactccgcgccatggggtgcttccagtccaaggtggcgggccccctgccgcccaacgacgccgccgcgctccccgccgacaacccggcagatcccgaggcggcgaacggcggcgcggatggcggcgacgccggcgacgacaaggaggcggtgaagcgcgcggtgcccgtgttcagggagttcgcgctggccgagctgcgcgccgccaccaagggattcagcgccgacctcatcgtctccgagagcggcgagaaggcgcccaacgtcgtctaccgcgggcggctcgacggcggccgcctcatcgccgtcaagcgcttctcgcgcctctcctggcccgacccgcagcagttcctcgcggaggcggcgggcgtggggaaggtgcgccacaagcgcctcgtcaaccttattggctgctgcgccgagggtgacgagaggctgctcgtcgccgagtacatgccaaacgacaccctctccaagcatctcttccactgggataagcagccattgccatgggaaatgcggttgagggtagcatatttcatcgcacaagcactcgaccattgcaatgcagagaaccggaagatctatcatgacttgaatgcttatagagtactttttgacg

SEQ ID NO: 47377 - protein, 203 aa, Panicum virgatum
  misc_feature: Ceres CLONE 2035913
  misc_feature: SWISSPROT Homolog: EC 2.7.11.1 Non-specific serine/threonine protein kinase
MGCFQSKVAGPLPPNDAAALPADNPADPEAANGGADGGDAGDDKEAVKRAVPVFREFALAELRAATKGFSADLIVSESGEKAPNVVYRGRLDGGRLIAVKRFSRLSWPDPQQFLAEAAGVGKVRHKRLVNLIGCCAEGDERLLVAEYMPNDTLSKHLFHWDKQPLPWEMRLRVAYFIAQALDHCNAENRKIYHDLNAYRVLFD

SEQ ID NO: 47378 - DNA, 650 bp, Panicum virgatum
  misc_feature: Ceres CLONE 2035921
  misc_feature: Encodes the peptide sequence at SEQ ID NO. 47379
ccccagcagacgcgcccactccactctctctcctctcccccgaccggatctccccgtgcctcctcctcctctgcctctctttctcagggcgacgcgggcggtctgaatcggtgctggttccggggtgttcctcgactgggcatccggaatggctgcggtggcgtcggttgtggaggaggtgctgcggcgcggtgtcgggagcgtgggggacgacgacgtggccgcgcgcagggcggaggaggccgcaataagaaggcatgatgcagccagttggttgcgaaaaacggttggggtagtgtgtgcaaaggacctgccagatgagccctcagaggaggaattccagcttggactaagaaatggcatcgtcctatgcaacgcactgaataaggtccagccaggcgccatacctaaggttgtcggagtgctgtcagagtctactgctcctgcggatggcccagctttatgcgcatatcagtacttcgaaaatctgcgaaattttgttgttgctgtacaaaattttggcctcccaacatttgaggtttctgatttggagaagggtggaaaaagtgtacgggttgtggactgtattcttgctctgaagtcattcaatgaaagcaagaaaacagggagacaagcttcatgtaaatatg

SEQ ID NO: 47379 - protein, 167 aa, Panicum virgatum
  misc_feature: Ceres CLONE 2035921
  misc_feature (34)..(155): Pfam Name: CH Pfam Description: Calponin homology (CH) domain
MAAVASVVEEVLRRGVGSVGDDDVAARRAEEAAIRRHDAASWLRKTVGVVCAKDLPDEPSEEEFQLGLRNGIVLCNALNKVQPGAIPKVVGVLSESTAPADGPALCAYQYFENLRNFVVAVQNFGLPTFEVSDLEKGGKSVRVVDCILALKSFNESKKTGRQASCKY

SEQ ID NO: 47380 - DNA, 670 bp, Panicum virgatum
  misc_feature: Ceres CLONE 2035945
  misc_feature: Encodes the peptide sequence at SEQ ID NO. 47381
aaaccatccccaaaactcagacgacacaggcacacagcccccgcccccgcccccgccccccgtcccgtcccgtccgcctcaggtgccgcgccccacccccaccgcccttctcgaccacgaccatgtcggtggtcgacgtggacgacgacgacgacgacgagggcttcctccaagccctcgacgcggcggaggccgccgcgctcgactcctccaagcgccgccgcctctccaccacctcctcaccgacgcccgccactccccccgccgcctctgaggggtcctacctgtctgcgctcaagggaagccacagctcggtctggcagcagcagcagcaagcgctgacctacgcgcacaagcggcccgacggctccaaaaccctagccgcgggtaccggggggacccaggtagcgagcggatcgtgcttcaagtgcggagaccccggccactgggccagggaatgtccccaatgggttccgactactgggggagggggtgtaatcggctgtggcgccggcggagggtatgtgaatgcgggtggggaggtggaggagaaggcgtgcccctgcggcgccgggagctgcctcgtgcttacttccaacacgcccaggaaccccgggcggaagttctacaagtgcccaatacgggtgagtatttcggaccagctgatcac

SEQ ID NO: 47381 - protein, 182 aa, Panicum virgatum
  misc_feature: Ceres CLONE 2035945
  misc_feature (98)..(115): Pfam Name: zf-CCHC Pfam Description: Zinc knuckle
  misc_feature (144)..(181): Pfam Name: zf-GRF Pfam Description: GRF zinc finger
  misc_feature: The sequence is a functional homolog of SEQ ID NO 1036 in the 10/374,780 US patent application
  misc_feature: The sequence is a functional homolog of SEQ ID NO 846 in the 10/666,642 US patent application
MSVVDVDDDDDDEGFLQALDAAEAAALDSSKRRRLSTTSSPTPATPPAASEGSYLSALKGSHSSVWQQQQQALTYAHKRPDGSKTLAAGTGGTQVASGSCFKCGDPGHWARECPQWVPTTGGGGVIGCGAGGGYVNAGGEVEEKACPCGAGSCLVLTSNTPRNPGRKFYKCPIRVSISDQLI

SEQ ID NO: 47382 - DNA, 599 bp, Panicum virgatum
  misc_feature: Ceres CLONE 2035954
  misc_feature: Encodes the peptide sequence at SEQ ID NO. 47383
cacccccgtaggacagttgacgggtgcagcgccgagacgccgactccaccctcgccccccctccccctcccccatgtatccgctcatgagacaattaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatggggg

SEQ ID NO: 47383 - protein, 154 aa, Panicum virgatum
  misc_feature: Ceres CLONE 2035954
  misc_feature: SWISSPROT Homolog: EC 3.5.2.6 Beta-lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMG

SEQ ID NO: 47384 - DNA, 702 bp, Panicum virgatum
  misc_feature: Ceres CLONE 2035999
  misc_feature: Encodes the peptide sequence at SEQ ID NO. 47385
gctaccaacttccacaaaaccccaagcggtgcccaagtcatctcctagctcttgccatcatctccaacctgcctcggcatcccattccctcctccattgctggtacctccgaatctgaaacgctctcccggggaggtgagtgaattgtctgttgggagtggcgtaggctgcagcctgcagagcaagccagccatgaggcttcctctgctggccgcggtgtgctgcgccctcctggcgagcgccgcccggccgcattgcgccgcggcggcaaaggcccggcacttcaagtgggagatcagcaacatgttctggtcgccggactgcgaggagaaggtggtgatcggcatcaacgggcagttccccggcccgaccatccgcgcccgcgccggcgacaccatccacgtcgagctcaagaacgcgctccacaccgagggcgtcgtcatccactggcacggcatcagacagatcggcacgccgtggatggacggcacggcggcgatctcccagtgcgccatcaaccctgaagaaaccttcacctaccgcttcgtcgtcgacaagccggggacgtacttctaccacgggcactacgggatgcagagggcggcggggctgtacgggtcgctgatcgtcgacgtggccgagggggaggaggagccgttcaagtacgacggcgagctcaacctgctgctcagcgactggtac

SEQ ID NO: 47385 - protein, 169 aa, Panicum virgatum
  misc_feature: Ceres CLONE 2035999
  misc_feature (34)..(151): Pfam Name: Cu-oxidase_3 Pfam Description: Multicopper oxidase
  misc_feature: SWISSPROT Homolog: EC 1.10.3.3 L-ascorbate oxidase
MRLPLLAAVCCALLASAARPHCAAAAKARHFKWEISNMFWSPDCEEKVVIGINGQFPGPTIRARAGDTIHVELKNALHTEGVVIHWHGIRQIGTPWMDGTAAISQCAINPEETFTYRFVVDKPGTYFYHGHYGMQRAAGLYGSLIVDVAEGEEEPFKYDGELNLLLSDW

SEQ ID NO: 47386 - DNA, 684 bp, Panicum virgatum
  misc_feature: Ceres CLONE 2036001
  misc_feature: Encodes the peptide sequence at SEQ ID NO. 47387
acacagacctctcaacacactgacacatcatctggcgatagctccatgcagctgaagctcggaggtgcctcgcggcgtggttgaaccggccggagcagtagatcaccgggcgatcgtgatggcggcgacggcgaggaagctgatcgtggaggtggtggaggcgcgggacctgctgcccaaggacgggaccggcacgtcgagcccctacgcgcgcgccgacttcgacgggcagcgacgcaagacgcgcacggtgacgagggacctcaacccggcgtggaacgaggcgctcgagttcgacttccccgccgccggcgccgaccccgtcgcgggggagccgctcgaggtcgccgtcctgcacgacgtccgcgtcgggcccagccggcggaacaacttcctcggccgcgtccgcctcgacgcgcgccagttcgtatgcaagggcgaggaggcgctcatctacttcccgctccagaagaagagcctcttcaactgggtccgcggcgagatcggcctcaaggtctactacgtcgacgtgccgctcgcgccgccggagccaccagccgctgacgccgccgcacttgatgccgcggtggcggaagcagaagcgccgccgccgccggccgatgcgcctaaagaggcttctgcggatgagccgccgaaggcggaggagccggcggacgcagctcc

SEQ ID NO: 47387 - protein, 188 aa, Panicum virgatum
  misc_feature: Ceres CLONE 2036001
  misc_feature (8)..(97): Pfam Name: C2 Pfam Description: C2 domain
  misc_feature: SWISSPROT Homolog: EC 2.7.11.13 Protein kinase C
MAATARKLIVEVVEARDLLPKDGTGTSSPYARADFDGQRRKTRTVTRDLNPAWNEALEFDFPAAGADPVAGEPLEVAVLHDVRVGPSRRNNFLGRVRLDARQFVCKGEEALIYFPLQKKSLFNWVRGEIGLKVYYVDVPLAPPEPPAADAAALDAAVAEAEAPPPPADAPKEASADEPPKAEEPADAA

SEQ ID NO: 47388 - DNA, 691 bp, Panicum virgatum
  misc_feature: Ceres CLONE 2036028
  misc_feature: Encodes the peptide sequence at SEQ ID NO. 47389
aaattactctcgttattctttttgggttctacctgcaagcccattgtgtgctgaagactgaggtcttggggttttctctgttcttcagtgaggtattcaagaaatgcttggagttccattccctggctgaaatttctggaagggtttaagagcataagcagaattctggcctgagagatagagaaagatggcaggcactgaagctgccacagacctgggcagttcacggagatcacaagatgacacagcaacattaatcccacacagtggcaacttggaagaatcaagccggaggggcgtaaagacaaccaggttcaaagatgatgatgaggttgtggagatcactcttgatgtacagcgtgattcagtggcaatagaagatgtcagagctgttgatgatggtggctcagggcatggtggtgggtttgacggcctgtcactagtgtcaccttcctcatcaaggagcggcaaactcgcatcaaagttaaggcaggtaacaaatgggctaaagctgaagaactcaagcaataaggcacaacagacacagttgggaaagaacacgaggaagagattggacagaagcaagagtggtgctgctgtggcgttgaagggcctgcagtttgtaactgcgaaagttggccatgatggttgggctgcagtggagaagcgcttcattcaactacagggtgat

SEQ ID NO: 47389 - protein, 167 aa, Panicum virgatum
  misc_feature: Ceres CLONE 2036028
  misc_feature (128)..(167): Pfam Name: NADPH_Ox Pfam Description: Respiratory burst NADPH oxidase
MAGTEAATDLGSSRRSQDDTATLIPHSGNLEESSRRGVKTTRFKDDDEVVEITLDVQRDSVAIEDVRAVDDGGSGHGGGFDGLSLVSPSSSRSGKLASKLRQVTNGLKLKNSSNKAQQTQLGKNTRKRLDRSKSGAAVALKGLQFVTAKVGHDGWAAVEKRFIQLQG

SEQ ID NO: 47390 - DNA, 717 bp, Panicum virgatum
  misc_feature: Ceres CLONE 2036034
  misc_feature: Encodes the peptide sequence at SEQ ID NO. 47391
acacaaatcttctcagctgccgagtagcatcctgtgagctcatcttctcctagctcacacagatacatgaaagtatgaaaccatcttagcaatggctatcaagaagggcagctctcctctgcgtgttcttgctgatctatccttgttcttctgcattctgcttacacctatatgctcagctacaccagccacagctcctgctactctcctgcaagtgaaatccagcctcactgatcctgaaggcgtcctttctggctggtcgccggaagccgatgtgtgctcatggcacggcattacatgccggccaggggaggtgggcattgtcacaggcctcaacctatccgggtacggcttgtcaggtgtgatacctccggcgatcggtggactcatctccgtcgagtccatcgacttgtcttccaactccctcaccgggccgatcccgccggagctgggcatgctggagagcctgaggacgctgctcctcttctccaactccctcaccggcgccgtccggccggagctcggcctcctcaagaacctggaggtgatcaggatcggcgacaacaggctgcacggcgagatcccgccgcagctcggcaactgcaccgagctggagacgctcggcctggcctactgccagctcaatggcaccattcccgccgagctcggcaacttgaggcgcctgcagcacctggccctggacacaacaccctcacc

SEQ ID NO: 47391 - protein, 208 aa, Panicum virgatum
  misc_feature: Ceres CLONE 2036034
  misc_feature (32)..(71): Pfam Name: LRRNT_2 Pfam Description: Leucine rich repeat N-terminal domain
  misc_feature: SWISSPROT Homolog: EC 2.7.11.1 Non-specific serine/threonine protein kinase
MAIKKGSSPLRVLADLSLFFCILLTPICSATPATAPATLLQVKSSLTDPEGVLSGWSPEADVCSWHGITCRPGEVGIVTGLNLSGYGLSGVIPPAIGGLISVESIDLSSNSLTGPIPPELGMLESLRTLLLFSNSLTGAVRPELGLLKNLEVIRIGDNRLHGEIPPQLGNCTELETLGLAYCQLNGTIPAELGNLRRLQHLALDTTPS

SEQ ID NO: 47392 - DNA, 703 bp, Panicum virgatum
  misc_feature: Ceres CLONE 2036046
  misc_feature: Encodes the peptide sequence at SEQ ID NO. 47393
aagggagtttgctagatcagtttgctgatgctgaaatgcctcaaacaatagcagtgactcctgaggagaatgaagctatacaacggcttgaacaaatgggcttcgaccgcgatctggttctagaggttttctttgcctgcaacaaggatgaacagatggcagccaactatctgttggaccatatgaatgactttgacgaagctcagcaatagggtgtcagatggcttgaagtacatggtggctgatgatgcgatttaattcagaatgcagcatcagtgttttgaaggctgattaccccaatttaggatcgggttaagacatattttgagtttcgcaatcattttttttcctgtttgggatttatgctcagtgcgagatatagctaggtgttacagtgtcgacggtaccgttgggtaactgaatctgatgttataggttaagaatcgactgtgttctgctcttgtttgtcaatgcttgagccggcagatgatcgagggttgcgaatcgtttctgctgtggtaaaaaaaaaaaaaaaaactgccacttcgccgtttcttctgaaactttctttccccttccccaatcctcctcccaacccccgagctcggcggcgacggcgcgggcgacccgagcgcgccgccatgaaggtctccatcaagacgctcaagggctccagcttcgagatcgagatggacccctcccg

SEQ ID NO: 47393 - protein, 69 aa, Panicum virgatum
  misc_feature: Ceres CLONE 2036046
  misc_feature (21)..(57): Pfam Name: UBA Pfam Description: UBA/TS-N domain
GSLLDQFADAEMPQTIAVTPEENEAIQRLEQMGFDRDLVLEVFFACNKDEQMAANYLLDHMNDFDEAQQ

SEQ ID NO: 47394 - DNA, 655 bp, Panicum virgatum
  misc_feature: Ceres CLONE 2036062
  misc_feature: Encodes the peptide sequence at SEQ ID NO. 47395
aattctcgccctccctcaccttccccatcctcctcgtcccgcctccgcggaacccgagccccccgcgtcccgccccaccgattgagcccaaccgccgtgccctaggtcgcgagatctcggggagcggagccccgcggcctccgggaacagggaccgcggcgcgatggtggagacgggcggcgggaggctccaccagcgccggggcgcggccgccttcgtcgcggccaacaggacgctgctcgccgccgcgtgggtcgtcgggttcgcgctggtgttcctgtggcagagcgcctcgatatcgctgaggagcgggggcggcggcagcgggggcgtgctcctcgggctcctgtcggggcctctcccgccgccgcgccccgcgccgtggctgcgccccgcggcctacaacctcacagacttcggcggcgtcggggacgggcgggcgctcaacaccggggcgttcgagcgcgccgtcgaggccatcgcggcgctcgcggagcgcggcggtgggcagctcaatgtgcccccaggccggtggctcacggccccgttcaacctgactagccacatgacgctgtttctcgccgaaggcgctgagatccttggcattccggtaagaagagccgtttctgtgagcttagctgtggaattcgagtag

SEQ ID NO: 47395 - protein, 163 aa, Panicum virgatum
  misc_feature: Ceres CLONE 2036062
  misc_feature: SWISSPROT Homolog: EC 3.2.1.82 Exo-poly-alpha-galacturonosidase
  misc_feature: Functional homolog of the protein sequence given in SEQ ID NO 50666
  misc_feature: Useful for making plants with altered carbohydrate content
  misc_feature: Functional homolog of the protein sequence given in SEQ ID NO 50667
  misc_feature: Useful for making plants with altered cell wall content and/or composition
MVETGGGRLHQRRGAAAFVAANRTLLAAAWVVGFALVFLWQSASISLRSGGGGSGGVLLGLLSGPLPPPRPAPWLRPAAYNLTDFGGVGDGRALNTGAFERAVEAIAALAERGGGQLNVPPGRWLTAPFNLTSHMTLFLAEGAEILGIPVRRAVSVSLAVEFE

SEQ ID NO: 47396 - DNA, 682 bp, Panicum virgatum
  misc_feature: Ceres CLONE 2036073
  misc_feature: Encodes the peptide sequence at SEQ ID NO. 47397
accgaacatgcctccgccttcccgcctgttggccctgctccccgccggcaacccgccgccgctccgtcttctccttccgctccacgcgcacctcctcgtgtccggtctcctctcctccctatcccccttcgctccccgcctcgtatccgccttcgcactcaccgaactcgcctccccgcgcccgcttctccacgctctctccctcctcgcatccctcacctccccgccggacaccgcgtccccctacaacgccgccctccgtgcgctctccctctgcccgcacccgcacctcctcgaccgccactgcctcccgctctaccgcgccctcctccgctccggctccgcgcggccggaccacctcaccttccccttcctcctcaaggcatgcgcgcgctcaagggagcgcttctacagcggcggcgcggtgcttgcgcacgttacccggctcggcttcaactcggacgtcttcgtggtgaacgccgctatgcattattggtctgtttgtgggtccatggtgaacgcccgcagattgttcgatgaaagtcccgtgagggatgttgtctcgtggaacacgctcatcggcgggtatgttcggaggggtctccctggagaggctctggagttattttggaggatggtggaggaaggaacagttaggccggatgaggtcacgatgattgga

SEQ ID NO: 47397 - protein, 224 aa, Panicum virgatum
  misc_feature: Ceres CLONE 2036073
  misc_feature (185)..(219): Pfam Name: PPR Pfam Description: PPR repeat
MPPPSRLLALLPAGNPPPLRLLLPLHAHLLVSGLLSSLSPFAPRLVSAFALTELASPRPLLHALSLLASLTSPPDTASPYNAALRALSLCPHPHLLDRHCLPLYRALLRSGSARPDHLTFPFLLKACARSRERFYSGGAVLAHVTRLGFNSDVFVVNAAMHYWSVCGSMVNARRLFDESPVRDVVSWNTLIGGYVRRGLPGEALELFWRMVEEGTVRPDEVTMI

SEQ ID NO: 47398 - DNA, 659 bp, Panicum virgatum
  misc_feature: Ceres CLONE 2036089
  misc_feature: Encodes the peptide sequence at SEQ ID NO. 47399
aaacccacacgaagcacacctctttccgtctcgccactctctcccgtccgcactctcctcgccgagcgggtggtgtgagccgcctgaccgcctctcccctcccctccacctcccacctcatctccgccgccgcacccgagagaggaagcgaagcccaatgcgcctcctccctctgctcctgctcctgctcctggccctcgccgcgggcgcggccggcggcggcacggacgcggacgcgggcgcgctgctcgcggcgaaggcggcgctctccgaccccaccggcgcgctcgcgtcctggaacgccacctcctcccccgaccactgcgcgtgggcgggggtcacctgcagcgatgccggcgtcgtggtggggctcgacgtctccaggctcaacctctccggcgcgctcccgccggcgctcgcgcggctccgcggcctgcagcgcctctccgtcgccgccaacgccttctgcgggcccatcccgccggcgctcgcgcgcctgcagcagctcctccacctcaacctctccaacaacgccttcaacggctccttcccgccggcgctcgcgcgcctccggggcctccgcgtcctcgacctctacaacaacaacctcaccagcgccacgctgccgctcgaggtcacgcagatgcccatgctccgcc

SEQ ID NO: 47399 - protein, 167 aa, Panicum virgatum
  misc_feature: Ceres CLONE 2036089
  misc_feature (23)..(64): Pfam Name: LRRNT_2 Pfam Description: Leucine rich repeat N-terminal domain
  misc_feature: SWISSPROT Homolog: EC 2.7.11.1 Non-specific serine/threonine protein kinase
MRLLPLLLLLLLALAAGAAGGGTDADAGALLAAKAALSDPTGALASWNATSSPDHCAWAGVTCSDAGVVVGLDVSRLNLSGALPPALARLRGLQRLSVAANAFCGPIPPALARLQQLLHLNLSNNAFNGSFPPALARLRGLRVLDLYNNNLTSATLPLEVTQMPMLR

SEQ ID NO: 47400 - DNA, 733 bp, Panicum virgatum
  misc_feature: Ceres CLONE 2036090
  misc_feature: Encodes the peptide sequence at SEQ ID NO. 47401
cgtttacagcctcaccacctacacacacacgccatgcttctcctcgccttcaagatgtcgctacttctgcttctttccttaccactccttctctcccgtgcaaattcagagacggtgacgcagctcgaaagagaagcagaagcccttcttcgatggaaatccaacttcgacgatgtctccgggcagcttgcttcaggctgcctcaagtcatggagcaatcacatcagcccgtgcaactggactggtgttgcctgcatcaccacggtgcctcatggccgtggctggagtggcggcgatgctgtcccagtcgtgggcagaatctctcttcccatgtgtaacctctctggccgcttagatgtgctcgacttcatggctttgcctcgtcttgcccatctggacctcaacgacaacaacctctcagggccggtcccgccgagcatcggtgcacttggtgaactcactttactggatctctcaagcaatgccctctccggaccgatcccaccctccataggtaatcttacaagtctgacataccttggtctctcacagaattatcagttcctaaacggacacctcccttctacacttggcatgctacacaacttaaagaagcttaatctgtgtgacaatagctttactggcccaatacctcccagtttgggaaatttgacctcgttggatttcattggcattagctttaacaatttatcgggtagcataccacatgagt

SEQ ID NO: 47401 - protein, 233 aa, Panicum virgatum
  misc_feature: Ceres CLONE 2036090
  misc_feature (31)..(75): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLLAFKMSLLLLLSLPLLLSRANSETVTQLEREAEALLRWKSNFDDVSGQLASGCLKSWSNHISPCNWTGVACITTVPHGRGWSGGDAVPVVGRISLPMCNLSGRLDVLDFMALPRLAHLDLNDNNLSGPVPPSIGALGELTLLDLSSNALSGPIPPSIGNLTSLTYLGLSQNYQFLNGHLPSTLGMLHNLKKLNLCDNSFTGPIPPSLGNLTSLDFIGISFNNLSGSIPHE

SEQ ID NO: 47402 - DNA, 679 bp, Panicum virgatum
  misc_feature: Ceres CLONE 2036092
  misc_feature: Encodes the peptide sequence at SEQ ID NO. 47403
attcgttgcggcctcgacctcgacctcgattcgattcgcccccctcctcttccttccatcggaggcaacaaggaaccaagcacgagctcctcctcctcctcctcctcctcccagagagaccgagagggagggttccgctctactcttccccgacaccactccgccaccgccgcatcccccaactcccgcaagatccgccgggtgcccgggctgtcgatttctcgggaggaggaggggttaacctttgtggggggaaacaatgtactttgagggctatggctaccatggaaacactttcgagcagacatatcgctgctacccagcatctttcattgacaagccacaacttgaggctggtgacaaaattattatgccaccatcggctcttgatcgtctcgcatctctgcatattgagtatcctatgctttttgaagtccacaatacggcagcagaacggacttcacattgtggtgttctggagttcattgcagaagaaggcatgatctatatgccatattggatgatgcaaaatcttcttctgcaagagggagatatggtgttcataaaaaatgcgaacctccccaagggcaaatatgtcaagttgcagcctcatacaacagactttttggatatctcaaaccccaaagcaatcttggagaaaactttgaggaacttttct

SEQ ID NO: 47403 - protein, 139 aa, Panicum virgatum
  misc_feature: Ceres CLONE 2036092
  misc_feature (10)..(139): Pfam Name: UFD1 Pfam Description: Ubiquitin fusion degradation protein UFD1
MYFEGYGYHGNTFEQTYRCYPASFIDKPQLEAGDKIIMPPSALDRLASLHIEYPMLFEVHNTAAERTSHCGVLEFIAEEGMIYMPYWMMQNLLLQEGDMVFIKNANLPKGKYVKLQPHTTDFLDISNPKAILEKTLRNF

SEQ ID NO: 47404 - DNA, 628 bp, Panicum virgatum
  misc_feature: Ceres CLONE 2036093
  misc_feature: Encodes the peptide sequence at SEQ ID NO. 47405
agaacagtcctgcttcgttctcccctttcaccccaccctctcccgccctctctctctctctctctctctctctccctgcgacgactcggcgagcggtggcgcccttcgcaggtcttcgtcggaggcgaagaacacccgcttgggtccgcccctggttacagcagcagtgtactttggcgatggatgcttgtgcgggatgttgagttcttgataggatggagggagaacggaccgaaggcgatgagctgattgacgattatgtcgattgcctcatgtctctggacaccaacgctcgggctggcccgagcgatgctctcattctcggtgctcctgttgtggaaggggcggctggaggcggaacggaggcggatgccatgagagattttgcttctgctgaggaccccaatgagcctgtgctcggcatgacattcgagtctgacgaggctgcaaaggcgttctacaatgagtatgccaggcggctcggtttcccctttcgtgttggcaggtctcggcgctccaagggcactgaggaggtagttgtcatgaagaggttcgtttgctccagggaaggggtgtacaagaagaaacagacctcaccggatgaggctacaaggaagcgtgagaggat

SEQ ID NO: 47405 - protein, 137 aa, Panicum virgatum
  misc_feature: Ceres CLONE 2036093
  misc_feature (80)..(137): Pfam Name: FAR1 Pfam Description: FAR1 family
MEGERTEGDELIDDYVDCLMSLDTNARAGPSDALILGAPVVEGAAGGGTEADAMRDFASAEDPNEPVLGMTFESDEAAKAFYNEYARRLGFPFRVGRSRRSKGTEEVVVMKRFVCSREGVYKKKQTSPDEATRKRER

SEQ ID NO: 47406 - DNA, 700 bp, Panicum virgatum
  misc_feature: Ceres CLONE 2036118
  misc_feature: Encodes the peptide sequence at SEQ ID NO. 47407
gaaacggaagcaaacgcaagcggcggcgatggcgacgacagcggccgacggccccccggtggagccgcagtccctgaagaagctgagcctccggtcgctgaagcgctccctggacctcttcgctccggcgcacgccctcctcttcacgcctgacgccgagagcaagaggattcgtaccgggtgcaaggtgagggcggagtatggcgcggtgaaggatctgccgccggagcaagggcgcggagggcagggcaagggtcctgcgcagccgtcgtcgacggcgttggcactgccaggaacaaaagatattaaagatggtcacagagaaggcagtagtaatgccattgtccctgtgccacttatgctgccaaaagcacctgagtctaccatacctggcaaaaatacaactctgtcaattcctggatcatctgacaggttttctacatctgcactgatggaaaggatacctagtagatggccacgtcctacatggcatgctccttggaagaactatcgggtcatcagtggtcacttgggatgggttcgatctattgcatttgatccagggaatgaatggttctgcactggttctgctgataggacaataaagatatgggatcttgcatcgggaaccctgaagcttacactgactggtcacattgaacaaattcgtggacttgctgtcagccaacgtcacacttat

SEQ ID NO: 47407 - protein, 223 aa, Panicum virgatum
  misc_feature: Ceres CLONE 2036118
  misc_feature (158)..(196): Pfam Name: WD40 Pfam Description: WD domain, G-beta repeat
  misc_feature: SWISSPROT Homolog: EC 2.3.1.48 Histone acetyltransferase
MATTAADGPPVEPQSLKKLSLRSLKRSLDLFAPAHALLFTPDAESKRIRTGCKVRAEYGAVKDLPPEQGRGGQGKGPAQPSSTALALPGTKDIKDGHREGSSNAIVPVPLMLPKAPESTIPGKNTTLSIPGSSDRFSTSALMERIPSRWPRPTWHAPWKNYRVISGHLGWVRSIAFDPGNEWFCTGSADRTIKIWDLASGTLKLTLTGHIEQIRGLAVSQRHT

SEQ ID NO: 47408 - DNA, 638 bp, Panicum virgatum
  misc_feature: Ceres CLONE 2036132
  misc_feature: Encodes the peptide sequence at SEQ ID NO. 47409
atctccttcctcccccacaaaaacatttctcccccttcggctgcggccgccgctgcctctcaccctttccgcctgccttcaccccctttcccccctccctccttctagggtttcccccgccccaggcaccgtccaactcaggggatccactctacccggagctctggcgcgcctgtgccggcccgctcgtcaccgtcccgcgccccggtgacctcgtcttctacttcccgcagggccacatcgagcaggtggaggcgtccatgaaccaggtcgccggaaaccagatgcgcctctacgatctgccctccaagctgctctgccgggtgctcaacgtggagctcaaggcggagacggagaccgacgaggtctacgcgcagatcatgctcatgccagagcccgagcaaaacgaggtgccgtctgagaaggcgagttctggggccgccgccacgccgaggccagccgtcaggtccttctgcaagactctcacagcgtccgacaccagcacacacggtggcttctctgtgctgcgccgccacgctgacgagtgtctccctcccctggatatgacccagtcacctccaacacaagagcttgtggcgaaggatctgcatggcatggagtggcgcttccgacacatc

SEQ ID NO: 47409 - protein, 211 aa, Panicum virgatum
  misc_feature: Ceres CLONE 2036132
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: The sequence is a functional homolog of SEQ ID NO 298 in the 10/412,699 US patent application
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 696 in the 11/479,226 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 100 in the 10/666,642 US patent application
  misc_feature: Functional homolog of the protein sequence given in SEQ ID NO 50498
  misc_feature: Useful for making plants with modulated light quality sensitivity
LLPPPQKHFSPFGCGRRCLSPFPPAFTPFPPSLLLGFPPPQAPSNSGDPLYPELWRACAGPLVTVPRPGDLVFYFPQGHIEQVEASMNQVAGNQMRLYDLPSKLLCRVLNVELKAETETDEVYAQIMLMPEPEQNEVPSEKASSGAAATPRPAVRSFCKTLTASDTSTHGGFSVLRRHADECLPPLDMTQSPPTQELVAKDLHGMEWRFRH

SEQ ID NO: 47410 - DNA, 687 bp, Panicum virgatum
  misc_feature: Ceres CLONE 2036135
  misc_feature: Encodes the peptide sequence at SEQ ID NO. 47411
atcaatcgacgacacacccttgcgatggggctggggcggagcaagcccgccgtggaggagctggacccggtcgtggagtggaagctggccggcgacgaccgcgacgtggtggagatctacctgccggggttcaagaaggaccaggtgagggtgcaggtggacgactacggcgtgctgcgcgccactggcgagaggcccggaacgggcggccggtgggtccggttcatgaaggacatccggctcccggagaactgctacgtcgacggcgtccgcgccgagttcatcgagaagctcgtcatcacgctacccatcgtccccgcagaggaagaagctttgtcggagccggagagcgaggcgctgccgtcgccgttggtctcgccgccatctcggccttcgcagccaccgccaccaccaacacctgttactagttatcctgatgagctgccattgccaccaccgcttaaatcaccttcaccttcgcctccggcaaccccacctcgtctgagcccatcaccacctccttctcctactcattttgagccgtcaccacctcggtttccatcacctccgccgcggcctcctccgtcgccgccaccggttgttagttatccgcagctgccattgccgccaccaccaccgcttgaatcacctccagcatccccacgctctccatgctactcggagccg

SEQ ID NO: 47411 - protein, 220 aa, Panicum virgatum
  misc_feature: Ceres CLONE 2036135
  misc_feature (18)..(105): Pfam Name: HSP20 Pfam Description: Hsp20/alpha crystallin family
MGLGRSKPAVEELDPVVEWKLAGDDRDVVEIYLPGFKKDQVRVQVDDYGVLRATGERPGTGGRWVRFMKDIRLPENCYVDGVRAEFIEKLVITLPIVPAEEEALSEPESEALPSPLVSPPSRPSQPPPPPTPVTSYPDELPLPPPLKSPSPSPPATPPRLSPSPPPSPTHFEPSPPRFPSPPPRPPPSPPPVVSYPQLPLPPPPPLESPPASPRSPCYSE

SEQ ID NO: 47412 - DNA, 724 bp, Panicum virgatum
  misc_feature: Ceres CLONE 2036157
  misc_feature: Encodes the peptide sequence at SEQ ID NO. 47413
gcgacacctcttcatcccccgaatcccccccaatccaacatctccaaaggaaaaaaaaaaaaaaatccccaatcctaaacccatgcccagatctcccgaaaatccccaactccaattgaccctccttcgtcgttatcacccctcctaatccgaccccaattccgcccgatgcgattagcagcggcggcataacgaaccggcgcgttccctagggttagggtttcgagggtttgcactagggtttgggcgcacgatggggcggtcccgcggggtgccgaattcaggcgacgacgacaccggccacaggtcgaagcggaggagggtatcgtcgagcggggatgcgactgacaccatttccgcggccatgggaggagcaggcgagggagggggcaagaaggcgctgtaccactgcaactactgtaataaggacatttccgggaagatacggatcaaatgctccaagtgccctgacttcgatctctgcgtcgagtgcttctccgttggcgctgaagtcaccccacaccggagcaaccatccttacagggtcatggacaacctgtctttcccacttatttgcccagattggaatgcagatgaagaaatcttgcttcttgagggaatcgaaatgtatggtctgggaaactggcttgaaagtgcagagcatgttggtaccaagtcaaagttacagtgcattgatcattatactacagcatatatgaactca

SEQ ID NO: 47413 - protein, 156 aa, Panicum virgatum
  misc_feature: Ceres CLONE 2036157
  misc_feature (47)..(92): Pfam Name: ZZ Pfam Description: Zinc finger, ZZ type
  misc_feature (108)..(154): Pfam Name: Myb_DNA-binding Pfam Description: Myb-like DNA-binding domain
  misc_feature: SWISSPROT Homolog: EC 2.3.1.48 Histone acetyltransferase
  misc_feature: The sequence is a functional homolog of SEQ ID NO 106 in the 10/286,264 US patent application
  misc_feature: The sequence is a functional homolog of SEQ ID NO 206 in the 10/412,699 US patent application
  misc_feature: The sequence is a functional homolog of SEQ ID NO 425 in the 11/479,226 US patent application
  misc_feature: Functional homolog of the protein sequence given in SEQ ID NO 51734
  misc_feature: Useful for making plants with modulated cold sensitivity
MGRSRGVPNSGDDDTGHRSKRRRVSSSGDATDTISAAMGGAGEGGGKKALYHCNYCNKDISGKIRIKCSKCPDFDLCVECFSVGAEVTPHRSNHPYRVMDNLSFPLICPDWNADEEILLLEGIEMYGLGNWLESAEHVGTKSKLQCIDHYTTAYMN

SEQ ID NO: 47414 - DNA, 725 bp, Panicum virgatum
  misc_feature: Ceres CLONE 2036179
  misc_feature: Encodes the peptide sequence at SEQ ID NO. 47415
atttatgcattctaaaggctatctgcacagagatatcaagcctgataacttcctcatgggtcttggtcgaaaagctaatcaggtttatgtcattgactttgggctcgccaagagatatcgtgactcaaccaccaatcgccatataccttatagagaaaataaaaacttgacaggcacagctcgctatgctagtcgcaacactcatcttgggattgagcaaagccgtagagatgatttggaatccattggatacgttcttctgtatttcctcaggggaagccttcctttgcagggcttgaaagcagccacgaagaaacaaaagtatgacaaaataagtgagaagaagctttcaactcctattgaggctttatgtaaatcccatcctgtggaatttgcttcctatttccactattgccattctctgacatttgatcagcggcccgattatagtttcttgagacggctctttcgagatttgtttgaccgtgaaggttatcagttcgattatgtctacgactggactttgttaaagtgtaagcaatctcagaaggctaaggctcaacaaggatgctcacaagatgcgggtgtaagcagccgtccagttacaacgaatgtggacaagcacaaagcttcaggtctggatgaagcagagcaacgcccggcaatcagaatgcaattgaagcccagcgttgaaaatagccgttcaataatctgcatcatgatag

SEQ ID NO: 47415 - protein, 241 aa, Panicum virgatum
  misc_feature: Ceres CLONE 2036179
  misc_feature: SWISSPROT Homolog: EC 2.7.11.1 Non-specific serine/threonine protein kinase
  misc_feature: The sequence is a functional homolog of SEQ ID NO 32 in US patent 7179962
FMHSKGYLHRDIKPDNFLMGLGRKANQVYVIDFGLAKRYRDSTTNRHIPYRENKNLTGTARYASRNTHLGIEQSRRDDLESIGYVLLYFLRGSLPLQGLKAATKKQKYDKISEKKLSTPIEALCKSHPVEFASYFHYCHSLTFDQRPDYSFLRRLFRDLFDREGYQFDYVYDWTLLKCKQSQKAKAQQGCSQDAGVSSRPVTTNVDKHKASGLDEAEQRPAIRMQLKPSVENSRSIICIMI

SEQ ID NO: 47416 - DNA, 665 bp, Panicum virgatum
  misc_feature: Ceres CLONE 2036186
  misc_feature: Encodes the peptide sequence at SEQ ID NO. 47417
ctctggttctgctgtcccacacatctttcctatcgataggcgaggggcgacgacgcaaaggcgagtggcgccgcccctgccagttcttcgtctcgtcgccggccgacaaggtatcaaagcttgccatcgtgctcaacctcatccaagcgggggtcatcggtgaagaattgctttagcttccgtgctcatttaaggaaagaggtgccatcaaagaattgctccctcttgttttcagattcttattacagtttgttgcatgccgttacctgtgttcaattacgtattcttctgtggcattacctgttgcagggttcacgctggataaggtctgagcctttcttgtcagcaaatagtgcaaagttcgtcggcaagaggacatcctgttcagttgcaacagagccgcctcctgctgcaaccgaaaaaccagagatggatgctcccaaggaaatattcttgaaagattacaggaaacctgattatttgtttgacaaggtggatttgcaatttcaacttggtgaagaaaagacaatagttacatctaaaatagttgtatctcctggtgttgaaggaagcatctcagctccactagttcttcatggttgtgacctgaagctgttgtcaatcaaagttaatggcaccgagctaaagggcgaagagtatacagt

SEQ ID NO: 47417 - protein, 78 aa, Panicum virgatum
  misc_feature: Ceres CLONE 2036186
  misc_feature: SWISSPROT Homolog: EC 3.4.11.2 Membrane alanyl aminopeptidase
MDAPKEIFLKDYRKPDYLFDKVDLQFQLGEEKTIVTSKIVVSPGVEGSISAPLVLHGCDLKLLSIKVNGTELKGEEYT

SEQ ID NO: 47418 - DNA, 703 bp, Panicum virgatum
  misc_feature: Ceres CLONE 2036200
  misc_feature: Encodes the peptide sequence at SEQ ID NO. 47419
tattgagtgggttgctctaataggacagtctgtctcaattgcatctgctcaatcaggatcagttgggtctgagaattcactggaaacagcttggcgagcagaggctgaaacacttaaatccattctaactggcgcacctcagagtaagctggggagaattgctctcgtggacaccattgctaagcaaatacgtaaacggatgaaaattcggctgcctaacatgctgagcggacttcagggtaaatcccagatagtgcaagatgagcttgcaaggctaggagaatcgatggtacaaagtgctgaaggaaccagagcagttgctctggagctgtgtcgagaatttgaagataaatttcttgctcatattacttctggtgaggggtccggttggaaaattgttgcaagttttgagggcaagtttccagataggatcaaacagcttccactggacaggcattttgatttgaacaatgtgaagaggattgtcttggaagcggatggttatcaaccttatttgatatctcccgagaaaggtttaagatccttaataaaaggagttctggaaatggccaaggagccatcacgactctgtgttgaagaggtacaccgtgttttgttagatatagtaaatgctgctgcaaacgctacaccagggctaggaagataccctcccttcaagcgtgaggtcattgcaattgcatct

SEQ ID NO: 47419 - protein, 233 aa, Panicum virgatum
  misc_feature: Ceres CLONE 2036200
  misc_feature: SWISSPROT Homolog: EC 3.6.5.5 Dynamin GTPase
IEWVALIGQSVSIASAQSGSVGSENSLETAWRAEAETLKSILTGAPQSKLGRIALVDTIAKQIRKRMKIRLPNMLSGLQGKSQIVQDELARLGESMVQSAEGTRAVALELCREFEDKFLAHITSGEGSGWKIVASFEGKFPDRIKQLPLDRHFDLNNVKRIVLEADGYQPYLISPEKGLRSLIKGVLEMAKEPSRLCVEEVHRVLLDIVNAAANATPGLGRYPPFKREVIAIA

SEQ ID NO: 47420 - DNA, 660 bp, Panicum virgatum
  misc_feature: Ceres CLONE 2036225
  misc_feature: Encodes the peptide sequence at SEQ ID NO. 47421
gagctgctaaagccacaccatcacgcttctgagcattctcccgtcctatacccatcaactggtctgtcatcttcatctcggccgcaaggcaaatcaacttgttcgccctgtccagcatctctgcgggtgttctccagcttttctacgattggtttcacaaaatccagagtctctgcgggtgttctccaggtgaactctgcttctggtttgtgaagggtgattccagcgcaccaatagaatgcagaactcacaactttcaagtgcatttccaagggaaccaacactagaatttctaaaacacatcacagaagacttctcaagtgaacgagaggtcggacgtggtggattcggtgtggtttacaagggcatacttcaaagtggacaacaggttactgtgaagaagcttgtgcgaacaacaggaattcatgacagacggtttcagaatgaggttggcaatctcctgatgctggagcacaaaaatatcgtcaagctacttggttcttgctaccacgcagaaaagaaattggtggaggtaaatggcagatttgttttctcagatgtcccggaaaagtttctctgctatgagtatctctctaatggcagccttgacaactacatctatggtgaatcctcccgacttgattggcccatgcgcttcaa

SEQ ID NO: 47421 - protein, 140 aa, Panicum virgatum
  misc_feature: Ceres CLONE 2036225
  misc_feature: SWISSPROT Homolog: EC 2.7.11.1 Non-specific serine/threonine protein kinase
MQNSQLSSAFPREPTLEFLKHITEDFSSEREVGRGGFGVVYKGILQSGQQVTVKKLVRTTGIHDRRFQNEVGNLLMLEHKNIVKLLGSCYHAEKKLVEVNGRFVFSDVPEKFLCYEYLSNGSLDNYIYGESSRLDWPMRF

SEQ ID NO: 47422 - DNA, 677 bp, Panicum virgatum
  misc_feature: Ceres CLONE 2036245
  misc_feature: Encodes the peptide sequence at SEQ ID NO. 47423
cctttcctccttccccgccatccatggcccccgcggcgccggcgggcctcgccgccgccgtgctcgcggtagccctgctcgccgcgtcggcggcggcggccgtcacctacgaccgcaaggccgtggtggtgaacggccagcgccggatcctgctctccggctccatccactaccccaggagcgtccccgagatgtggccggatctgatacagaaggccaaggacggcggcctcgacgtggtgcagacgtacgtcttctggaacggccacgagccctcccctggacagtactacttcgaggggcggtatgatctggtgcacttcatcaagctggtgaagcaggccggactctacgtgcacctccgcattggcccctacgtctgcgccgagtggaatttcggtggtttccctgtttggctcaagtatgtcccaggcatcagctttaggactgataatgggccgttcaaggctgagatgcagaaatttaccacgaagattgttgacatgatgaagtcagaagggctctttgagtggcagggagggccaatcatcctctcccagattgagaacgagtttgggcccttggagtgggatcagggtgaaccagccagggcctacgcgtcgtgggcagctaacatggcacttgcgctgaacacaggtgttccatggatcatgtgc

SEQ ID NO: 47423 - protein, 217 aa, Panicum virgatum
  misc_feature: Ceres CLONE 2036245
  misc_feature (33)..(217): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51324
  misc_feature: Useful for making plants with altered cell wall content and/or composition
  misc_feature: Functional homolog of the protein sequence given in SEQ ID NO 51152
  misc_feature: Useful for making plants with altered carbohydrate content
MAPAAPAGLAAAVLAVALLAASAAAAVTYDRKAVVVNGQRRILLSGSIHYPRSVPEMWPDLIQKAKDGGLDVVQTYVFWNGHEPSPGQYYFEGRYDLVHFIKLVKQAGLYVHLRIGPYVCAEWNFGGFPVWLKYVPGISFRTDNGPFKAEMQKFTTKIVDMMKSEGLFEWQGGPIILSQIENEFGPLEWDQGEPARAYASWAANMALALNTGVPWIM

SEQ ID NO: 47424 - DNA, 706 bp, Panicum virgatum
  misc_feature: Ceres CLONE 2036257
  misc_feature: Encodes the peptide sequence at SEQ ID NO. 47425
atctcgccactcgctacgccccaaaaaacctcacgcgctcccacccctgcccctcgcctcgccgccgcgccggcgagagggggcgctcacccacccgtgccgtgtgtaaccacgccggagcggaggtacctaccccgcgccttatccgctcgcccagatctacctctgcctctcgccgcgtcggggcgatcccgccgaggttccagggtataagctgctgtcatggcaaccaacacaggagcgtcaggatggttgaggggtaaggttaaggctgtgacatcaggggattgtctactcatcatgggaagcacaaaggctgagatcccacctgagaagtccatcactctgtcctaccttatggccccaaggctggctcgccgtggtggagtggatgagcccttcgcatgggaaagcaaagagtttctgagaaagctttgcattggcaaggaggtcacattcagagtggactatacagctcccaatattggacgagaatttggtactgtttatcttggtgacaagaatgttgcatactcggtagtttctgctggatgggcaagggtaaaggagcaaggccccaaggggggtgaacaaaatccataccttactgagctgctaaggttggaggaagttgccaagcaacagggtgttggtcgttggagcaaggaacctggtgctgctgaagagtccataagagatcttccgc

SEQ ID NO: 47425 - protein, 161 aa, Panicum virgatum
  misc_feature: Ceres CLONE 2036257
  misc_feature (9)..(148): Pfam Name: SNase Pfam Description: Staphylococcal nuclease homologue
MATNTGASGWLRGKVKAVTSGDCLLIMGSTKAEIPPEKSITLSYLMAPRLARRGGVDEPFAWESKEFLRKLCIGKEVTFRVDYTAPNIGREFGTVYLGDKNVAYSVVSAGWARVKEQGPKGGEQNPYLTELLRLEEVAKQQGVGRWSKEPGAAEESIRDLP

SEQ ID NO: 47426 - DNA, 623 bp, Panicum virgatum
  misc_feature: Ceres CLONE 2036271
  misc_feature: Encodes the peptide sequence at SEQ ID NO. 47427
tcactgctttcctatccctgtatccccctttcctcccctccccctcacctcctctgccgctgctccaccgatggcgcccacggcggagatgaagctggcggcgatcaagctcgctgaggaggagcccgcggcggagaaggcggagaaggccccggcggggaagaagcccaaggcggagaagcgcctccccgcgggcaagtccagcgccggcaaggacggcgagggcaagaagggcaagaataaggccaagaagagcgtccagacctacaagatctacatcttcaaggtgctcaagcaggtgcacccggacatcggcatctcctccaaggccatgtccatcatgaactccttcatctacgacatcttcgagaagctcgccgccgaggccgccaagctcgcccgctacaacaagaagcccaccatcacctcccgcgagatccagacctccgtccgcctcgtcctccccggggagctcgccaagcacgccgtctccgagggcaccatggccgtcaccaagttcacctcgtcttagttaggtttgccgcctcttgtggtgccagtactagttcggttgggtgctgctgctagacctggctccctcggtttaatttatctggtagaag

SEQ ID NO: 47427 - protein, 153 aa, Panicum virgatum
  misc_feature: Ceres CLONE 2036271
  misc_feature (60)..(130): Pfam Name: Histone Pfam Description: Core histone H2A/H2B/H3/H4
  misc_feature: Functional homolog of the protein sequence given in SEQ ID NO 50160
  misc_feature: Useful for biocontainment applications
  misc_feature: Useful for making plants with modulated flowering time
MAPTAEMKLAAIKLAEEEPAAEKAEKAPAGKKPKAEKRLPAGKSSAGKDGEGKKGKNKAKKSVQTYKIYIFKVLKQVHPDIGISSKAMSIMNSFIYDIFEKLAAEAAKLARYNKKPTITSREIQTSVRLVLPGELAKHAVSEGTMAVTKFTSS

SEQ ID NO: 47428 - DNA, 668 bp, Panicum virgatum
  misc_feature: Ceres CLONE 2036275
  misc_feature: Encodes the peptide sequence at SEQ ID NO. 47429
atccatccgtctccgctgcttgcgatccagcagaattcccggttgccggccccctccattggcggacctccggcaacggcaagccccccgggccccggcggctcaaaccgtctctcacgctccccccccatgggctccgtttctctcaagtgggccccggaagatccagctactcgcgtgcatccacgtggcactggcagtcgagccggctataaatcccccgccccgggcgctcctccccgatcacaccccaaagcagcgcagccgcctcattcctcctctccatcctcccctctctctctctctctctctctctcgccgctcttcccgttccgttccaggagagcagtgaggcgggtagtagtggtcgcctggtcggggaggggaggcaagatgttcatcgagagcttccgcgtggagagcccgaacgtgcggtacggcccgtcggagatcgagtcggagtaccggtacgacacgacggagctggtgcacgagggcaaggacggcgcctcccgctgggtcgtccgccccaagtccgtcaagtacaacttccggacccgcaccgccgtccccaagctcggggtgatgctcgtggggtggggcggcaacaacgggtccacgctgacggctggggtcatcgccaacagggaggggatctcatgggcgac

SEQ ID NO: 47429 - protein, 91 aa, Panicum virgatum
  misc_feature: Ceres CLONE 2036275
  misc_feature: SWISSPROT Homolog: EC 5.5.1.4 Inositol-3-phosphate synthase
MFIESFRVESPNVRYGPSEIESEYRYDTTELVHEGKDGASRWVVRPKSVKYNFRTRTAVPKLGVMLVGWGGNNGSTLTAGVIANREGISWA

SEQ ID NO: 47430 - DNA, 677 bp, Panicum virgatum
  misc_feature: Ceres CLONE 2036288
  misc_feature: Encodes the peptide sequence at SEQ ID NO. 47431
atctgccgtcgcccgactcgcaccgtagcacacaaccctcacgttccgtccccagccaccgcctcgttccgccgccgtcgtcgggtggtcgagagaagagatggcgggccgtggcaaagcgatcggcgcgggcgcggcgaagaaggcgacgtcgaggagctccaaggccgggctccagttccccgtcggcaggatcgccaggttcctcaaggccggcaagtacgccgagcgcgtcggcgccggcgcccccgtctacctcgccgccgtcctcgagtacctcgccgctgaggttctcgagctggccgggaacgccgcgagggacaacaagaagacccgtatcgtgccgcgccacatccagcttgccgtccgcaacgacgaggagctctcgcgcctgctgggcacggtgaccatcgcgagcgggggtgtcatgcccaacatccacaacctgctgctccccaagaagtacgcggcggcagcgccaaggctgtggccggcgatgaggactagatccctgactgcaccgtccttcgggtggtcgtgcttcttgtggatgccgcgtatcacttgtgcttgtgtagtagtgtcttctagactcgcctagtagggaggttgtatgtgtgtgcctgtaccgatgctaaaactagtttactcttggttcgctaaggattaattttttt

SEQ ID NO: 47431 - protein, 166 aa, Panicum virgatum
  misc_feature: Ceres CLONE 2036288
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKYAAAAPRLWPAMRTRSLTAPSFGWSCFLWMPRITCACVVVSSRLA

SEQ ID NO: 47432 - DNA, 694 bp, Panicum virgatum
  misc_feature: Ceres CLONE 2036291
  misc_feature: Encodes the peptide sequence at SEQ ID NO. 47433
gcaaagccacacgcaccccgacccgttcccaggcggccaggccatcacaccaccaccacctccctcccccgtccgcgcctcgccgccgccgccgctgccgccgtcgccgttgcggcctgccggcctgcgatggcgaagacccgaaagcctcctcccccacccccgccccccgcagaaacgccatccccgcagcggcggcgcaagaagaagggccgcccctccctcctcgacctccaacgccgcagcctccgtctccagccccaaaaccctaccccggccccctcaccctcccgccgggaccccaacccctctgatgacgatgatgatggggcagggagcgggcggcggcggcagaagcgcctcaagagcgtcctctccggcgtcgttaaggaggaggcgggggaaggaaagaaggacgcagcgaaagtgacggggaaaggagttgctgcgttggatggcggcgggcccacggggacgcccctcccagacaaaaagttgctgctcttcatcctcgataggctccagaagaaggatacttatggagttttctcagagcctgtcgacccagaggagcttccagattaccatgagattattgagcatccgatggacttctcgacaatccgtgagaagctgttgaatgactcgtattctaacttggagcagtttgaggacgatatatttctacttacat

SEQ ID NO: 47433 - protein, 188 aa, Panicum virgatum
  misc_feature: Ceres CLONE 2036291
  misc_feature (120)..(188): Pfam Name: Bromodomain Pfam Description: Bromodomain
  misc_feature: SWISSPROT Homolog: EC 2.3.1.48 Histone acetyltransferase
MAKTRKPPPPPPPPAETPSPQRRRKKKGRPSLLDLQRRSLRLQPQNPTPAPSPSRRDPNPSDDDDDGAGSGRRRQKRLKSVLSGVVKEEAGEGKKDAAKVTGKGVAALDGGGPTGTPLPDKKLLLFILDRLQKKDTYGVFSEPVDPEELPDYHEIIEHPMDFSTIREKLLNDSYSNLEQFEDDIFLLT

SEQ ID NO: 47434 - DNA, 686 bp, Panicum virgatum
  misc_feature: Ceres CLONE 2036303
  misc_feature: Encodes the peptide sequence at SEQ ID NO. 47435
acctccattgacttccttcttccagggtgctcttcatcgttcttggcttctgctttcctctccactctccggccggccgtgtcgtcctagctagccacaagcctcccacattgctcaccgcaagagctccttcgtttggttgcttccatcccatcccggcagcagccatgatcacggcgctggacctgtaccacgtcctcacggccgtggtgccgctgtacgtggccatgacgctcgcctacggctccgtccgctggtggcgcatcttcaccccggaccagtgctccggcatcaaccgcttcgtcgcgctcttcgccgtcccgctcctctccttccacttcatctccaccaacaaccccttccagatgaacctccgcttcctcgccgccgacacgctccagaagctcaccgtcctcgcgctgctcctcttgtctgcccgcctccccttcgcatcctccgtcctcaacctcgactggagcatcacgctcttctccctctccacgctccccaacacgctcgtcatgggcatcccgctgctccggggcatgtacggccccgactccgccggcacgctcatggtccaggtcgtcgtcctccagtgcatcatctggtacacgctcatgctcttcctcttcgagtaccgagccgcgcgcgccctcgtcatggaccagttccccgacggcgcc

SEQ ID NO: 47435 - protein, 172 aa, Panicum virgatum
  misc_feature: Ceres CLONE 2036303
  misc_feature (9)..(172): Pfam Name: Mem_trans Pfam Description: Membrane transport protein
MITALDLYHVLTAVVPLYVAMTLAYGSVRWWRIFTPDQCSGINRFVALFAVPLLSFHFISTNNPFQMNLRFLAADTLQKLTVLALLLLSARLPFASSVLNLDWSITLFSLSTLPNTLVMGIPLLRGMYGPDSAGTLMVQVVVLQCIIWYTLMLFLFEYRAARALVMDQFPDG

SEQ ID NO: 47436 - DNA, 734 bp, Panicum virgatum
  misc_feature: Ceres CLONE 2036311
  misc_feature: Encodes the peptide sequence at SEQ ID NO. 47437
acgcagtggtgtgccgtgccgcactgcctgccctgcgcccctgccatctccgaccataactctcacccgccccgcacgcctgcctgtctgtccctcccgctctgctccgcacactcggcgcaggtgcagcgtccctgctctgctccccacccggcgcccgcattgctgccggagagctgaggcggaccaccggccgcggcggcggaaccaggaggaggaggaggggcaggaagagaggcggcaggatgttcgggcgggacccgtggggcgggccgctggagatctccaacgccgactcggcgacggacgacgaccggagccgggacctggaccgggcggcgctgatgcggcagctggacgagacgcagcagagctggctcctagccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcccagcgatctggtccgctgcccaagcacaacggcgtcagctggaggggcaattcctgcatgaaggacggcctctcggacagcaccgtccggcggagcttggtcggaggcttctacgatgca

SEQ ID NO: 47437 - protein, 162 aa, Panicum virgatum
  misc_feature: Ceres CLONE 2036311
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIGFIMMIVKLVPHKRPPPPPPDQYTQALHKALMFFNAQRSGPLPKHNGVSWRGNSCMKDGLSDSTVRRSLVGGFYD

SEQ ID NO: 47438 - DNA, 752 bp, Panicum virgatum
  misc_feature: Ceres CLONE 2036318
  misc_feature: Encodes the peptide sequence at SEQ ID NO. 47439
atcaaacccccagacttttccgccagcgccatcctcagccgccaagccttcgagaaccctccggagctcgctcgatccgatcggacccggcgcgggctgccgccatggccgacgaggcgaaggccaagggtaatgcggcgttctccgccggccgcttcgaggaggcggcgcggcacttctcggacgccatcgcgctcgccccgggcaaccacgtcctctactccaaccgctccgccgcgctcgcctcgctccaccgctactcggacgcgctcgccgacgcgcagaagaccgtcgagctcaagcccgactgggccaagggctactcgcggctcggcgccgcgcacttcggcctcggcgacgccgccagcgccgtcgccgcctacgagaaggggctcgcgctcgaccccaccaacgagggccttaaggcggggctcgaggacgccaggaaggccgccgccgccccgccgcgccgcgggccgtccgggcccgacgccatcggccagatgttccagggccccgagctgtggagcaagatcgcggccgaccccaccacgcgcgcctaccttgaccagccagactttatgcagatgctgcgcgaggtgcagaggaacccaagcagcctcaacatgtacctctccgatccccgcatgatgcaggtgctcagcctcatgcttaatatcaagatccagagacccgaggcctccgagccgtcgcagtctaccccggcgtcgccgcagcagcagcagcagacg

SEQ ID NO: 47439 - protein, 215 aa, Panicum virgatum
  misc_feature: Ceres CLONE 2036318
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFSDAIALAPGNHVLYSNRSAALASLHRYSDALADAQKTVELKPDWAKGYSRLGAAHFGLGDAASAVAAYEKGLALDPTNEGLKAGLEDARKAAAAPPRRGPSGPDAIGQMFQGPELWSKIAADPTTRAYLDQPDFMQMLREVQRNPSSLNMYLSDPRMMQVLSLMLNIKIQRPEASEPSQSTPASPQQQQQ

SEQ ID NO: 47440 - DNA, 716 bp, Panicum virgatum
  misc_feature: Ceres CLONE 2036326
  misc_feature: Encodes the peptide sequence at SEQ ID NO. 47441
ctattggggcattttcccttttccatcgagtcaccggcgcttcgccgcggcaggagcctagagcgcgagaccgagcagaaatgtcggcgatgctggcggcgcggctggattccactgccatcccctcaccccagttgccctcgccaagcatccgcctccgcttctcgccgcccgcaggctcccgctcccgctccctcgcccccgccccgcgggcggcggcctcggcgaccgccgtcgccactaaaccggcggcggcggctgcggctcccttgtccgcggatcgcaccgtcgtgcgcattgggctccccagcaagggccgcatggcggagcaaaccctaagcctcctcaagagttgtcaattgtcggtgaggcagctcaacccgcggcagtacactgccgtcatcccgctgattccaaatctggaggtttggtttcaaaggcctaaagatattgtccgtaaactgcagtcaggggatcttgaccttggtattgtggggtttgacacagtcagtgaatatgggcaggtaaatttatgaagaatcaagttagatcttttctctaatataaatttgtgtaaattgaacacattgtactttacatgaactttttgtgaagaaaatcattatgattttgttgcacttgttgggcgtttatgtggtttaagatttatgtgacaggtcaatgatgacttagtagttattcatgatgctctggat

SEQ ID NO: 47441 - protein, 151 aa, Panicum virgatum
  misc_feature: Ceres CLONE 2036326
  misc_feature: SWISSPROT Homolog: EC 2.4.2.17 ATP phosphoribosyltransferase
MSAMLAARLDSTAIPSPQLPSPSIRLRFSPPAGSRSRSLAPAPRAAASATAVATKPAAAAAAPLSADRTVVRIGLPSKGRMAEQTLSLLKSCQLSVRQLNPRQYTAVIPLIPNLEVWFQRPKDIVRKLQSGDLDLGIVGFDTVSEYGQVNL

SEQ ID NO: 47442 - DNA, 742 bp, Panicum virgatum
  misc_feature: Ceres CLONE 2036332
  misc_feature: Encodes the peptide sequence at SEQ ID NO. 47443
atcttcctccaccctgccccccaccaccgccacggccgctctctcctccgtcctccctctccgtccgtccatcggccgcgacccgcgacaaaaaaaaaattgcctggagcctttccttttcgtggatcccttccacttccccacgaggcaaccagccagcgctaattccattccttaattgccaatggcgaccgcttgggccagtacggccttgccgcgggcgccttgggataaactccgcggcaaggaaggcacccggtgccgccttaatagcctcttcagtcttccccccgtggcagctctggtcccgcgggttgtggtagggcaccgccatgggtggtcttgctggccctggcttcgtgctgctttcatgggtgcttttctccccctgcctcttctcagtggatgggctgtccaaggtgagggctgttaacttgggaggatggctggtggttgaagggtggattaagccatcactttttgacgggattccaaatggggatatgctagatgggactcaggtgcagctccgctctgttgtgttgaataaatatgttagtgcagccaatgggggtggttcaaatgtgacagtggaccgtgatgtggcctcaacatgggagacatttagggtgagaagtacatggaacctattagtctggtttaagaagtatcagtctattgacttgtatactttacaagtgatacacctctgcattatacagctagggtattggatgaaatt

SEQ ID NO: 47443 - protein, 136 aa, Panicum virgatum
  misc_feature: Ceres CLONE 2036332
  misc_feature: SWISSPROT Homolog: EC 3.2.1.58 Glucan 1,3-beta-glucosidase
MGGLAGPGFVLLSWVLFSPCLFSVDGLSKVRAVNLGGWLVVEGWIKPSLFDGIPNGDMLDGTQVQLRSVVLNKYVSAANGGGSNVTVDRDVASTWETFRVRSTWNLLVWFKKYQSIDLYTLQVIHLCIIQLGYWMK

SEQ ID NO: 47444 - DNA, 675 bp, Panicum virgatum
  misc_feature: Ceres CLONE 2036350
  misc_feature: Encodes the peptide sequence at SEQ ID NO. 47445
gaactagttcttggcctcgtcttcctgctcctgccatcacgcccgccccccaaattcacctcgcccgccgtcaccctcctccgcctcgtcggcgcggaccggcagccaaagtcgcgggccactgcatcgcgctcctggcgcgtgccgtgcgtccatctctctgcctcatctcccgagcgcattccacgccactcctgtgccgccacccagaggccctcctcgccgcgcgcctccccctccccctctccctctccggctcccacatcctcctctcccattcagtaagcaagatctgcagtattgcttaacatatttggtgccccatcttgttcagtttaaagatcagcgcgcaagttgtacgggccgtgcatttaggttcatgttgcatcataagggatgaacagcagtcgacaaatggaactccactacataaacactggatttccgtacactgttaccgagagcttcatggatttctttgaaggtctcacctatgctcatgctgactttgctcttgcggatggctttcaggatcagggtaatccatactgggcaatgatgcatgcaaactcgtacaagtatggatattctgctccagggaactattacagttacgcccatgcctacgacatagatgattacatgcatagagcagatggtgggcgcagaatatgg

SEQ ID NO: 47445 - protein, 92 aa, Panicum virgatum
  misc_feature: Ceres CLONE 2036350
  misc_feature: Functional homolog of the protein sequence given in SEQ ID NO 50438
  misc_feature: Useful for making plants with altered terpenoid content
MNSSRQMELHYINTGFPYTVTESFMDFFEGLTYAHADFALADGFQDQGNPYWAMMHANSYKYGYSAPGNYYSYAHAYDIDDYMHRADGGRRI

SEQ ID NO: 47446 - DNA, 719 bp, Panicum virgatum
  misc_feature: Ceres CLONE 2036352
  misc_feature: Encodes the peptide sequence at SEQ ID NO. 47447
agttttcatttgaataggcgagcggggaagcatctcataaaccaccctccgctccgccgacccgtccccaaccctagcctccctcccgcgccgccccgacgtgacgccgcccggacctcgtgtgctccagtgcggcggggattcgttcgggcccggattgatttcctctctgcgcggatagggcatttgctacagccatggatattactcaaattctgctagctgctcaatctccggatgctaaccttcgaacagtagcagaaagcaacctcacacagttccaggagcagaatcttccaaacttcctcctctccttatcagtggaactctcgaatgatgaaaaacccccagagtctagaaggcttgctggtattatccttaagaattctttggatgcaaaggattctgcaaaaaaggagctattgactcagcaatgggtcagtgtggatccttctatcaaatcgaagatcaaggactcgttgctggtaacactaggatcttcggtgcatgatgcaaggcatacctcatcacaagttattgccaaggttgcatcaattgagatcccacgtcgagaatggctagacctcattgccaagttattgggaaacatgacactaccgggtgcatcagctcctttgaagcaagcaacactagaggcattggggtatgtatgtgaggagatttctccgcagcacttggagcaggatcaagtgaatgct

SEQ ID NO: 47447 - protein, 173 aa, Panicum virgatum
  misc_feature: Ceres CLONE 2036352
  misc_feature (21)..(101): Pfam Name: IBN_N Pfam Description: Importin-beta N-terminal domain
MDITQILLAAQSPDANLRTVAESNLTQFQEQNLPNFLLSLSVELSNDEKPPESRRLAGIILKNSLDAKDSAKKELLTQQWVSVDPSIKSKIKDSLLVTLGSSVHDARHTSSQVIAKVASIEIPRREWLDLIAKLLGNMTLPGASAPLKQATLEALGYVCEEISPQHLEQDQVN

SEQ ID NO: 47448 - DNA, 636 bp, Panicum virgatum
  misc_feature: Ceres CLONE 2036354
  misc_feature: Encodes the peptide sequence at SEQ ID NO. 47449
agagaaatggtgcagcggtgaaagggaggcacgaagggggagggttaggaggggaggagctgctgaagccgcagtctggcgcagacatggctggggcggccattggggtggtggtcctgttcttggctgcagctccatttggggctaatgccaacaccgactcgaacgatgtaaacgccctcaatgtcttctacacaaccatgaattcgccaccccagctgacgaactgggtgtcccaaaatggggatccctgtggagagtcgtggcttggggtcacatgctccggttccagagtgacaacaataaagttatctggaatgcggcttaatgggaccttggggtacaacatgaatcaactaactgcactagttcaactcgatatgagcaacaacaatcttggaggcagtgacatcccttacaatcttcctccaaatctcgagagtttaaatcttgccagcaataacttcactgggactgtaccttactccatctcccagatggttgcatttaagaatttaaatcttggtcataatcagctctcaaacatcaatgatatgttcaatcagctcacaaatttaacaacattggatttgtcacaaaacaacttttctggtaatcttccacagagctttgact

SEQ ID NO: 47449 - protein, 211 aa, Panicum virgatum
  misc_feature: Ceres CLONE 2036354
  misc_feature (53)..(94): Pfam Name: LRRNT_2 Pfam Description: Leucine rich repeat N-terminal domain
  misc_feature: SWISSPROT Homolog: EC 2.7.11.1 Non-specific serine/threonine protein kinase
RNGAAVKGRHEGGGLGGEELLKPQSGADMAGAAIGVVVLFLAAAPFGANANTDSNDVNALNVFYTTMNSPPQLTNWVSQNGDPCGESWLGVTCSGSRVTTIKLSGMRLNGTLGYNMNQLTALVQLDMSNNNLGGSDIPYNLPPNLESLNLASNNFTGTVPYSISQMVAFKNLNLGHNQLSNINDMFNQLTNLTTLDLSQNNFSGNLPQSFD

SEQ ID NO: 47450 - DNA, 751 bp, Panicum virgatum
  misc_feature: Ceres CLONE 2036370
  misc_feature: Encodes the peptide sequence at SEQ ID NO. 47451
acatactctatcccctgcctttcatcattccttcttcatctcttatcttccaaacacacatacagacacacaccaaagccgaacgggagatagatacaaagttacgaacacaaagatgaggcgtgggctaaaaggtctcaccttcctgcttctccttgtcttgcttgttctgtgctccagcattcgtctatgctatgcaagaagtgggaagcattggaggcgaagcagagcgacctccacctctatgctgagaaaagggaaaccaaagagcagcagttcccacaagcaaaacggcaaaggaaataggagtccataccagccaagtccgagcacaagccctgtcagcccgagcacaagccctgtccagagtaaaggaggccagggtccaacaatgccaacaccaggcggtggcagtgggtgtacagtgccacctccaccaccgttgcagccgcctccactgccgtctccaccggcagcgcacgacacaatcttcaacgtggttgattttggagccaagggtgatggggttacggatgatactcaggcttttgaagcagcatgggcagcagcatgcaaggtggaggcatctacggttcttataccatctgaactcgagtttgtcgttggcccaatctcattttctggaccttactgtaaaccaaacattctattccagctggatgggactattttagctcaaactagtacgagagtgtggggttctggtttgcttcaatgggcttgagttcac

SEQ ID NO: 47451 - protein, 209 aa, Panicum virgatum
  misc_feature: Ceres CLONE 2036370
  misc_feature: SWISSPROT Homolog: EC 3.2.1.15 Polygalacturonase
  misc_feature: Functional homolog of the protein sequence given in SEQ ID NO 50988
  misc_feature: Useful for making plants with altered carbohydrate content
MRRGLKGLTFLLLLVLLVLCSSIRLCYARSGKHWRRSRATSTSMLRKGKPKSSSSHKQNGKGNRSPYQPSPSTSPVSPSTSPVQSKGGQGPTMPTPGGGSGCTVPPPPPLQPPPLPSPPAAHDTIFNVVDFGAKGDGVTDDTQAFEAAWAAACKVEASTVLIPSELEFVVGPISFSGPYCKPNILFQLDGTILAQTSTRVWGSGLLQWA

SEQ ID NO: 47452 - DNA, 672 bp, Panicum virgatum
  misc_feature: Ceres CLONE 2036372
  misc_feature: Encodes the peptide sequence at SEQ ID NO. 47453
gtagcccagatcaaacgacccaagtagccagcgggagcacgagaaaaaaaaatcgaagcgaaaaaagcggtggtgaaaagcttgggggagaagagaggagaggagcgcggcataaatcccgagccccaaatcgcaaaccctagcggcttccgatctgcaatgcggaggctgtgagtgagcgagggtggggggatgaggcgggtggcgccggcgatgatcgccgtcggcggcgctggcggcgaggagacggcggagggggcggtggtggagaagacgctgcagaacggcgacgtctaccgcggcggcttctcccagggcgtgccgcacggcaagggcaagtacgtgtgggcggacggctgcatgtaccagggggagtggcggaaggggaaggcgtccgggaagggccggttctcgtggccgtccggggccaccttcgagggggagttccgcggcggccggatcgaggggcagggcgcgttcgtcgggcccgacggcgccacctaccgcggcgcctgggtggcggaccgccgccacggcgtgggcgccaagagctacgccaacggggactactacgagggccagtggcggcgcaacctccaggacggccacggccgctacgtctgggccaacggcaaccagtacgtcggggagtggcgcgccggggtgctctcc

SEQ ID NO: 47453 - protein, 159 aa, Panicum virgatum
  misc_feature: Ceres CLONE 2036372
  misc_feature (127)..(149): Pfam Name: MORN Pfam Description: MORN repeat
  misc_feature (35)..(57): Pfam Name: MORN Pfam Description: MORN repeat
  misc_feature (58)..(80): Pfam Name: MORN Pfam Description: MORN repeat
  misc_feature (81)..(103): Pfam Name: MORN Pfam Description: MORN repeat
  misc_feature (104)..(126): Pfam Name: MORN Pfam Description: MORN repeat
  misc_feature: SWISSPROT Homolog: EC 2.7.1.68 1-phosphatidylinositol-4-phosphate 5-kinase
MRRVAPAMIAVGGAGGEETAEGAVVEKTLQNGDVYRGGFSQGVPHGKGKYVWADGCMYQGEWRKGKASGKGRFSWPSGATFEGEFRGGRIEGQGAFVGPDGATYRGAWVADRRHGVGAKSYANGDYYEGQWRRNLQDGHGRYVWANGNQYVGEWRAGVL

SEQ ID NO: 47454 - DNA, 703 bp, Panicum virgatum
  misc_feature: Ceres CLONE 2036377
  misc_feature: Encodes the peptide sequence at SEQ ID NO. 47455
cactccacactcgccttcaaccttagcctcctctgctttttcggctgcggccaaagtttgcgatcagagcgagtttagatctgagagtaagaaaccgtcgcgtacctcgccgctgttgcatcctcacccttgccatggctgagaaggtcactatccttccgccccgcgacccgtggccgttctcctccgtctccgcggaggacctgcaagagctcgtagacggaggtatgctccaccccgccatccccgaggggcacccaaggtggctcgttcctagagaagaggaggagccgaatccgcccgtgggctacgttgtcagcttcgtttcgttccacgagcgcgggttcggggtgccgccgagccgcttcatgcgggcgctcctgtattactccggcgtcgagctccataatttcaaccccaactccatcgcgcaggcggcgatcttcgcggcggtttgcgagggatttcttggaatcgatccccactgggatctctgggtccacctcttccgcgcagagcccttttccaatctgacagagacgaagaaggtccgcactgcggtgagggccggcggatgcacgctgcagctgggggcggaccgggtgcatcagtacatcccggcctccctcacctcgtcgaacaaggggtggcagagccgctggttctacctccgcaacgacgatggttggctgcccccgtacac

SEQ ID NO: 47455 - protein, 189 aa, Panicum virgatum
  misc_feature: Ceres CLONE 2036377
  misc_feature (1)..(189): Pfam Name: Transposase_28 Pfam Description: Putative gypsy type transposon
MAEKVTILPPRDPWPFSSVSAEDLQELVDGGMLHPAIPEGHPRWLVPREEEEPNPPVGYVVSFVSFHERGFGVPPSRFMRALLYYSGVELHNFNPNSIAQAAIFAAVCEGFLGIDPHWDLWVHLFRAEPFSNLTETKKVRTAVRAGGCTLQLGADRVHQYIPASLTSSNKGWQSRWFYLRNDDGWLPPY

SEQ ID NO: 47456 - DNA, 653 bp, Panicum virgatum
  misc_feature: Ceres CLONE 2036453
  misc_feature: Encodes the peptide sequence at SEQ ID NO. 47457
aaaaagcaagcacccagtgttagctccgcaccacgcacggggagggaagaagagagaagctaggcggagcagcagctgcagcagcggctgcgattaacgccagacagataggtagtagaggaagaaagggggagaggggaggaagggctaactgagaggcgaactcaaggagagggcagctgcagcagcaagtataggtagctagctagctcggaggcaatgaggtcgtcgttgcggcggagcgtggttgcggcggccgtagtggcgctggcggcggcgtggtgcgcggcggcgcagctgaaccagagctactacgcgtcgacgtgccccaacgtggagaccctggtccgcggcgccgtcacccagaagctgcaggagaccttcaacgccgcgccgggcacgcttcgcctcttcttccacgactgcttcgtcaggggctgcgacgcctcggtgctgctgtcgggccccgacgacgagcacagcgccggcgccgacacgacgctgtccccggacgcgctggacctcgtcacccgcgccaaggccgccgtcgacggcgacccgtgctgcgccaacaaggtctcctgcgccgacatcctcgcgctcgccgcccgcgacgtcgtctcgcaggtaggagtactaccgatcccgagctc

SEQ ID NO: 47457 - protein, 144 aa, Panicum virgatum
  misc_feature: Ceres CLONE 2036453
  misc_feature (43)..(144): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51490
  misc_feature: Useful for making plants with altered carbohydrate content
  misc_feature: Functional homolog of the protein sequence given in SEQ ID NO 50952
  misc_feature: Useful for making plants with altered cell wall content and/or composition
MRSSLRRSVVAAAVVALAAAWCAAAQLNQSYYASTCPNVETLVRGAVTQKLQETFNAAPGTLRLFFHDCFVRGCDASVLLSGPDDEHSAGADTTLSPDALDLVTRAKAAVDGDPCCANKVSCADILALAARDVVSQVGVLPIPS

SEQ ID NO: 47458 - DNA, 656 bp, Panicum virgatum
  misc_feature: Ceres CLONE 2036472
  misc_feature: Encodes the peptide sequence at SEQ ID NO. 47459
gctccgccctcctcgcgattgcggcgacggggcggcgagatagctcccagaaacaataaagctggataaagaagagagaagttgacagagaagagacggagcgaagcaccgccgccggccatggcgaccggggatcggacccgaagcttcatgaaggacgtgaaacgcgtcatcatcaaggtgggcactgcggttgtcaccagacaagatgggcgattggctttgggcaggcttggagctctgtgcgagcaggtgaaggaactgaacacccttgagtacgaggtgatcatggtcacctcaggtgctgtcggtgttgggaggcagaggctcaagtaccggaagcttgtcaatagcagctttgctgatctgcaaaagccccagatggagctggacggaaaggcttgtgctgctgttggtcagagtggcctcatggctctttatgacatgttatttacccaacttgatgtgtcctcttctcaacttcttgtgacagaccgtgattttgagaacccaaacttccgggagaggctccgcgaaaccgttgagtcactgttagatcttaaagttgtgccggtgtttaatgaaaatgatgctatcagcacaagaaaggctccatatgaggattcatctggtatattttgggataatgatagttc

SEQ ID NO: 47459 - protein, 178 aa, Panicum virgatum
  misc_feature: Ceres CLONE 2036472
  misc_feature (15)..(178): Pfam Name: AA_kinase Pfam Description: Amino acid kinase family
  misc_feature: SWISSPROT Homolog: EC 2.7.2.11 Glutamate 5-kinase
MATGDRTRSFMKDVKRVIIKVGTAVVTRQDGRLALGRLGALCEQVKELNTLEYEVIMVTSGAVGVGRQRLKYRKLVNSSFADLQKPQMELDGKACAAVGQSGLMALYDMLFTQLDVSSSQLLVTDRDFENPNFRERLRETVESLLDLKVVPVFNENDAISTRKAPYEDSSGIFWDNDS

SEQ ID NO: 47460 - DNA, 624 bp, Panicum virgatum
  misc_feature: Ceres CLONE 2036500
  misc_feature: Encodes the peptide sequence at SEQ ID NO. 47461
aaaaaaaaaaaaaagatgatgtttggcagcatggggtatggaccaatctcctaagaactccatttgactctgcggctacaggtatagttttgataaccactcggaatgatacaattgcacgagcaattggggtggaatatcttcatcgagttgatttgatgtccccagaagtaggatgggaactgctgtggaagagtatgaacaatataaaatattttgaagtgcaaaaccttaatactattgggttggagattgtttgtttgtgtggtggccttcctcttgcaatcaaggttactgctagtgttctagcaactaaagagataaatgagaacgagtggagaaaggttataaacaaaattggtcagtctattagcacgcttccttttgagctgagtggtgctttgtatctgagttatgatgagctaccacgacatttgaagcaatgttttttgtattgtgccatatatcctgaagatttcaccatgcatcgtgatgaccttgttaggtactggattgctgaaggttttgtgcatgagcaagggacacaacttctggaggatacagctgaagaatattactatgaattgatctacagaaatattctccaaccagatgaaactattg

SEQ ID NO: 47461 - protein, 207 aa, Panicum virgatum
  misc_feature: Ceres CLONE 2036500
  misc_feature (1)..(181): Pfam Name: NB-ARC Pfam Description: NB-ARC domain
KKKKDDVWQHGVWTNLLRTPFDSAATGIVLITTRNDTIARAIGVEYLHRVDLMSPEVGWELLWKSMNNIKYFEVQNLNTIGLEIVCLCGGLPLAIKVTASVLATKEINENEWRKVINKIGQSISTLPFELSGALYLSYDELPRHLKQCFLYCAIYPEDFTMHRDDLVRYWIAEGFVHEQGTQLLEDTAEEYYYELIYRNILQPDETI

SEQ ID NO: 47462 - DNA, 694 bp, Panicum virgatum
  misc_feature: Ceres CLONE 2036519
  misc_feature: Encodes the peptide sequence at SEQ ID NO. 47463
gccaagctacgccctacgcacgccgccccccagttcaaaccctccccccttcgtctccccgtcgcccccagctgtgcacgcgctttccgatcgcttcatctaccccgccaccccgctcccgcccagccccagcccccaatcgccagcccaccgcgcgcgcgctctcccgatccagcgatggctgcctccgcagctccccaggccgtggtcctcgggctcctcctgctcgcggggctcgcggcggcgcagagggggacgacgcccgcggccgccgcccccgcgcccgaccccggctgcaacggcatccagctcacctacagctttcagggccgcaccaagatccgccccttcgtcagcgacattaacaagcagccctacgcgttccgcgccaacgccaccgtgctcaactccggcacccgcccgctcaagtcgtgggcgatactcgtcgagttcgcccacggcgagatcctcgtcggcgtcgacggcgccgtgctcacgggcggcggcgagctgccctacaacaccacggaggacgccggcaacgccacctccttctcggggtacccgcagacggacctcctcacgcctatcgccaccgccggcgacctctcgcagatccaggcctccgtcagcatcgtcggcacgctcttcgccgggcccgacccgttcgatccgttccccaccaagctgtcgc

SEQ ID NO: 47463 - protein, 172 aa, Panicum virgatum
  misc_feature: Ceres CLONE 2036519
  misc_feature: Functional homolog of the protein sequence given in SEQ ID NO 51735
  misc_feature: Useful for making plants with altered carbohydrate content
MAASAAPQAVVLGLLLLAGLAAAQRGTTPAAAAPAPDPGCNGIQLTYSFQGRTKIRPFVSDINKQPYAFRANATVLNSGTRPLKSWAILVEFAHGEILVGVDGAVLTGGGELPYNTTEDAGNATSFSGYPQTDLLTPIATAGDLSQIQASVSIVGTLFAGPDPFDPFPTKLS

SEQ ID NO: 47464 - DNA, 686 bp, Panicum virgatum
  misc_feature: Ceres CLONE 2036559
  misc_feature: Encodes the peptide sequence at SEQ ID NO. 47465
aaaacccctcccaccctttcccgtagcgcggagccgccactcccccacaccagcacaccacgctgaggaaaacctagatccggacccctcgccgccggccatggcgacgcgtcgggccctctcctccatcctccgctcggcctcccgcctccgcgccgcctccccgaccccgtgcccgcgcacgccgctccaccaccgcccgtcccctgcgggcttcctcctcaaccgcgccgccgcctacgcctcctccgccgcggcacaggcggcgcccgccccgccgcccccgtccaccggcaagacgaccggtggtggcaagatcaccgatgagttcaccggcgccggcgccatcggccaggtgtgccaggtcatcggtgctgtcgttgacgtgcggttcgacgaggggttgcccccgatcctgacggcgctcgaggtgctcgacaacaacatccgcctcgtgctcgaggtggctcagcatctcggggagaagatggtccgcaccatcgccatggacgggaccgaggggctcgtccgcggccagcgtgtgttaaacactggctctcccatcaccgtaagcccatttcctctcgtttctcgtcctttttcgtgttttgagatgatttatttggatctaatctgacgaatcggcgggtgttagatttgatctggccgtacggatccatttattg

SEQ ID NO: 47465 - protein, 178 aa, Panicum virgatum
  misc_feature: Ceres CLONE 2036559
  misc_feature (86)..(152): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MATRRALSSILRSASRLRAASPTPCPRTPLHHRPSPAGFLLNRAAAYASSAAAQAAPAPPPPSTGKTTGGGKITDEFTGAGAIGQVCQVIGAVVDVRFDEGLPPILTALEVLDNNIRLVLEVAQHLGEKMVRTIAMDGTEGLVRGQRVLNTGSPITVSPFPLVSRPFSCFEMIYLDLI

SEQ ID NO: 47466 - DNA, 707 bp, Panicum virgatum
  misc_feature: Ceres CLONE 2036582
  misc_feature: Encodes the peptide sequence at SEQ ID NO. 47467
aaaaaccttatcccaaacctcgccctcgtatatttggccaccacactccgctcccgctccagcctcccccctctgccctccaacccgatgatggccttggcgctgcaatggcagctccagctcccactcccactccaggcgcggcctccccctctcgtcgcggcccgccggcggcagcgtggtctcctcacccccgcccgccgcgccccgccactccgagctcgctgctgcgccggcgacgccgctgccgccgacgcggagaaggcgcaagcggcggcgaggagggcgtacccgtacgacgagatcgaaccgaggtggcagcggcactgggaggagcaccgcacgttccgcaccctggacatcggcgaggggctcgacacctctaagcccaagtgctacatcctcgacatgttcccctaccccagtggggctgggctgcatgttgggcacccccttggatacacggcaactgacatcctttcaagattcaagcgcatgaaaggcttcaatgttttgcatcctatgggatgggatgcgtttggtcttcctgctgagcagtacgctattgagacgggaacccaccctaagattacctctgagaggaacattgagcgcttccggacacagctgaaatcattaggtttttcatatgactgggatcgtgaaatctccacaacagagccggcttactataaatggacgcaatg

SEQ ID NO: 47467 - protein, 205 aa, Panicum virgatum
  misc_feature: Ceres CLONE 2036582
  misc_feature: SWISSPROT Homolog: EC 6.1.1.4 Leucine--tRNA ligase
MALALQWQLQLPLPLQARPPPLVAARRRQRGLLTPARRAPPLRARCCAGDAAAADAEKAQAAARRAYPYDEIEPRWQRHWEEHRTFRTLDIGEGLDTSKPKCYILDMFPYPSGAGLHVGHPLGYTATDILSRFKRMKGFNVLHPMGWDAFGLPAEQYAIETGTHPKITSERNIERFRTQLKSLGFSYDWDREISTTEPAYYKWTQ

SEQ ID NO: 47468 - DNA, 725 bp, Panicum virgatum
  misc_feature: Ceres CLONE 2036615
  misc_feature: Encodes the peptide sequence at SEQ ID NO. 47469
accaggccaccaccactcactcgggctctccgttcctgcatcccccctccgtcctcgtgccgcggcccctcgcccgctcctccgatccggatggcgcccaccgagtccggcccggcggcctagcgcagctcgggctcggcccgggcccaggctccagccgcgccgtccccgcagtcgtcagctcgagcccccgaggtctttatattcagctaagagagatgcttgtccatctctaggagcccccttttttggtacttcggcagtgctctttcctttttggagtagatgtcatttcgtagcattgtgcgcgatgtaagggatggcttcgggagcttatctaagaggggattcgaggtcaggcttctgggtcatcgcagagggaaatctcatggcgcggtccatgagctgcacgacccagtgcctgtggtacagaccagctgctgggctagcttgcctcctgaattacttcgagatgtgattgagaggttggaggcgagtgaggatacatggccttctaggaagaatgtagttgtttgtgcatctgtctgcagaacatggagagagatgtgtagagagattgtcaagaacccagagttttctgggaagatcacttttcctgtttctctgaaacagcctgggcctcgagatggaactatacagtgtttcattaagagggataaatctacacagatctactacctgtacctttgtcttagctcaactgt

SEQ ID NO: 47469 - protein, 146 aa, Panicum virgatum
  misc_feature: Ceres CLONE 2036615
  misc_feature (51)..(106): Pfam Name: F-box Pfam Description: F-box domain
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
MSFRSIVRDVRDGFGSLSKRGFEVRLLGHRRGKSHGAVHELHDPVPVVQTSCWASLPPELLRDVIERLEASEDTWPSRKNVVVCASVCRTWREMCREIVKNPEFSGKITFPVSLKQPGPRDGTIQCFIKRDKSTQIYYLYLCLSST

SEQ ID NO: 47470 - DNA, 701 bp, Panicum virgatum
  misc_feature: Ceres CLONE 2036618
  misc_feature: Encodes the peptide sequence at SEQ ID NO. 47471
  misc_feature (626)..(626): n is a, c, t, g, unknown, or other
actaatagtaatccgctcgtagctcgctctactcctcttgttgtgtgttcccccagctagtctagtctctctaccctgtcgtactagttttgtgttcgagctcaccggcgacaacaatggagtgcgagaccggcctcgtccgctccctgcacggcgacggcctgtgcgtgccggccccggcggcggcgcgcgccgaccccctgaactggggcaaggccgcggaggacctgtccgggagccacctgggcgaggtgcagcgcatggtggcggagttccgcgagccgctggtgcggatccagggcgcgagcctgagcatcgcgcaggtggccgccgtggccgccggcgccggcgaggcccgagtcgagctggacgagtccgcgcgcggccgcgtcaaggccagcagcgactgggtcatgagcagcatgatgaacggcaccgacagctacggcgtcaccaccggcttcggcgccacctcccaccgccgcaccaaggagggcggcgcgctccagcgggagctcatcagattcctcaatgccggcgccttcggcaccggcgccgacggccacgtgctgccggcggaggccacccgcgcggcgatgctcgtgcgcatcaacaccctcctgcanggctactccggcatccgcttcgagatcctcgaggcaatcgccaagctgctcaacgccaacgtcaccccgtgcctg

SEQ ID NO: 47471 - protein, 194 aa, Panicum virgatum
  misc_feature: Ceres CLONE 2036618
  misc_feature (57)..(194): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature: Functional homolog of the protein sequence given in SEQ ID NO 51139
  misc_feature: Useful for making plants with altered cell wall content and/or composition
  misc_feature: Functional homolog of the protein sequence given in SEQ ID NO 50787
  misc_feature: Useful for making plants with altered lignin content
  misc_feature (170)..(170): Xaa is any aa, unknown, or other
MECETGLVRSLHGDGLCVPAPAAARADPLNWGKAAEDLSGSHLGEVQRMVAEFREPLVRIQGASLSIAQVAAVAAGAGEARVELDESARGRVKASSDWVMSSMMNGTDSYGVTTGFGATSHRRTKEGGALQRELIRFLNAGAFGTGADGHVLPAEATRAAMLVRINTLLXGYSGIRFEILEAIAKLLNANVTPC

SEQ ID NO: 47472 - DNA, 472 bp, Panicum virgatum
  misc_feature: Ceres CLONE 2036623
  misc_feature: Encodes the peptide sequence at SEQ ID NO. 47473
attcagagctctcgcttcgaaactgaaccaactccccagctgcatgacatcgacgccttggaccggatggtcgatccagcactcaagggcctttaccctgccaaatccctctcccgtttcgctgatgttgttgcactgtgtgtccagcctgagccagagttcagacctccaatgtctgaggtggtgcaagcactggtccggcttgttcagagggccaacatgaccaggagaatgcttgatggcgaggaggcttctcggcgaccggatgaccaggaccaggaattcgtctaacaagcggaacaatatatacatcttatgctgaacctgcataccatcttactgttgtgactgttaactttcattccccgaacacaacacgtaatgcagagaaaaaggaggaaacagctatttcaggttctatcagtacatattacaggttttgtttcgtataatgaaatatacatgtttgtgt

SEQ ID NO: 47473 - protein, 96 aa, Panicum virgatum
  misc_feature: Ceres CLONE 2036623
  misc_feature: SWISSPROT Homolog: EC 2.7.11.1 Non-specific serine/threonine protein kinase
IQSSRFETEPTPQLHDIDALDRMVDPALKGLYPAKSLSRFADVVALCVQPEPEFRPPMSEVVQALVRLVQRANMTRRMLDGEEASRRPDDQDQEFV

SEQ ID NO: 47474 - DNA, 619 bp, Panicum virgatum
  misc_feature: Ceres CLONE 2036640
  misc_feature: Encodes the peptide sequence at SEQ ID NO. 47475
aggtttaggtgccctgaggtcctcttccagccgtccatgattggcatggaatcccctggaatccatgagactacctacaactccatcatgaagtgtgatgtggatatcaggaaggacctgtatggcaacattgtgctcagtggaggttcaacaatgttcccaggcattgctgaccgtatgagcaaggagatcaccgctcttgctccgagcagcatgaagatcaaggtggttgctccacctgagcgcaagtacagtgtctggatcggagggtctatcctagcttctctcagcaccttccaacagatgtggatatcgaaggaggagtacgatgaatctggccctgcaatcgtccacaggaagtgcttctgagtaacgctgccttttcatgtagtcgcctgtgtgtgggttttttcatggggggagagattgcaaggtttatgtttgtgttctgcagacggtccttattttggccacttgtatctgtggttgccccagttacctttgttctgtactagtatttgtttgctctgtgactatgaggtcactttgtgaaacttgtggttggtttgatcgtttgtaactgttatagctgatagttctataagttgttgagatctcc

SEQ ID NO: 47475 - protein, 122 aa, Panicum virgatum
  misc_feature: Ceres CLONE 2036640
  misc_feature (1)..(122): Pfam Name: Actin Pfam Description: Actin
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
RFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWISKEEYDESGPAIVHRKCF

SEQ ID NO: 47476 - DNA, 667 bp, Panicum virgatum
  misc_feature: Ceres CLONE 2036641
  misc_feature: Encodes the peptide sequence at SEQ ID NO. 47477
acatccatctctaatctctcggccagcctcggcgacgacgcaaagggaggtggcgagagaggcgccgcccggcccttggcagttctttcgtctcgtcgggcacttccaaggtatcaaaccttgccatcgtgctcaacctcatccaagcggggatcatcggtgaagaattgctttagcttccgtgctcatttaaggaaagagggttcacgttggataaggtccgagcctttcttgtcagtaaatagtgcaaagtttgtcggcaagaggacatcctgttcagttgcaacagagccgcctcctgctgcaaccgaaaaaccagagatggattctcccaaggagatattcttgaaaggttacaggaaacctgattatttgtttgacaaggtggatttgcaatttcaacttggtgaagaaaagaccatagttacatctaaaatagttgtatctcctggtgttgaaggaagcatctcagctccacttgttcttcatggctgtgacctgaagctgttatcgatcaaagtcaatggcaccgagctaaagggcgaagagtatacagtcgattcacgccatctgacggtttcaacaccgcctgctggtgtattcaacttggaaattgttacagaaatatatcctcagctaaacacatctttggaggggctgtacaagt

SEQ ID NO: 47477 - protein, 222 aa, Panicum virgatum
  misc_feature: Ceres CLONE 2036641
  misc_feature: SWISSPROT Homolog: EC 3.4.11.2 Membrane alanyl aminopeptidase
TSISNLSASLGDDAKGGGERGAARPLAVLSSRRALPRYQTLPSCSTSSKRGSSVKNCFSFRAHLRKEGSRWIRSEPFLSVNSAKFVGKRTSCSVATEPPPAATEKPEMDSPKEIFLKGYRKPDYLFDKVDLQFQLGEEKTIVTSKIVVSPGVEGSISAPLVLHGCDLKLLSIKVNGTELKGEEYTVDSRHLTVSTPPAGVFNLEIVTEIYPQLNTSLEGLYK

SEQ ID NO: 47478 - DNA, 698 bp, Panicum virgatum
  misc_feature: Ceres CLONE 2036670
  misc_feature: Encodes the peptide sequence at SEQ ID NO. 47479
atgatcacatcaacaactttgcaaatccttaacttgtcctccaatgctctttttggggatcttccattgctttctgggagctgcactgtgttagatctatcaaataacaagtttagagggaatttatcagtaattgccaaatggaccagcgatttggaatatgttgatcttagtcagaacaacctaactgggacaattcctgatgtgagcgctcagttccttcgcctaaactacctaaatctttcccataatgctctatctgacaccatccctgaagctgttgttcagtaccccaaacttaccgtacttgacctgagctccaatcaattacgcggtcctattcctgctgatctattcacttcgtccatgctacaagagctctacatccaagataacatgctttttggtggcctatcatttcctggttcctcatccaaaattttgagtcttcaagtgcttgatatttctggaaatcacttcaatggaagcctccctgatgatattgcttccttacctggcctccgagttcttgatatatcgacaaacaatttctctggtccattacctgctgctgttagtaagcttggggcgcttactgatcttgatttgtcaataaatcagttcaccgggccattacctgaggatcttccagatgacctcatatctttcaatgcgtcctataatgacctttctggtgt

SEQ ID NO: 47479 - protein, 232 aa, Panicum virgatum
  misc_feature: Ceres CLONE 2036670
  misc_feature: SWISSPROT Homolog: EC 2.7.11.1 Non-specific serine/threonine protein kinase
MITSTTLQILNLSSNALFGDLPLLSGSCTVLDLSNNKFRGNLSVIAKWTSDLEYVDLSQNNLTGTIPDVSAQFLRLNYLNLSHNALSDTIPEAVVQYPKLTVLDLSSNQLRGPIPADLFTSSMLQELYIQDNMLFGGLSFPGSSSKILSLQVLDISGNHFNGSLPDDIASLPGLRVLDISTNNFSGPLPAAVSKLGALTDLDLSINQFTGPLPEDLPDDLISFNASYNDLSG

SEQ ID NO: 47480 - DNA, 680 bp, Panicum virgatum
  misc_feature: Ceres CLONE 2036679
  misc_feature: Encodes the peptide sequence at SEQ ID NO. 47481
aagtccccacttcactctcgcggtctcgcctcactccacggctccgccgctcaggcagagcgctccctctcccaatggcggcgtcgctcttccgcatcaccctccccctcctgcacctgctcatgctcctctccatccccgccgactcggcgcgcaacgcggaggacgcccgtgcgctcgcggcgctccggcgggcacttgaccctgccggccgggtcctgggctcctggaacccctccggcgacccttgcggcggctccttcctcggcgtcacctgcgaccccgccggccgcgtcacggccgtctcgctgcagggccgcgggctctccggcagcctgccgcctgcggtcgccgggctacggcgcctccaggggctctacctgcactacaacggcatcaagggccccataccgcgggagattgggaagctgtccgagctcgcggacctgtacctcgacgtgaaccatctcaccgggcccgtgcccgtcgagattgctgccatggtcaacctccaagtgttgcagttgggttacaatcagttgacaggcagtatacctccccagttgggcaacctgaataagctatctgtgctcgcaatgcagtccaatcagcttacaggagccattccggcaacccttggtgagctaacgcagctgagacggcttgatttgagcttcaac

SEQ ID NO: 47481 - protein, 201 aa, Panicum virgatum
  misc_feature: Ceres CLONE 2036679
  misc_feature (28)..(69): Pfam Name: LRRNT_2 Pfam Description: Leucine rich repeat N-terminal domain
  misc_feature: SWISSPROT Homolog: EC 2.7.11.1 Non-specific serine/threonine protein kinase
MAASLFRITLPLLHLLMLLSIPADSARNAEDARALAALRRALDPAGRVLGSWNPSGDPCGGSFLGVTCDPAGRVTAVSLQGRGLSGSLPPAVAGLRRLQGLYLHYNGIKGPIPREIGKLSELADLYLDVNHLTGPVPVEIAAMVNLQVLQLGYNQLTGSIPPQLGNLNKLSVLAMQSNQLTGAIPATLGELTQLRRLDLSF

SEQ ID NO: 47482 - DNA, 670 bp, Panicum virgatum
  misc_feature: Ceres CLONE 2036687
  misc_feature: Encodes the peptide sequence at SEQ ID NO. 47483
atttacattctcttctacccctatccccaccggatcgaccccctccgccttcctccctccttccctcgctgacactgtttgacccctgccggctgctgccaatcgtgtcatccagctaataaggttcagaggtgagtagtgagggccggactgtgtctgtcactgtggcagtgtggtaccgtgcgtgcgtaggacggggagaatggagccccgctcctcctcctcatccgctctcgccgccgccgccctcctcctcgcctcctcgctcctcctcgcggcgcgcgccgacgacccctacaggttctacacctggaacgtcaccttcggcgacatctacccgctcggcgtcaagcaggaggggatactgatcaacggccagttcccggggccgcagatcgaagccgtcaccaacgacaacatcatcgtcaatgtcttcaacaacctgcccgtccccttcctcctctcatggttgatgctctagatttgtggatgcaatggcgtcacccagatcatgctgtgaatcttatgtgttcctttcctctctgtttctcccgggtacatgccattttcttttggagttctgaatgccactttcttcacgcaagctacattgagctgggagtgggattggctgtcaaaacattggcagtggtgagagaacaagccagga

SEQ ID NO: 47483 - protein, 92 aa, Panicum virgatum
  misc_feature: Ceres CLONE 2036687
  misc_feature (38)..(92): Pfam Name: Cu-oxidase_3 Pfam Description: Multicopper oxidase
  misc_feature: SWISSPROT Homolog: EC 1.10.3.2 Laccase
MEPRSSSSSALAAAALLLASSLLLAARADDPYRFYTWNVTFGDIYPLGVKQEGILINGQFPGPQIEAVTNDNIIVNVFNNLPVPFLLSWLML

SEQ ID NO: 47484 - DNA, 684 bp, Panicum virgatum
  misc_feature: Ceres CLONE 2036688
  misc_feature: Encodes the peptide sequence at SEQ ID NO. 47485
ccatctcatccctcgccccctggcgctccctacaaaccctactcgcctcctccagtcctccctcgcgccgccgcctcctcttctctcctcgcgttcgggaagggcctcgtcatggcctcggagacggagacgttcgccttccaggcggagatcaaccagctgctctccctcatcatcaacaccttttactccaacaaggagatcttcctcagggagctcatctccaactcctccgatgcattggacaagatcaggttcgagagcttgacggacaagagcaagctggatgcccagccagagctgttcatccacattgttcctgacaaggcctccaacactctgacaatcattgacagtggtattggtatgaccaagtctgatcttgtgaacaaccttggtaccattgcgcggtcaggcacaaaggagttcatggaggctctggctgctggtgctgatgtttctatgattggccagtttggtgttggtttctactctgcctaccttgttgctgagagagttgttgtgaccactaagcacaacgatgatgagcagtacgtgtgggagtctcaggctggtggctccttcactgtcacgcgtgatacctctggggagccccttggcaggggtaccaagatgaccctctacctcaaggatgatcagttggagtaccttgaggagcgtcgc

SEQ ID NO: 47485 - protein, 190 aa, Panicum virgatum
  misc_feature: Ceres CLONE 2036688
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHIVPDKASNTLTIIDSGIGMTKSDLVNNLGTIARSGTKEFMEALAAGADVSMIGQFGVGFYSAYLVAERVVVTTKHNDDEQYVWESQAGGSFTVTRDTSGEPLGRGTKMTLYLKDDQLEYLEER

SEQ ID NO: 47486 - DNA, 718 bp, Panicum virgatum
  misc_feature: Ceres CLONE 2036748
  misc_feature: Encodes the peptide sequence at SEQ ID NO. 47487
ctccgcccgcctcctcctcttcgccgccctccctccctcctccccgctccgcgccttctgcccgagggaacgcccctcccccgccacctgcgccgccttctcctccactgcgatggccaccgacaaccccctcctcgccgccgacttcgacttcccgcccttcgaccgcgttgagcccagccacgtccgacccggcatccgcgagctcctcacgcgactcgagggcgagctcgaggagctcgagaagggggtcgagccctcctgggggaagctggtcgagccgctcgagcgcatcaccgacaggctcgaggtcatctggggaatggtcgaccacctcaaggccgtcaaggactctgccgatctccgcgccgccatcgaggaagtccagcctgacaaagtcaagtttcaactaaggctgggccagagcaagcctatctaccaagctttccaggccattagaaactcttctgactgggacagtctcactgatgctcgcaaacgtatagtagaagctcaaataaaggatgctgttctcagtggagttgcacttgaggatgaacagagggagaaattcaaccaaatcgaacaagagcttgaaaaactgtcacaaaagttcagcgaaaatgtgctggggacgcacaagaaatttgagaaattaattactgataagaaagaaattgatggggtgcctgctacagcccttggtttagcagcacaa

SEQ ID NO: 47487 - protein, 238 aa, Panicum virgatum
  misc_feature: Ceres CLONE 2036748
  misc_feature: SWISSPROT Homolog: EC 3.4.24.70 Oligopeptidase A
SARLLLFAALPPSSPLRAFCPRERPSPATCAAFSSTAMATDNPLLAADFDFPPFDRVEPSHVRPGIRELLTRLEGELEELEKGVEPSWGKLVEPLERITDRLEVIWGMVDHLKAVKDSADLRAAIEEVQPDKVKFQLRLGQSKPIYQAFQAIRNSSDWDSLTDARKRIVEAQIKDAVLSGVALEDEQREKFNQIEQELEKLSQKFSENVLGTHKKFEKLITDKKEIDGVPATALGLAA

SEQ ID NO: 47488 - DNA, 655 bp, Panicum virgatum
  misc_feature: Ceres CLONE 2036788
  misc_feature: Encodes the peptide sequence at SEQ ID NO. 47489
gtactccaacttgatcggccctggcctaggctcatagtcctagccagctagctgaaaaaaagtaagaaacattctgttccccctcagctgcagagcgcacacggctctccgctgcgtccagaagaaccaggttcctcgccagctctagccggcaccccccaccacggcgagccggccgaccatgggggagctcggcggcggcggcggcggcgacgcgcaggtgccgttcccgtggaagctggtggtgctgtgtgcggtggccgcgtggtgcgccgtgcgcgcggtcgagtgggcgtggtggcggccgcggcgcctggcgcgggcgctgcggtcgcaggggctccgcggcacggcgtaccgctccctggcgggggacgcgccgctgacggagcggctcgaccgggaggccaggtcccggcccatgccgctgggatgccacgacgtcgtgccccgggcgatgccgctgttccaccagaccatgaaggagcacggcaaaacgtccatcacctggttcgggccggtgccaagggtgaccatcaccaagcccgagctggtgcgcgaggttctgtccaacaagttgggtcacttcgagaagatcaggtacggcaggcttcagaggatgctgcacaacggcctgggcagccacgagggcgag

SEQ ID NO: 47489 - protein, 157 aa, Panicum virgatum
  misc_feature: Ceres CLONE 2036788
  misc_feature: SWISSPROT Homolog: EC 1.3.3.9 Secologanin synthase
MGELGGGGGGDAQVPFPWKLVVLCAVAAWCAVRAVEWAWWRPRRLARALRSQGLRGTAYRSLAGDAPLTERLDREARSRPMPLGCHDVVPRAMPLFHQTMKEHGKTSITWFGPVPRVTITKPELVREVLSNKLGHFEKIRYGRLQRMLHNGLGSHEG

SEQ ID NO: 47490 - DNA, 605 bp, Panicum virgatum
  misc_feature: Ceres CLONE 2036819
  misc_feature: Encodes the peptide sequence at SEQ ID NO. 47491
atctcgcaccctcgccgctgctgctgcaattaacgccaccgccggccaacaacccgaaacctacctccgccgtcgtcgccgcaaccgccgccaacatggcgagccaaggggagccgtcggcctccgcttcggatccgaaggggaagaaagactactctacggcgattcttgagagaaagaagtcgccgaaccgcctggtcgttgatgaggccaccaacgacgacaactccgtcgtcgctctccacccggataccatggagaggctgcagctcttccgcggcgataccgtgctccttaagggtaagaagaggaaagacactatatgcattgtccttgcggatgaaacctgtgaggaaccaaaggttcggatgaacaaggttgtccgccagaacctgagggtgaggcttggtgatgtggtttccgtccatcagtgccaggatgtgaaatatgggaagcgtgtacacattcttccaattgatgatacagttgaaggcattacagggaacctgtttgatgtcttcttgaaaccatacttcctagaagcgtaccgtgatagaaagcttggtacaggccagccagaaggtagctactgatttatttgtacc

SEQ ID NO: 47491 - protein, 165 aa, Panicum virgatum
  misc_feature: Ceres CLONE 2036819
  misc_feature (30)..(116): Pfam Name: CDC48_N Pfam Description: Cell division protein 48 (CDC48), N-terminal domain
MASQGEPSASASDPKGKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDVFLKPYFLEAYRDRKLGTGQPEGSY

SEQ ID NO: 47492 - DNA, 713 bp, Panicum virgatum
  misc_feature: Ceres CLONE 2036847
  misc_feature: Encodes the peptide sequence at SEQ ID NO. 47493
ctccgcgcccctcccgcggcaatctccttatcccccgttggccggtgggcggtggccgcctgcccacctccctccgccgcttgctaaaaccccctcgccgctgactgggcgggaccctcatctgccttctccactccgctcctcgcgctcgcggcgggcgcagaatggacgccgcctcatgctgccgcgtcttctccacgcagcggtgccggttcccgctgcgcaggctggcagcgccgccgtggtcgcagccgtttggcaccgagtcgagcggcggcctctccgccgcgtcgatctcgaagcggaggtccagggggcccgtcatggcggcgaagaaggctgagcagggtgcaaagcaagaggatggtaagtacaagcacacagtggatctcccgaaaacaacatttgggttgagagcgaattctgttgtaagggaaccagaactccagaaattatgggaggagaatcaagttctgaaaagggtatctgaaaggaacactggggctacatttgttcttcatgatggccctccttatgctaatggcgaccttcatatgggccatgcgctcaataaaatcctcaaagatattataaatcgttacaagctgcttcagaatcataaagtgtattttgttcctgggtgggattgccatggccttccaatagaactaaaagttttgaagtcaatggataaagaaactttgggtgctctt

SEQ ID NO: 47493 - protein, 182 aa, Panicum virgatum
  misc_feature: Ceres CLONE 2036847
  misc_feature: SWISSPROT Homolog: EC 6.1.1.5 Isoleucine--tRNA ligase
MDAASCCRVFSTQRCRFPLRRLAAPPWSQPFGTESSGGLSAASISKRRSRGPVMAAKKAEQGAKQEDGKYKHTVDLPKTTFGLRANSVVREPELQKLWEENQVLKRVSERNTGATFVLHDGPPYANGDLHMGHALNKILKDIINRYKLLQNHKVYFVPGWDCHGLPIELKVLKSMDKETLGA

SEQ ID NO: 47494 - DNA, 668 bp, Panicum virgatum
  misc_feature: Ceres CLONE 2036876
  misc_feature: Encodes the peptide sequence at SEQ ID NO. 47495
gcgcgttttcctcgcattgcctccgcgacctcgtcgtcacaattcccccatttcccgattcctctaaaactttccccaatcccccctccccgattcggagcacgcgctaatggcgacgaaatgcgctgccgccgcggtcaatctggccaccggccgcccccgcaagcgcgcaaggcttggctgggacgtggctccggctgccgagacaagatatacaaaaaaataggtgaaggtacttttggtcaggtactagagtgttgggaccgagaaagaaaagagatggtggctattaaaattgttcgttctgtaaagaagtacagcgatgcagcaatgatagagattgatgtcctgcagaagcttgcaagaaatgatgcagcaggcaaacattgtgtccaaatacggaactggtttgactatcgtagccatatttgtattgtaagtatatggttgatttatagaattttccccaatctgtcaagtagacattggggtcaaatcaatcaataaatttcggtgaatggacaggtctgcgagaagcttggcccaagcctatacgattttctacggaaaactggctatcgcccattcccaatcgatctagtacgccagattggagagcaacttttggaatctgttgcatgtgtgtagagacagtactctgcaaactt

SEQ ID NO: 47495 - protein, 128 aa, Panicum virgatum
  misc_feature: Ceres CLONE 2036876
  misc_feature: SWISSPROT Homolog: EC 2.7.12.1 Dual-specificity kinase
MRCRRGQSGHRPPPQARKAWLGRGSGCRDKIYKKIGEGTFGQVLECWDRERKEMVAIKIVRSVKKYSDAAMIEIDVLQKLARNDAAGKHCVQIRNWFDYRSHICIVSIWLIYRIFPNLSSRHWGQINQ

SEQ ID NO: 47496 - DNA, 566 bp, Panicum virgatum
  misc_feature: Ceres CLONE 2036880
  misc_feature: Encodes the peptide sequence at SEQ ID NO. 47497
ccgtctccgctgccgccgctgacgccctcgtaccaagactcgccgctcgccgctcgccgctcgccgccagcatctcgcgtcccgacaatctgccgcagaagaatcggccccagtccccgtctcttctcctcctcctcctccccctccttccccattctaccagccgcggccatggccaccgacagcgccgcccccgccgggtccaagagtaagctgctcgtcttcgattccgtggaagatctcgcggtgtctctggcgaagtacaccgctgagctgtctcagaagttcgccaccgagaggggcgccttcaccgtcgtgctctccggcggatccctcatcgactcgctcagcaagctgacggagccgccgtacctggaatcggtggactggagcaagtggcacgtcttctgggtggatgagagagtcgtgcccaaggatcatgaggatagcaactacaagctcgccttcgatgggtttctctccaaggtattctttgcaatttattgtgcttttttcaaggcaattcctgttctctgattgggtaattgggagacgggatcttgtgt

SEQ ID NO: 47497 - protein, 121 aa, Panicum virgatum
  misc_feature: Ceres CLONE 2036880
  misc_feature: SWISSPROT Homolog: EC 3.1.1.31 6-phosphogluconolactonase
  misc_feature: Functional homolog of the protein sequence given in SEQ ID NO 50130
  misc_feature: Useful for biocontainment applications
  misc_feature: Useful for making plants with modulated flowering time
MATDSAAPAGSKSKLLVFDSVEDLAVSLAKYTAELSQKFATERGAFTVVLSGGSLIDSLSKLTEPPYLESVDWSKWHVFWVDERVVPKDHEDSNYKLAFDGFLSKVFFAIYCAFFKAIPVL

SEQ ID NO: 47498 - DNA, 654 bp, Panicum virgatum
  misc_feature: Ceres CLONE 2036893
  misc_feature: Encodes the peptide sequence at SEQ ID NO. 47499
acacacagtgcgccaccctcaccaccaccgtcaccaacaaagccaaatcggacgctagaccggcgatggattctgactacggcgtgccgcgcgagctctcggaggtgcagaagaagcgcgcgctctaccagcccgaggttcccccatgcctccagggcactactgtgagggtagagtacggtgatgctgcaattgctgctgatccagcaggcgctcatgtgatcagccaggcgttccctcacacttatgggcagccccttgcacattttctcaggaagacggctgttgtccctgatgctaaggtcatatctgagcaccctgcagtcagggttggcattgtgttctgtggaaggcagtcccctggaggccacaatgtcgtttggggactctatgaggctatcaaggctcacaaccaaagcagcaaactcattggttttcttggtggttctgatggtcttctagcacagaaaaccttggagatcaccgatgaagttctttcttcatacaaaaaccaaggtggttatgacatgcttggtcggacaaaggatcagattagaacaaaagagcaggttaacggcgcgatggctagttgccaagctttgaagttagatgctctggtaatcattggaggtgtcacatccaatactgatgctg

SEQ ID NO: 47499 - protein, 196 aa, Panicum virgatum
  misc_feature: Ceres CLONE 2036893
  misc_feature: SWISSPROT Homolog: EC 2.7.1.90 Diphosphate--fructose-6-phosphate 1-phosphotransferase
MDSDYGVPRELSEVQKKRALYQPEVPPCLQGTTVRVEYGDAAIAADPAGAHVISQAFPHTYGQPLAHFLRKTAVVPDAKVISEHPAVRVGIVFCGRQSPGGHNVVWGLYEAIKAHNQSSKLIGFLGGSDGLLAQKTLEITDEVLSSYKNQGGYDMLGRTKDQIRTKEQVNGAMASCQALKLDALVIIGGVTSNTDA

SEQ ID NO: 47500 - DNA, 697 bp, Panicum virgatum
  misc_feature: Ceres CLONE 2036894
  misc_feature: Encodes the peptide sequence at SEQ ID NO. 47501
tcaccgagtcaccgttcgccaccaccaccaccaccaccaccaccaccgctaccacaccacgccacagtcgcagcgcgcaggccaggacagcgcgcgcgcacgagagccggcggcagccatgtccgccccgaagctgggccgcaacccgagcatccgcgaccgcgtcgaggacaccctccacgcgcaccgcaacgagctcgtcgccctcctctccaagtacgtgaacaaggggaagggcatcctgcagccgcaccacatcctcgacgcgctcgacgaggtccagggctccgggggcggcgcgctcgccgagggccccttcctcgacgtcctccgctccgcgcaggaggcgatcgtgctgccgccgttcgtggccatcgcggtgcgcccgcgcccgggggtgtgggagtacgtccgcctcaacgtgcacgagctcagcgtcgagcagctcaccgtcccggagtacctgcgcttcaaggaggagctcgtcgacggccagcacaatgatccctacatgcttgagcttgacttcgagccattcaatgccacagtcccacgcccaaatcggtcatcctctattggaaatggcgtgcagtttctcaatcgacacctctcttcgatcatgttccgcaacagggattgcctggaacccctgctggatttcctccgtggccaccggcacaagggtcatgttatgatg

SEQ ID NO: 47501 - protein, 192 aa, Panicum virgatum
  misc_feature: Ceres CLONE 2036894
  misc_feature (7)..(192): Pfam Name: Sucrose_synth Pfam Description: Sucrose synthase
  misc_feature: SWISSPROT Homolog: EC 2.4.1.13 Sucrose synthase
  misc_feature: The sequence is a functional homolog of SEQ ID NO 12 in US patent 7091398
  misc_feature: The sequence is a functional homolog of SEQ ID NO 2 in US patent 7091398
  misc_feature: Functional homolog of the protein sequence given in SEQ ID NO 51468
  misc_feature: Useful for making plants with altered cell wall content and/or composition
MSAPKLGRNPSIRDRVEDTLHAHRNELVALLSKYVNKGKGILQPHHILDALDEVQGSGGGALAEGPFLDVLRSAQEAIVLPPFVAIAVRPRPGVWEYVRLNVHELSVEQLTVPEYLRFKEELVDGQHNDPYMLELDFEPFNATVPRPNRSSSIGNGVQFLNRHLSSIMFRNRDCLEPLLDFLRGHRHKGHVM

SEQ ID NO: 47502 - DNA, 682 bp, Panicum virgatum
  misc_feature: Ceres CLONE 2036908
  misc_feature: Encodes the peptide sequence at SEQ ID NO. 47503
aaaaagccaagaacacgcctccctcccctccaccatggacaagattggcagcagcagcaggaggaacaaggggagaagccgccccatggccgccatcaccatgctcatgctggccgccctcctcctctgctccgcgcccaccgtagcactcacccccgacggcgaggtcctgctcgagctcaagctggccttcaacgccaccgcccagcgcctcaccagctggaggccctccgacctcaacccctgcggctgggagggcatctcctgctccctccccgacctcagggtccaatccataaatctcccatacatgcagctcgggggcatcatttcacccagcatcgggaggctcgataagttgcagagactagctctgcaccagaacagcttgcacggcccaatccctgcagagatcaagaactgcacggagctcagggcaatttacctgagagctaactatctgcacggaggtatcccttcagagattggcgagcttgtgcacctcacaatcttggacttgtcgagcaacctgttgaggggcacaattccggcatccattggaagcctcacacaccttcgctttctgaacctgtccactaatttcttctcaggagagatcccaaatgtgggtgtcctcggaaccttcaaaagcagctcttttgttggaaatctggagctttgt

SEQ ID NO: 47503 - protein, 215 aa, Panicum virgatum
  misc_feature: Ceres CLONE 2036908
  misc_feature (39)..(79): Pfam Name: LRRNT_2 Pfam Description: Leucine rich repeat N-terminal domain
  misc_feature: SWISSPROT Homolog: EC 2.7.11.1 Non-specific serine/threonine protein kinase
MDKIGSSSRRNKGRSRPMAAITMLMLAALLLCSAPTVALTPDGEVLLELKLAFNATAQRLTSWRPSDLNPCGWEGISCSLPDLRVQSINLPYMQLGGIISPSIGRLDKLQRLALHQNSLHGPIPAEIKNCTELRAIYLRANYLHGGIPSEIGELVHLTILDLSSNLLRGTIPASIGSLTHLRFLNLSTNFFSGEIPNVGVLGTFKSSSFVGNLEL

SEQ ID NO: 47504 - DNA, 666 bp, Panicum virgatum
  misc_feature: Ceres CLONE 2036912
  misc_feature: Encodes the peptide sequence at SEQ ID NO. 47505
aaaaaaataaaatctctctttccccatctttccccgcaggctccgtgcttcttccccagagagagagagagagagagagcgaaaccctagctcgcggctcgccggatggaccctcagcagccggaaccggtcagctacctctgcggagattgtggagccgagaacacgctgaagccgggtgatgtgatccagtgccgcgagtgcggctaccgcatcctctacaagaagcggacccgccgaagtatggtctctcctactcctctcttgatttcctgtgtggcagtgtctgaagtctgaattgttggcttgtgatttcaccaatgattgctcagatcctattgtagttactggttggtatatatggaaaatctcatgtaggcctgatgccctgttatcagaagggagggttgggcattaagttcttatacatttacagaccagtttcaagtagttcaagcacattgtcatggagttgccctgctgctgcccatcctaactgatgctgcatacttttttcccattgtcgttctatattttgtacaacattgatatagcatatttaacctggaatggctactttcgaaaattagttaaaatgatgagaaaacacagtttttataattcatttttttaaaagaacctttttgctagtccacaaaaaggtgt

SEQ ID NO: 47505 - protein, 63 aa, Panicum virgatum
  misc_feature: Ceres CLONE 2036912
  misc_feature (11)..(42): Pfam Name: DNA_RNApol_7kD Pfam Description: DNA directed RNA polymerase, 7 kDa subunit
MDPQQPEPVSYLCGDCGAENTLKPGDVIQCRECGYRILYKKRTRRSMVSPTPLLISCVAVSEV

SEQ ID NO: 47506 - DNA, 681 bp, Panicum virgatum
  misc_feature: Ceres CLONE 2036922
  misc_feature: Encodes the peptide sequence at SEQ ID NO. 47507
accccaaccaacggacggccgcacctgcacgcgccgccggagcgcgctcccctcccgtagccgccgtccgccacctcgctcccctcccgtagccgccggggacccggcgtcctcgtccccccgccgcatcctcctttaacggcgccgggcggaggtccatcccaactcgccggtcacccaaaggggctggggcaaccatgcccaaagttaagaatcctcatgtcttcatggacatatcaatcggcggaggaagcgccgagaggatcacattcgagctatttgcaaatgtagtcccgaagactgtggagaacttccgagcactttgtactggtgaaaagggccttggagcatccacacagaaaccactctattataagggaacaaacatccatcgcatagttaaagggtttgttgctcagggtggtgatttttcaagaggagatggacgtggtggagagagcatttatggtggaaaatttccagatgaaaacttcaggctaatgcacgatcagcctggtgtgctgtcaatggcaaattctggaccagacaccaatgggtcccaattttttataacattcaagcctctaccacatcttaatggcaagcacgtggtctttgggaaggtggtcagtggaatagatttgcttaagaagcttgaagcagttggtggtgaaaatggaa

SEQ ID NO: 47507 - protein, 161 aa, Panicum virgatum
  misc_feature: Ceres CLONE 2036922
  misc_feature (8)..(161): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MPKVKNPHVFMDISIGGGSAERITFELFANVVPKTVENFRALCTGEKGLGASTQKPLYYKGTNIHRIVKGFVAQGGDFSRGDGRGGESIYGGKFPDENFRLMHDQPGVLSMANSGPDTNGSQFFITFKPLPHLNGKHVVFGKVVSGIDLLKKLEAVGGENG

SEQ ID NO: 47508 - DNA, 688 bp, Panicum virgatum
  misc_feature: Ceres CLONE 2036927
  misc_feature: Encodes the peptide sequence at SEQ ID NO. 47509
tgattgcctgttggctccattcagaaatcaactgaggtttcttctcctagttcgtcagaaatactgcaatgacaagcgcttgatggattgttcagcgatcgcctgcgctgccgctctgctcctcctcctcctgcttcggccatgtgaatccgacgacaggatcgtccccggaaagccgctctcccctggcgccaccgtcgtgtcggaggacggcagcttcgccttgggcttcttcgccccttccacctcaactccggccaaactgtacctcgggatatggtacaacgacatccccgagctcaccgtggtgtgggtcgccaaccgggacgcccccgtcacgaacaccaccacgtcccccgcgccaacgctctccctggcggccggcacctcggatctcgtcttgtccgacgccgacggccgcgctgtttggacgacgaacatcaccgccgtcccaggcacccctgcagcaccgcctaccggcctcgccgcggtgctcctcaacagcggcgacctcgtcatcaggtcccccaacggcaccaccctgtggcagagcttcgagcacccggccgacacgctcctcccgggcatgaagatccgggtcaggtaccggacccgggccggcgagcgcctggtgtcgtggaggggccccggcgacccgtcgccggggagcttcagcttcggcgcggac

SEQ ID NO: 47509 - protein, 201 aa, Panicum virgatum
  misc_feature: Ceres CLONE 2036927
  misc_feature (72)..(193): Pfam Name: B_lectin Pfam Description: D-mannose binding lectin
MDCSAIACAAALLLLLLLRPCESDDRIVPGKPLSPGATVVSEDGSFALGFFAPSTSTPAKLYLGIWYNDIPELTVVWVANRDAPVTNTTTSPAPTLSLAAGTSDLVLSDADGRAVWTTNITAVPGTPAAPPTGLAAVLLNSGDLVIRSPNGTTLWQSFEHPADTLLPGMKIRVRYRTRAGERLVSWRGPGDPSPGSFSFGA

SEQ ID NO: 47510 - DNA, 690 bp, Panicum virgatum
  misc_feature: Ceres CLONE 2036928
  misc_feature: Encodes the peptide sequence at SEQ ID NO. 47511
agtgtctcacagcctcactcactccccagctcactcgctcgctccccatttcgcttcgccgtccgaccaagctcacccttagctgattagctccaccggcgggcgcagcagagcagggcgggatgccggccggcgtggtggacgcggccgccaagggcgtcaggctggagcggcacgcggcgggggccgccgtgctgctgcggcgcgcgtcgggcgccaagcagctcgcgtcggcgtcctcgcacctgctcttccgcgccacggtcctcgccacgctcgcgctcgtcgtcctcttcgccgtgcactacccgtccctgctctcgcgctccttcagcctctccgccgcgccctcgtccggctcgccgtccgcggcggcggcgcggtcgcggccgtcgcaccggagcctgctgggctcgggggcctcgtacgggggcgccgcgtgggagcgtgaggtgcggcgcagagccacgccgcggcgggacgggggcctgtccgtgctggtcaccggcgccgcggggttcgtgggcgcacactgctccctggcgctccgcgggcgcggcgacggcgtgctcggcctcgacaacttcaactcctactacgaccccgccctgaagcgcgcgcgccagcgcctgctcgcgtcgcgcggtgtggtggtgctcgtcgccgacatcacgacgccgcgctgctcga

SEQ ID NO: 47511 - protein, 189 aa, Panicum virgatum
  misc_feature: Ceres CLONE 2036928
  misc_feature: SWISSPROT Homolog: EC 5.1.3.6 UDP-glucuronate 4-epimerase
  misc_feature: Functional homolog of the protein sequence given in SEQ ID NO 50674
  misc_feature: Useful for making plants with altered carbohydrate content
  misc_feature: Functional homolog of the protein sequence given in SEQ ID NO 50675
  misc_feature: Useful for making plants with altered cell wall content and/or composition
MPAGVVDAAAKGVRLERHAAGAAVLLRRASGAKQLASASSHLLFRATVLATLALVVLFAVHYPSLLSRSFSLSAAPSSGSPSAAAARSRPSHRSLLGSGASYGGAAWEREVRRRATPRRDGGLSVLVTGAAGFVGAHCSLALRGRGDGVLGLDNFNSYYDPALKRARQRLLASRGVVVLVADITTPRCS

SEQ ID NO: 47512 - DNA, 670 bp, Panicum virgatum
  misc_feature: Ceres CLONE 2036980
  misc_feature: Encodes the peptide sequence at SEQ ID NO. 47513
agagtcccagcctcccaggctcccacccaccccttccatcccttccagaaccctcccactccaagcatctccaatcgcatcgcgtgagcagagagggcgcgcacgggcgggctaagctcggcggagcgtgatggcggggaacgactggatcaatagctacctggaggcaatcctcgacgcgggcggggctgcgggggagatctcggcagccgcaggtggtggcagcggggttgcgggggcgtccggagagaagcgggacaagtcgtcgctgatgctccgggagcgcggccggttcagccccgcgcgatactttgtcgaggaggtcatctccggtttcgacgagactgacctttacaagacctgggtccgaacatcggcgatgaggagccctcaggagcggaacacgcggctggagaacatgtcctggaggatctggaacctcgccaggaagaagaagcagattgaaggagaggaagcctctcgtttgtctaaacagcaccaggaacgtgaggaagctcgtcaatatgctgctgctgatttctctgaagatctatctgaaggcgaaaaaggagaaaacagtaatgaaccatctattcacgatgagaggacaatgacacggatgccaaggattggtttcactgatgctattgaagcatgggcaagccagcac

SEQ ID NO: 47513 - protein, 179 aa, Panicum virgatum
  misc_feature: Ceres CLONE 2036980
  misc_feature: SWISSPROT Homolog: EC 2.4.1.14 Sucrose-phosphate synthase
  misc_feature: Functional homolog of the protein sequence given in SEQ ID NO 50680
  misc_feature: Useful for making plants with altered cell wall content and/or composition
  misc_feature: Useful for making plants with modulated biomass
  misc_feature: Useful for making plants with modulated carbohydrate content
MAGNDWINSYLEAILDAGGAAGEISAAAGGGSGVAGASGEKRDKSSLMLRERGRFSPARYFVEEVISGFDETDLYKTWVRTSAMRSPQERNTRLENMSWRIWNLARKKKQIEGEEASRLSKQHQEREEARQYAAADFSEDLSEGEKGENSNEPSIHDERTMTRMPRIGFTDAIEAWASQ

SEQ ID NO: 47514 - DNA, 695 bp, Panicum virgatum
  misc_feature: Ceres CLONE 2036987
  misc_feature: Encodes the peptide sequence at SEQ ID NO. 47515
agaccaccaggcagcctcccctcccgagtcgccgtcgcctccgcctccccctcatccccgcgccgcctcagtcatgggtaaggagaagtcccacatcaacatcgtggtcattggccacgtcgactccggcaagtcgaccaccaccggccacctgatctacaagcttggaggtatcgacaagcgtgtgatcgagaggtttgagaaggaggctgcggagatgaacaagaggtccttcaagtacgcctgggtgcttgacaagctcaaggccgagcgtgagagaggtatcaccattgatatcgccctgtggaagtttgagaccaccaagtactactgcaccgtcattgatgcccctggacaccgtgacttcatcaagaacatgatcacgggtacctcccaggctgactgtgctgtccttatcattgactccaccactggtggttttgaggccggtatctccaaggatggccagacccgtgagcatgctctccttgctttcactcttggagtcaagcagatgatctgctgctgtaacaagatggatgccaccacccccaaatactccaaggctcgttatgatgagattgttaaggaagtctcctcctacctgaagaaggtgggctacaaccctgacaagattgccttcgttcccatctctggttttgagggtgacaacatgatagagaggtccaccaaac

SEQ ID NO: 47515 - protein, 207 aa, Panicum virgatum
  misc_feature: Ceres CLONE 2036987
  misc_feature (5)..(207): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMIERSTK

SEQ ID NO: 47516 - DNA, 685 bp, Panicum virgatum
  misc_feature: Ceres CLONE 2037012
  misc_feature: Encodes the peptide sequence at SEQ ID NO. 47517
agcctcgcctcactttgcttcttccatcctttccaccaccacccatccctctctctctcctcccggcccggcccttctctctctttctctctatacgcggatcaccggacggaggcaagctagctaccacctcgaccgaccggcagccgatctgtgctgtgaacaagtcaggaagctagctcgcggagatacatggctggcgcggggggtgcgacggcggtgcagcagccggcggcgggggctccgccggctggggcgaggagtggtgcgggcgccggcgccggcgcggcgggggccccggtcgccgacccgcgcgccgaggcgctgcggtgcccgcgctgcgactcggccaacaccaagttctgctactacaacaactactcgctgtcgcagccgcggcacttctgcaaggcgtgcaagcgctactggacgcgcgggggcacgctccgcaacgtccccgtcggcgggggctgccgcaagaacaagcgctccaggagcagcagcgcggcgggcgccgccgggaggagcggatcctcctccgccgcggccgccgtcacgtcctcctcggcggcgtccacgctgcccctgccgccgccggcggggtccctgccgtcgctcacgtccgcgctcggcctgcccgggggcacctcgctggcgtcgctgctactcggcagcggcaccggcg

SEQ ID NO: 47517 - protein, 164 aa, Panicum virgatum
  misc_feature: Ceres CLONE 2037012
  misc_feature (40)..(102): Pfam Name: zf-Dof Pfam Description: Dof domain, zinc finger
  misc_feature: The sequence is a functional homolog of SEQ ID NO 2748 in the 10/374,780 US patent application
  misc_feature: The sequence is a functional homolog of SEQ ID NO 394 in the 10/225,066 US patent application
  misc_feature: The sequence is a functional homolog of SEQ ID NO 1790 in the 10/374,780 US patent application
  misc_feature: The sequence is a functional homolog of SEQ ID NO 2768 in the 10/374,780 US patent application
  misc_feature: The sequence is a functional homolog of SEQ ID NO 410 in the 10/225,066 US patent application
  misc_feature: Functional homolog of the protein sequence given in SEQ ID NO 51325
  misc_feature: Useful for making plants with modulated nitrogen use efficiency
  misc_feature: The sequence is a functional homolog of SEQ ID NO 2 in US patent 7265264
  misc_feature: The sequence is a functional homolog of SEQ ID NO 1142 in the 11/479,226 US patent application
  misc_feature: The sequence is a functional homolog of SEQ ID NO 502 in the 10/412,699 US patent application
  misc_feature: The sequence is a functional homolog of SEQ ID NO 8 in the 10/286,264 US patent application
  misc_feature: Functional homolog of the protein sequence given in SEQ ID NO 51736
  misc_feature: Useful for biocontainment applications
  misc_feature: Useful for making plants with modulated biomass
  misc_feature: The sequence is a functional homolog of SEQ ID NO 2762 in the 10/374,780 US patent application
  misc_feature: The sequence is a functional homolog of SEQ ID NO 404 in the 10/225,066 US patent application
  misc_feature: The sequence is a functional homolog of SEQ ID NO 1967 in the 11/479,226 US patent application
  misc_feature: Functional homolog of the protein sequence given in SEQ ID NO 51737
  misc_feature: Useful for making plants with altered terpenoid content
MAGAGGATAVQQPAAGAPPAGARSGAGAGAGAAGAPVADPRAEALRCPRCDSANTKFCYYNNYSLSQPRHFCKACKRYWTRGGTLRNVPVGGGCRKNKRSRSSSAAGAAGRSGSSSAAAAVTSSSAASTLPLPPPAGSLPSLTSALGLPGGTSLASLLLGSGTG

SEQ ID NO: 47518 - DNA, 695 bp, Panicum virgatum
  misc_feature: Ceres CLONE 2037025
  misc_feature: Encodes the peptide sequence at SEQ ID NO. 47519
gaaatcactttctccgcccgtgtggtctatggatcttgactccggatggagggatagccaaccagactgcgcgccgaggtgaagccgtgatctctgcactgacgccggccggccgattgatcctacagcaaggtactaagttctctcaggacatttaggctccttgtgttaccgtagagtgcttcgatacaggaacaaacagaagcttgggcacgcttggtttggtgaattggacatcgcagaaggggccaaggcgtcccgcatcgcaacgcagccttgagacaaacaacttccataggcttcaagaaaataacatcagatggaatacgaactagatcttccagaaaataatcttcaatatttcatccaacacaacaaggcaaagtggacatgcgacaacaaccataatatcaagtatttcacagaagatgagatcagaattattaccagcagctacgacaccaagattggaggtggtgcctttggagatgtttacagaggagttctcagtgatagccgtttagttgcagtgaagagaaacatccgccctgatacaaaagaggagtttgctaaagaggtcatcgctcatagtcaaatcaaccataagaatgtagtaaggctcctggggtgctgcatagaggaaaatgctcaagcgatgatatttgagcatgtatccaaaggtaaccttagtgacc

SEQ ID NO: 47519 - protein, 125 aa, Panicum virgatum
  misc_feature: Ceres CLONE 2037025
  misc_feature: SWISSPROT Homolog: EC 2.7.11.1 Non-specific serine/threonine protein kinase
MEYELDLPENNLQYFIQHNKAKWTCDNNHNIKYFTEDEIRIITSSYDTKIGGGAFGDVYRGVLSDSRLVAVKRNIRPDTKEEFAKEVIAHSQINHKNVVRLLGCCIEENAQAMIFEHVSKGNLSD

SEQ ID NO: 47520 - DNA, 716 bp, Panicum virgatum
  misc_feature: Ceres CLONE 2037031
  misc_feature: Encodes the peptide sequence at SEQ ID NO. 47521
agaggggaacaggggagggggaaaaaaagagaggagagacctcgcagctccacgcgcacacgccaaaccccaatcggagccgcggccgccgacgccgaccggatcggagctcgagtccatggcgagcggaggcgaaggcgccgggagcggcgagtccccgcctgccgccgcgggggaggcgccggcagcggcgggggcgacgctgcacatccggtgcgcgaacggctccaagttcacggtgcaggcggacctggccgccacggtgggcgcgttcaaggaggtcgtggccgggagctgcgacgtgccggcgccgcagcagcgcctgatctacaagggccgcatcctcaaggacgagcaaaccctagaaagctacggtgttgagacatatcacacaattcacttggtgcgtggtgttgcctcaccggctgcatcaggtgcacctgctgctgccagtccccttgcttcatctactcctagcagtggcccagcaggtggcctgggaggtctatttccaggtgttggtgctccaagaagtggcaggccatcaggtttatttggggcaggatttccagaattagaacaagttgagcagcatttaagccagaatccaaacttgatgagggagataatgaatatgccagcaatgcaaaatctcatgaacaacccagatttaatacgcaatatgatcatgagcaacccacagctgcgcgagatca

SEQ ID NO: 47521 - protein, 199 aa, Panicum virgatum
  misc_feature: Ceres CLONE 2037031
  misc_feature (32)..(100): Pfam Name: ubiquitin Pfam Description: Ubiquitin family
MASGGEGAGSGESPPAAAGEAPAAAGATLHIRCANGSKFTVQADLAATVGAFKEVVAGSCDVPAPQQRLIYKGRILKDEQTLESYGVETYHTIHLVRGVASPAASGAPAAASPLASSTPSSGPAGGLGGLFPGVGAPRSGRPSGLFGAGFPELEQVEQHLSQNPNLMREIMNMPAMQNLMNNPDLIRNMIMSNPQLREI

SEQ ID NO: 47522 - DNA, 688 bp, Panicum virgatum
  misc_feature: Ceres CLONE 2037038
  misc_feature: Encodes the peptide sequence at SEQ ID NO. 47523
ggccgcctccgccttcccctcagactccagtcctccccggctccacgccgtcctcccgaccgtgatattccgagtcctgattcaactgccgagccgaccagcgccaccggctagtggggtcgccggcgagcaagagctccccccatcgtcgcctccctcctcactgccctgtaggctgtagcttcggcagcaggaggacaccatgaagctcgacgtgaacgccctgcgctacctcaccagggacgacttccgcgtcctcaccgccgttgagatgggcatgcgcaaccacgagattgtcccagctgagcttgttgacaggatcgctggactgaagcatggcggcacatacaaagtgctgaggaatcttttgaagaacaaattggtgcaccatgatgctactaaatatgatggatatcggctcacctatcttggatatgacttccttgccatcaagactttggttaatcgaggagtttttgcttcggttggccgtcagatcggtgttggaaaggagtcagatatatttgaggttgccacagaggatggtacagtgcttgcaatgaagctccataggttgggcaggacatcttttagggctgtgaaatctaagcgtgattatctaaggcatcgaaggagctttaattggctgtacctctcacgacttgcagccttgaaggaatttgccttt

SEQ ID NO: 47523 - protein, 161 aa, Panicum virgatum
  misc_feature: Ceres CLONE 2037038
  misc_feature (8)..(89): Pfam Name: Rio2_N Pfam Description: Rio2, N-terminal
  misc_feature: SWISSPROT Homolog: EC 2.7.11.1 Non-specific serine/threonine protein kinase
MKLDVNALRYLTRDDFRVLTAVEMGMRNHEIVPAELVDRIAGLKHGGTYKVLRNLLKNKLVHHDATKYDGYRLTYLGYDFLAIKTLVNRGVFASVGRQIGVGKESDIFEVATEDGTVLAMKLHRLGRTSFRAVKSKRDYLRHRRSFNWLYLSRLAALKEFA

SEQ ID NO: 47524 - DNA, 663 bp, Panicum virgatum
  misc_feature: Ceres CLONE 2037047
  misc_feature: Encodes the peptide sequence at SEQ ID NO. 47525
cctgttcttgaagcatttggaaatgcaaagactgtcagaaacaataattcaagtcgtttcggtaaatttgttgagatccagtttgatcagaaagggagaatatcaggagctgccgtaagaacttatctcctcgagagatcccgtgtctgtcaaatatctgatccagagagaaattaccattgtttctacatgctatgttctgcccctcctgaggagcgtgagagatacaaactcggagatcccaaaacgtttcactaccttaatcagtctaactgcatcaagcttgaaggcctagatgaatctaaagagtatcttgaaaccaggaaggctatggatactattgggattagttctgaagagcaggaagcaatctttcgggttgttgctgctattctccacctggggaatgttgagtttgcagaaggggttgatggagattcatcaaaaccaaaagatgaaaaatctctgtttcatttgaggacagctgctgagctcttcatgtgtgatgcaaaagctctagaagactcactatgtcaacgcatcattgtgactcgcgatgagaacatagtaaaaactttggatcctgaatctgcccagggaagtagagatgcactcgctaagactgtttactcgcggttgttcgattgggctgtgaataagatc

SEQ ID NO: 47525 - protein, 220 aa, Panicum virgatum
  misc_feature: Ceres CLONE 2037047
  misc_feature (1)..(220): Pfam Name: Myosin_head Pfam Description: Myosin head (motor domain)
  misc_feature: SWISSPROT Homolog: EC 2.4.1.16 Chitin synthase
PVLEAFGNAKTVRNNNSSRFGKFVEIQFDQKGRISGAAVRTYLLERSRVCQISDPERNYHCFYMLCSAPPEERERYKLGDPKTFHYLNQSNCIKLEGLDESKEYLETRKAMDTIGISSEEQEAIFRVVAAILHLGNVEFAEGVDGDSSKPKDEKSLFHLRTAAELFMCDAKALEDSLCQRIIVTRDENIVKTLDPESAQGSRDALAKTVYSRLFDWAVNK

SEQ ID NO: 47526 - DNA, 596 bp, Panicum virgatum
  misc_feature: Ceres CLONE 2037051
  misc_feature: Encodes the peptide sequence at SEQ ID NO. 47527
agaatctcccctccgcccctccgccccgcccgacccgtgagcgacgcatcgcggcgcagcccccacctcccctccacccctcgtctcccgccgcatctccgcggcgcggtccttcccgacgagccgccgccgccgccgctccccctccatcggccagggagaagatggagggagctggcaaggatggcaacccgctgaggaattaccggattggtaagactctggggattggttcattcggtaaggtcaaaattgcggagcatataagtactggacacaaggtggcaatcaagatcctcaaccgtcgtaaaatcagaggcatggagatggaagaaaaaggttggtgtctcgttgttacatgcctttccctagcttactgatcgactataattaatttttttaggagtaggcaattatctggtatactgatgtattgtgttaagctcatacaccgcagtgtggcctactgagtgcaccatgcagtactatatggcattatgctaaccttacatctatgaacattattgcaattgatatgagcaaggcaccgccattttgctgctgtttgttttgaaggacaagtttttatagttgtt

SEQ ID NO: 47527 - protein, 71 aa, Panicum virgatum
  misc_feature: Ceres CLONE 2037051
  misc_feature: SWISSPROT Homolog: EC 2.7.11.1 Non-specific serine/threonine protein kinase
MEGAGKDGNPLRNYRIGKTLGIGSFGKVKIAEHISTGHKVAIKILNRRKIRGMEMEEKGWCLVVTCLSLAY

SEQ ID NO: 47528 - DNA, 592 bp, Panicum virgatum
  misc_feature: Ceres CLONE 2037057
  misc_feature: Encodes the peptide sequence at SEQ ID NO. 47529
acacacagctcagtagcaccatcgcatcgcgcccccgtctccatttctttgtctctctcccggtcttaaaaatccaacgcggccgccggacgcgcattgctcttcctccctccctggttggcctccccgccccctcttcccctgctcctccccttcttccccgcgggccgggcgttcttggagccggagcttctggagttgctgctgctgctgctgctgctgccggcggtggtcccgtaggtggcggttcgcaatggggaggagcagccgcgcctgctccgtccttggctctgccctgctcctcctcctgctctcgctcggctccgccgccgcgcagaagggctccacctggaagaccctgagtggcaaggctccagcaattattgccaagggcgggttctcaggcctttttccagattccagtggtcttgcttatcagtttgttggatttgctagctctcctgacacagctatctcgtgcgatgtttggctgaccaaggatggaactggcatctgccttccaaatataaatatggataactgtaccacaatatccgatcatttcccacaggagaagaagacctacaatgtt

SEQ ID NO: 47529 - protein, 112 aa, Panicum virgatum
  misc_feature: Ceres CLONE 2037057
  misc_feature: Functional homolog of the protein sequence given in SEQ ID NO 51292
  misc_feature: Useful for making plants with altered cell wall content and/or composition
MGRSSRACSVLGSALLLLLLSLGSAAAQKGSTWKTLSGKAPAIIAKGGFSGLFPDSSGLAYQFVGFASSPDTAISCDVWLTKDGTGICLPNINMDNCTTISDHFPQEKKTYN

SEQ ID NO: 47530 - DNA, 596 bp, Panicum virgatum
  misc_feature: Ceres CLONE 2037065
  misc_feature: Encodes the peptide sequence at SEQ ID NO. 47531
gctgcttgctctctctggcttccttccaacccaaaccagagcccgaacccaccgccaccgcccattccgcccccgtcgcctcccccgcaaaacccaatcccgagccagccagacagcccggccaccaaaccctaatccccccgcgccacgcctcgcgcgcgcgcgcggcctcccatgggctgaccgcgccgcggtggggagcccccggatccggagctagggttccgccttggagtgggacagcgagtccgacggcgccggcagcggcggcgccggcgacgaggaggaggaggaagaggaggaggaggaggaggaggtgggagccgcgggagccggtgacgcggcggccgccgccgccggcgggatgttcacgttcgcgatcgaaggcatgctgcgcgcgtccgggccgtgcgggctggtcgtcaccgacgcgctcgagcccgactgccccatcatctacgtcaaccgcggcttcgaggaggccacgggataccgcgccgaggaggtgctcggcaggaactgccggttcctgcaatgtagagggccatttgctcaaaggaggcaccccctagttgatgccgcagtggtttcaaata

SEQ ID NO: 47531 - protein, 77 aa, Panicum virgatum
  misc_feature: Ceres CLONE 2037065
  misc_feature: SWISSPROT Homolog: EC 2.7.11.1 Non-specific serine/threonine protein kinase
MFTFAIEGMLRASGPCGLVVTDALEPDCPIIYVNRGFEEATGYRAEEVLGRNCRFLQCRGPFAQRRHPLVDAAVVSN

SEQ ID NO: 47532 - DNA, 660 bp, Panicum virgatum
  misc_feature: Ceres CLONE 2037084
  misc_feature: Encodes the peptide sequence at SEQ ID NO. 47533
attcctcggttcctcccctccaccaaaggcaagaacgaagctgccagccccaccgatcgcaccccctccctcgcggcagcggcggcggagatgtggctggtggtgccgccggaggagaccaaccggtgcgtgcgcgggtgctgccgcagcgccgccatcccgctccacctccggcccgcctccttctccctcctctccccaatcgcgcgagggtcggagagcacggtgtacgaggctcggctggccggcgagcgcgtcgcggccaagaagcccgtgctgtccacgtccgaggacctcgacaagttccactaccagctccagctcctctgtgagctggatcacccagggttggcgaaactgatcgcagcacatgcacaccctccaaattatttgatgttttttgatttcttcgagcctccaaaccttgcggacaagattcatgttgaagaatggagcccttctgtccagcaagtggtggccattgccagcgatctagcaaaggctctccagtacctacacatccttggggttgttcacagagatataaaacctgcaaatattttgctagacaaagacctccatccacacctagcagattttggcttagccatgtttcagaaggatattaagcgtgtctcagttgagaactggaaatcatct

SEQ ID NO: 47533 - protein, 189 aa, Panicum virgatum
  misc_feature: Ceres CLONE 2037084
  misc_feature (32)..(187): Pfam Name: Pkinase Pfam Description: Protein kinase domain
  misc_feature: SWISSPROT Homolog: EC 2.7.11.1 Non-specific serine/threonine protein kinase
MWLVVPPEETNRCVRGCCRSAAIPLHLRPASFSLLSPIARGSESTVYEARLAGERVAAKKPVLSTSEDLDKFHYQLQLLCELDHPGLAKLIAAHAHPPNYLMFFDFFEPPNLADKIHVEEWSPSVQQVVAIASDLAKALQYLHILGVVHRDIKPANILLDKDLHPHLADFGLAMFQKDIKRVSVENWKS

SEQ ID NO: 47534 - DNA, 584 bp, Panicum virgatum
  misc_feature: Ceres CLONE 2037094
  misc_feature: Encodes the peptide sequence at SEQ ID NO. 47535
atcagcgaaccactcagatctgccgttcccgacccggagccagcgaggcgaggcgggacgccatcagccatggagcccgggctgagcatcgagtccggctccgccatccgcgtggcggtgctccccgtgggcggcacgatcccgccgccgcgcctgcgcgagtacgcggcgctggtggcgcgccacgcgcgcgtcgacctcgcctcgctccgcacctactactcggagcaccagaagagccccttcgcgcaccagccctgggaaaccgggtgcctccgcctcaagttcgtgctcggcgggtgcgtgccttccccctgggaggacttccagtcctcgcgcaaggtgctcgccgtgatcggcatctgccacctgccgtcctcacccgacctcgaccgcgtcgcggccgacttcatcgatgcagcgcggacgtacccctcggcgctcgccagacggtgcttcgccttctgccccacggacgcgcagatggagggaaaaaagagagatgacattattatgttccctccttctgatcagcaatcgctggagcttcatatgcttacaatgatccaagatcttgctgcttc

SEQ ID NO: 47535 - protein, 171 aa, Panicum virgatum
  misc_feature: Ceres CLONE 2037094
  misc_feature (1)..(171): Pfam Name: Trs120 Pfam Description: Transport protein Trs120
MEPGLSIESGSAIRVAVLPVGGTIPPPRLREYAALVARHARVDLASLRTYYSEHQKSPFAHQPWETGCLRLKFVLGGCVPSPWEDFQSSRKVLAVIGICHLPSSPDLDRVAADFIDAARTYPSALARRCFAFCPTDAQMEGKKRDDIIMFPPSDQQSLELHMLTMIQDLAA

SEQ ID NO: 47536 - DNA, 668 bp, Panicum virgatum
  misc_feature: Ceres CLONE 2037097
  misc_feature: Encodes the peptide sequence at SEQ ID NO. 47537
atcctcctcctcctcaggtcttccccctcctcccccgatccccaaatcctcctccggatttcgcactcagccgcggcgcaggtggtgaagggaggcagagaggggaaacatggggctcgcgttcgggaagctcttcagccggctcttcgccaagaaggagatgcggatcctcatggtcggcctcgacgccgccggtaaaacaaccatcctctacaagctcaagctcggcgagatcgtcaccaccatccccaccatcggtgagccactcgcacaagcctcctctcccttgccttgtccacgcttgatcggagtttcggatcgtgtgatgcaattcggctgtggagggaatgccttgttaccgtttctatgcggacggacaatggttccattccacgcgtgaatgatggatctgatggatccgtattcgatgtgaaacaatgaggccttgacaggtttagaaagaccgtttggcacaatgttcccagttcccactatgtttgaattgaatcccagcatatgcatatctgattttacctgtgcacacgctgccgcaccagatttgatgcaacacatgcgttttacgttggcctatttggctgcaagatccatttgtttctaatgaacatgattcctttttttctttaatgtcaccatcaagcattcatgat

SEQ ID NO: 47537 - protein, 96 aa, Panicum virgatum
  misc_feature: Ceres CLONE 2037097
  misc_feature (5)..(90): Pfam Name: Arf Pfam Description: ADP-ribosylation factor family
MGLAFGKLFSRLFAKKEMRILMVGLDAAGKTTILYKLKLGEIVTTIPTIGEPLAQASSPLPCPRLIGVSDRVMQFGCGGNALLPFLCGRTMVPFHA

SEQ ID NO: 47538 - DNA, 659 bp, Panicum virgatum
  misc_feature: Ceres CLONE 2037147
  misc_feature: Encodes the peptide sequence at SEQ ID NO. 47539
agcattaaccagcagctcgcacacacgcgccgcggccggccactccgtgaggccgccccccgcccgcccgcccgcccgcgccgcgcaagagagaaccgccgggcatgcagcgcctcgcctcctcccggaggctcctccgggccgcgctcgtccccgccagggccaactccagcctctccgcggccgtcgccgcggcgcccgcggtggagaatggcgccgccgcgtccccgaagatgccgggcttcgactacacgccgccgccctacgacggcccgcgggccgaggagatcttccggaagcgggccgagttcctcagcccgtccctcttccacttctacgaccgccccgaaaaaatgtcgtcttcttggtagtcctttcacacagaagtgttctttgtcgctttccgataggtttggtaggaatgcccctatcccatgtgctctgttcttatctcatgtcatgtacgatctgataataattcagcgagatctgtcccaaggtatccttcagaatcccccaggacgccagcagccacaaattctgaattgtttgttaaaaacaaattctgcatcgctggcagtaccactcaagaaactggttgatagcactgtcgctggaggacagtatgttttctctccgttgtactagtagatcctttt

SEQ ID NO: 47539 - protein, 88 aa, Panicum virgatum
  misc_feature: Ceres CLONE 2037147
  misc_feature: SWISSPROT Homolog: EC 2.6.1.44 Alanine--glyoxylate transaminase
MQRLASSRRLLRAALVPARANSSLSAAVAAAPAVENGAAASPKMPGFDYTPPPYDGPRAEEIFRKRAEFLSPSLFHFYDRPEKMSSSW

SEQ ID NO: 47540 - DNA, 700 bp, Panicum virgatum
  misc_feature: Ceres CLONE 2037193
  misc_feature: Encodes the peptide sequence at SEQ ID NO. 47541
gccaatgacattggcatggtagcttggatcttagagatgtccactcctgaatttccaaatggcaggcagattattgttgtagcaaatgatattactttcagagctggatcatttggcccaagggaagacgcattttttgaagctgtcaccaacctggcctgcgagaggaagcttcctcttatttacttggcagcaaactctggtgctaggattggcattgccgatgaagtgaaatcttgcttccgtgttgggtggtctgatgaaggcagccctgaacgtggatttcagtacatttatctaactgaagaagactatgctcgtattagctcttctgttatagcacataagctgcagctggatagcggtgaaattaggtggattattgactctgttgtgggcaaggaggatgggcttggtgttgagaatatacatggaagtgctgctattgccagtgcttattctagggcatacgaggagacatttacacttacatttgtcactggacggactgtagggataggtgcttatcttgctcgtcttggtatacgttgcatacaacgtcttgaccagcctattattttaactgggttttctgccctgaacaagcttcttgggcgggaagtgtacagctctcacatgcagttgggtggtcctaagatcatggcaaccaatggtgttgtccacttgactgtttcagatg

SEQ ID NO: 47541 - protein, 233 aa, Panicum virgatum
  misc_feature: Ceres CLONE 2037193
  misc_feature (11)..(233): Pfam Name: Carboxyl_trans Pfam Description: Carboxyl transferase domain
  misc_feature: Functional homolog of the protein sequence given in SEQ ID NO 51511
  misc_feature: Useful for making plants with altered oil content
  misc_feature: Useful for making plants with modulated herbicide sensitivity
ANDIGMVAWILEMSTPEFPNGRQIIVVANDITFRAGSFGPREDAFFEAVTNLACERKLPLIYLAANSGARIGIADEVKSCFRVGWSDEGSPERGFQYIYLTEEDYARISSSVIAHKLQLDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVSD

SEQ ID NO: 47542 - DNA, 695 bp, Panicum virgatum
  misc_feature: Ceres CLONE 2037194
  misc_feature: Encodes the peptide sequence at SEQ ID NO. 47543
acacaaaataacgatcatggacatggatagcccgtccctgcactactactgcagttgcctactgttgcttgctctcctctactccctaaccaaatgtttctacaatgcatccgcccgctccagctgccatcgtggcctacggctccccccgtgcccatggcagctccctgtcatcggcagcctccaccacctggccggcgcgctcccacaccgctcgctgcgccgcctctcacacagctacggccctatcatgctcctcaggttcggcgaggtcccggtcgtcgtctcctccggcgaggccgccaggggggtcatgaggacgcacgacgtggccttcgccacgaggccccagctcgcggccatcaagattctcaccaaggaaggtcattgtaacgccccgatatttgccggggtcaccaaggccaatttggccacggcaccgccgaacgacgcgcgcgttccgcgtgtcccgcattgccgccgagccgccccttccttctgctgctgctcgcccactgccctctccctttcttcttcctcgagcagagccatggttgccgcccgacccccacgccgagccgccgtctgagctcgccccgacctccaccaaccctccaggcgcactccccacctcctatggcacctccccgaattgccagaccgccgctccggccaccagcttaccggaacagaac

SEQ ID NO: 47543 - protein, 190 aa, Panicum virgatum
  misc_feature: Ceres CLONE 2037194
  misc_feature: SWISSPROT Homolog: EC 1.14.13.68 4-hydroxyphenylacetaldehyde oxime monooxygenase
MDMDSPSLHYYCSCLLLLALLYSLTKCFYNASARSSCHRGLRLPPCPWQLPVIGSLHHLAGALPHRSLRRLSHSYGPIMLLRFGEVPVVVSSGEAARGVMRTHDVAFATRPQLAAIKILTKEGHCNAPIFAGVTKANLATAPPNDARVPRVPHCRRAAPSFCCCSPTALSLSSSSSRAMVAARPPRRAAV

SEQ ID NO: 47544 - DNA, 703 bp, Panicum virgatum
  misc_feature: Ceres CLONE 2037198
  misc_feature: Encodes the peptide sequence at SEQ ID NO. 47545
aaaaaaaaaacaaggggagaagcatatagctcacgcggaacacgggagcggcggaagcaaacaactgaaattccccagtccggttccttccgtgcgatttgatctcgtcggaggcgcggccgcggttacccccaacccgccatcgaattcgatggcggccaacgccggcaacaagatccgcaacgccaagctggttcttcttggagatgtgggcgctggcaaatctagtttggttcttcggtttgtgaaaggacagtttgttgaattccaggaatcaacgattggagcagctttcttctctcagaccttggcggtcaatgatgagactgttaagtttgaaatctgggatactgctgggcaagagaggtaccatagcttggcacccatgtactataggggtgctgctgccgccatcgttgtctacgacattacgaatctggttagtaaaacactaatagtttacttgttctagataaattgatttatcaggatttaggaccccagcaatttctttcaaagattcatagtttaatggattctttggttaataataacagttagaagttaaaactctcatgccagtgcattgctgagatgagcactggttagtaataaaaccataattagcaaaagttttcagatagttccattcatgattcttgtgatgcaagcaattaaaactagatgtttgtaggaatatgac

SEQ ID NO: 47545 - protein, 106 aa, Panicum virgatum
  misc_feature: Ceres CLONE 2037198
  misc_feature (13)..(105): Pfam Name: Ras Pfam Description: Ras family
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNLVSKTLIVYLF

SEQ ID NO: 47546 - DNA, 695 bp, Panicum virgatum
  misc_feature: Ceres CLONE 2037207
  misc_feature: Encodes the peptide sequence at SEQ ID NO. 47547
gtggtcatcatcatatcatcaatctttctccacagagcattccagcatctcctcctatccacttattatccagctggtggtacggttctcagacgatcattgccggagtcgtcggccgtgagcacggctgtcgggtcgtcggcgtacgtcgtcaccgtggaattgtagctagaacaacacgatggctaactcagctaccaagcatgctttcaagagaattttggccagcctccctaagcctggcggcggagaatatgggaagttcttcagccttcctgcattaaatgatccaaggatcgataggctaccgtactccattcgtgttcttctcgaatcagctattcgccattgtgataacttccaagttacagagagtgatgtcgagaaaatcatcgattgggagaacacatctccaaagcaggctgagatacctttcaagccagcgagatgcattctaatggacaacactggagtcccagcggtggtagaccttgcagctatgcgcgatatgatgccaaagttgggctgcgatcctgacaagatcaacccactgattccagtggatgctgttattgaccatgcggtgcgagtggatgtagcaaggagatgtgatgcgttggataaaaaccaggagctagagtttgatcgcaacaaagaaaggtttgcattccttaaatgggcatccactgcttttc

SEQ ID NO: 47547 - protein, 171 aa, Panicum virgatum
  misc_feature: Ceres CLONE 2037207
  misc_feature: SWISSPROT Homolog: EC 4.2.1.3 Aconitate hydratase
MANSATKHAFKRILASLPKPGGGEYGKFFSLPALNDPRIDRLPYSIRVLLESAIRHCDNFQVTESDVEKIIDWENTSPKQAEIPFKPARCILMDNTGVPAVVDLAAMRDMMPKLGCDPDKINPLIPVDAVIDHAVRVDVARRCDALDKNQELEFDRNKERFAFLKWASTAF

SEQ ID NO: 47548 - DNA, 685 bp, Panicum virgatum
  misc_feature: Ceres CLONE 2037228
  misc_feature: Encodes the peptide sequence at SEQ ID NO. 47549
tggagaatcgattcaaaacagagctgatatattgcagaacacagctttgaacgctgctctgaacactcaatttcttttccaaattggtgtgtttactgcagttcccatgattcttggttttatccttgaatcaggtgtcttaacggcttttgtccaatttatcacaatgcagttccaactatgctctgtatttttcactttctcacttggaacgaggactcactactttggccgtgcattattacatggaggtgcaaagtatagagcaactggcaggggttttgtggtacgtcacatcaagtttgctgagaactatcgcctttattcacgaagccactttgtgaaagggatggaggttgcgcttttattggtgatctttctagcatatggtttcaatgatggtggagcagttggctatattttactctctataagcagttggtttatggtgctgtcttggctttttgctccctacttatttaacccatctggtttcgaatggcagaaggtcgttgaggatttcagagactggacaaattggctgttttatcgaggtggtattggtgtcaaaggagaagaaagctgggaagcttggtgggaagaagaactgcaacatatttacaccatccgagggaggatactggaaactatactaagcctaaggttttcatcttccaatatggag

SEQ ID NO: 47549 - protein, 227 aa, Panicum virgatum
  misc_feature: Ceres CLONE 2037228
  misc_feature: SWISSPROT Homolog: EC 2.4.1.34 1,3-beta-glucan synthase
  misc_feature: Functional homolog of the protein sequence given in SEQ ID NO 51248
  misc_feature: Useful for making plants with altered cell wall content and/or composition
GESIQNRADILQNTALNAALNTQFLFQIGVFTAVPMILGFILESGVLTAFVQFITMQFQLCSVFFTFSLGTRTHYFGRALLHGGAKYRATGRGFVVRHIKFAENYRLYSRSHFVKGMEVALLLVIFLAYGFNDGGAVGYILLSISSWFMVLSWLFAPYLFNPSGFEWQKVVEDFRDWTNWLFYRGGIGVKGEESWEAWWEEELQHIYTIRGRILETILSLRFSSSNM

SEQ ID NO: 47550 - DNA, 667 bp, Panicum virgatum
  misc_feature: Ceres CLONE 2037239
  misc_feature: Encodes the peptide sequence at SEQ ID NO. 47551
cccaccgaaacactccgcccgccgcggcgttccccccactccctgtccgtcctcgccctcaggcctcggccaccacacttcgctctcgctcgctccccgccgccgcgtaccgctattaataccaccacctcctccgccagacggccaccaccgcgctccatacaaactcagctccgaccgaccatggccgccgccgcggcctcattcgccgcccttccgtgcctcctgctggtgccggtgtggttgcattacgtgccaggaacggttttccgtacgaacaatgaaccattcaagagccatatgcagagcttcacgacgtacatcgtgaatatgatgaagaaagagcagctctttgcttcgcagggagggaacattatcctagctcagattgaaaatgaatatgggggttatcttgaggagtattatggtactgccggcaaggcatacgcaatgtgggcagctagtatggcccttgctcagaacaccggtgtcccttggataatgtgccagcagcctgacgctcccgatcctgtgataaacacctgcaattcattctactgcgatggcttccagccaaattcgcctaccaagccaaagttttggactgagaactggccaggatgacttttggtgaaagtaatccccacagaccacctgaagatgttgc

SEQ ID NO: 47551 - protein, 146 aa, Panicum virgatum
  misc_feature: Ceres CLONE 2037239
  misc_feature (1)..(146): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51738
  misc_feature: Useful for making plants with altered cell wall content and/or composition
  misc_feature: Functional homolog of the protein sequence given in SEQ ID NO 51319
  misc_feature: Useful for making plants with altered carbohydrate content
  misc_feature: The sequence is a functional homolog of SEQ ID NO 2 in US patent 7084321
MAAAAASFAALPCLLLVPVWLHYVPGTVFRTNNEPFKSHMQSFTTYIVNMMKKEQLFASQGGNIILAQIENEYGGYLEEYYGTAGKAYAMWAASMALAQNTGVPWIMCQQPDAPDPVINTCNSFYCDGFQPNSPTKPKFWTENWPG

SEQ ID NO: 47552 - DNA, 376 bp, Panicum virgatum
  misc_feature: Ceres CLONE 2037247
  misc_feature: Encodes the peptide sequence at SEQ ID NO. 47553
gttttacccaaagaggaggaggacaagtgcatggtcgcgggcgtggccgtgggcatagtagctttggtcaaggccgtggacgtggctatgtgcgaaagggaaacgtggagaaatcagctgaacaattggacaaggagcttgacaattaccattctggtgcgatgaatgttgactaagatggtgcatccaccatccagtcaccttgaagttggatgtatgttgaacataagcttggtattctgtcaggtgtgcgcatgtctgactgctttcgttgtctagctggaagattagatttcacctgcgatttcgtgtttgatgtttgtcctatggatgataccataattggcttgtgacagaatgatgaatcgtgtttttc

SEQ ID NO: 47553 - protein, 57 aa, Panicum virgatum
  misc_feature: Ceres CLONE 2037247
  misc_feature: Functional homolog of the protein sequence given in SEQ ID NO 51030
  misc_feature: Useful for making plants with altered alkaloid content
  misc_feature: Functional homolog of the protein sequence given in SEQ ID NO 50867
  misc_feature: Useful for making plants with modulated biomass
FTQRGGGQVHGRGRGRGHSSFGQGRGRGYVRKGNVEKSAEQLDKELDNYHSGAMNVD

SEQ ID NO: 47554 - DNA, 678 bp, Panicum virgatum
  misc_feature: Ceres CLONE 2037253
  misc_feature: Encodes the peptide sequence at SEQ ID NO. 47555
acggcacaccgccacggccactgccggccgcctactccgagagcctcacccatcccgtaggcggcggcggcggcagcaccgcagcagcagaggagaaaaaggccttccggctccggaaccccgcggacccgaccagccacgcggccctcccatccgcgagacgcgcttccctccgaattccaaaacagcacacgcgcgcgcgccatggcggagcgcctcgccgcctccctcctccccgcggcctccccgtccccgtccgcccgccgcgccacggtcggggccgcggccgccgcgcccttcccttgctcgggccccgcccgcgcggggctgcgcctccgctcctcccgtcgtccggcccgcttctccaaggcggccgccggccgcggcggcggcggcgcgctccgggtggtccggtgcatggcggcgtcggacgcggcgcagctcaagagcgcgcgggaggacatcagggagctcctcaagaccacgtactgccacccgatcatggtccgtcttgggtggcatgattctggtacgtatgacaagaatattgaggagtggccccagcgcggcggagctgatggaagcttaagatttcaacctgagttgaatcatggagccaatgctggtctgattaatgctttgaagcttatccaacctatcaaggacaaatacccaggt

SEQ ID NO: 47555 - protein, 157 aa, Panicum virgatum
  misc_feature: Ceres CLONE 2037253
  misc_feature: SWISSPROT Homolog: EC 1.11.1.11 L-ascorbate peroxidase
MAERLAASLLPAASPSPSARRATVGAAAAAPFPCSGPARAGLRLRSSRRPARFSKAAAGRGGGGALRVVRCMAASDAAQLKSAREDIRELLKTTYCHPIMVRLGWHDSGTYDKNIEEWPQRGGADGSLRFQPELNHGANAGLINALKLIQPIKDKYP

SEQ ID NO: 47556 - DNA, 669 bp, Panicum virgatum
  misc_feature: Ceres CLONE 2037255
  misc_feature: Encodes the peptide sequence at SEQ ID NO. 47557
atcggctttgctccgccgccggcgagtgagaccgggcggcgaggccgcggcggcggcggcggcggcggcggcggcgatggggtcgatgacgatcggcgccaagtacaagaccacgctcaaggaccccggcaccccgggcgtcctccgcatgaacgacgataagttcactttcactcctaatgatccacgctcggcaatgaagctcaatgttgatttccgaagcattaaaggtcacaagttcaataaagtagatggtaacaaaccagcattattgaatctttcaaaagattctgacaagggtggaggttacatgtttgagtttgacaatgttggtaaccgtgacctatgtcgagactttgtagctaaggttttaggcaaacatcaaggggtagtgccccctcgaccaactgcagctcctgaaaactcagttgcttctgctggtctggaacagctcagtgctgctgaagtggaacggcgggtgaaactgttgcgagaagacagtgaattgcagaaattacataagaagtttgttcttggaaatattctgcaagaatctgaattttgggcaacaagaaagaatttgctagatgatcaagcaaataaagcatctaaacaaaggctaggcttcaagactgcgatgtcagatgttaggccatcagctgatggtcg

SEQ ID NO: 47557 - protein, 197 aa, Panicum virgatum
  misc_feature: Ceres CLONE 2037255
  misc_feature (113)..(180): Pfam Name: BSD Pfam Description: BSD domain
MGSMTIGAKYKTTLKDPGTPGVLRMNDDKFTFTPNDPRSAMKLNVDFRSIKGHKFNKVDGNKPALLNLSKDSDKGGGYMFEFDNVGNRDLCRDFVAKVLGKHQGVVPPRPTAAPENSVASAGLEQLSAAEVERRVKLLREDSELQKLHKKFVLGNILQESEFWATRKNLLDDQANKASKQRLGFKTAMSDVRPSADG

SEQ ID NO: 47558 - DNA, 642 bp, Panicum virgatum
  misc_feature: Ceres CLONE 2037265
  misc_feature: Encodes the peptide sequence at SEQ ID NO. 47559
accttgcctctgctcctagctcgttacagctgccatccatggggattccttctttctacaagtggcttgtgaccaaatacccaagcatcgtctcctccgcaaaggaggaaccagaggggagccctgatggcgtcatctatgacaacctctacctcgacataaattgcatcatccaccattgcttccacccgcaagacagcatgcatgcagacatagatgtgtgccctccgacgacggtcaccgaggtcttggagtccattttcgagtacttggatcgcctgttccgcatcgtcaggccgagaaggctcctctacttggcagtagatggcgttgctccttgcgccaaaatgaaccgaatgcgacggggacgtttccactctgcttggctagcaagggatgaggcgcttgaagaggaagagatgcggagggaattaagagctcgaccatgcttccatttacaggcgcttgaagaggaagagatgcggagggaattaagagctcaagggaaggaggtgccaccgccagagatttcagaggtttctgaccccaatgtcatcacaccagggactgaattcatggagaagctatcacaagcgctccaatactacatccgtgccagactgaatactgacccggggtgga

SEQ ID NO: 47559 - protein, 201 aa, Panicum virgatum
  misc_feature: Ceres CLONE 2037265
  misc_feature (1)..(201): Pfam Name: XRN_N Pfam Description: XRN 5'-3' exonuclease N-terminus
MGIPSFYKWLVTKYPSIVSSAKEEPEGSPDGVIYDNLYLDINCIIHHCFHPQDSMHADIDVCPPTTVTEVLESIFEYLDRLFRIVRPRRLLYLAVDGVAPCAKMNRMRRGRFHSAWLARDEALEEEEMRRELRARPCFHLQALEEEEMRRELRAQGKEVPPPEISEVSDPNVITPGTEFMEKLSQALQYYIRARLNTDPGW

SEQ ID NO: 47560 - DNA, 469 bp, Panicum virgatum
  misc_feature: Ceres CLONE 2037277
  misc_feature: Encodes the peptide sequence at SEQ ID NO. 47561
gcctgtggccggagggtgctgggcggcgtagcacgaggagtgcagagcatgaagtgatccctgctaaggaaattgcgcaatctgttgccaagttcatggaacatggaggtgctgcggaagccgcgaggagaagggtaaaggaactttctccaaaggctcatgcggctttggcagaaggcggaacctctaaccgtgatctgcatcagcttatcgatgatttcattgctgcaaaagcatctgctgctgggactacgacgtcatgaaaagattgagaatccaagtggaacgcaaggtttaatttcatgaagaagggggaggtggctatctatgcatgtgccatggtgtttcaagaataaaagtttgttgtcccgcaaacggttcactgtaaaatgtatctgcgagcggacatttcaaagatgatatgtattggtacttttaataaatttaaagtatcgcattgttgttggtc

SEQ ID NO: 47561 - protein, 86 aa, Panicum virgatum
  misc_feature: Ceres CLONE 2037277
  misc_feature: Functional homolog of the protein sequence given in SEQ ID NO 51247
  misc_feature: Useful for making plants with altered carbohydrate content
LWPEGAGRRSTRSAEHEVIPAKEIAQSVAKFMEHGGAAEAARRRVKELSPKAHAALAEGGTSNRDLHQLIDDFIAAKASAAGTTTS

SEQ ID NO: 47562 - DNA, 690 bp, Panicum virgatum
  misc_feature: Ceres CLONE 2037293
  misc_feature: Encodes the peptide sequence at SEQ ID NO. 47563
ctcttccctttccacacacccacctccacccccacccaaacctctccactctctagcaggggggagtaggaggagacgggagcgatttgcggatcgaatccatggcgcggaccaactgggaggccgataagatgctcgacgtctacatctacgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccactcctccaccgccaaggcctcctcctccgccggggcgcctcctccccacctcgatatcaacaagtcgagggagcaccagatgaggctccagctactgcaccagcacaacgcccaactccacaccagaggagctgcccctcctcctcccgcctccatcaatgccctcaactctgacgtctccgccgtccttgcttctaaaatgatggaggaccggatcaggaaccccaaccctggcgattccgacgcgtcacagcatctcctggacgcaaacaggatcgcccttctcaagtcaccacctaaccacactgggtaactacacctcacctcatcatccataaaaacacctgctcattttgtattagtattaccatggtttctggctgtgatcccttctcctt

SEQ ID NO: 47563 - protein, 167 aa, Panicum virgatum
  misc_feature: Ceres CLONE 2037293
  misc_feature (10)..(36): Pfam Name: LisH Pfam Description: LisH
MARTNWEADKMLDVYIYDYLVKRNLQATAKAFIAEGKVATDPVAIDAPGGFLFEWWSIFWDIFHSSTAKASSSAGAPPPHLDINKSREHQMRLQLLHQHNAQLHTRGAAPPPPASINALNSDVSAVLASKMMEDRIRNPNPGDSDASQHLLDANRIALLKSPPNHTG

SEQ ID NO: 47564 - DNA, 664 bp, Panicum virgatum
  misc_feature: Ceres CLONE 2037325
  misc_feature: Encodes the peptide sequence at SEQ ID NO. 47565
taagttatatgacaccacaaatcatacatcccctattaaaatgtatggttccgatttcagttcatctggtgatctgcagcgcattagtaacattgattttggtgacccaacacgcaaacatgaaatgcattgcagattcaagtatgaacccccactgccctggtctgcaataacaatatcgacagctgtagctataattgttttgcttgttggacatataatttatgcaactctgaactcccttgaaaaggctgaacatgattatagggtaatgagagaactaaaaggacgagctgaagctgcggatgttgcaaagtctcagtttctagcaactgtttcccatgagattcggactccagtgaatggtgttctaggtatgttgcagatgctaatggacactgaacttgatacaactcagcaggattttgtagttactgctcaagaaagtggaaaggcattgataaacttgataaatgaagtccttgatctggctaagatagagtcaggaaggattgagttggaaacagtgccttttgatgtccgtgatattattgataatgtggtatctctattctatgaaaaatcacaggctaaaggcatagagttggccgtgcttgtatctgatcaagttccagatgttctaattggggatccatggaggttt

SEQ ID NO: 47565 - protein, 220 aa, Panicum virgatum
  misc_feature: Ceres CLONE 2037325
  misc_feature (104)..(169): Pfam Name: HisKA Pfam Description: His Kinase A (phosphoacceptor) domain
  misc_feature: SWISSPROT Homolog: EC 2.7.13.3 Histidine kinase
  misc_feature: The sequence is a functional homolog of SEQ ID NO 5 in US patent 7026530
KLYDTTNHTSPIKMYGSDFSSSGDLQRISNIDFGDPTRKHEMHCRFKYEPPLPWSAITISTAVAIIVLLVGHIIYATLNSLEKAEHDYRVMRELKGRAEAADVAKSQFLATVSHEIRTPVNGVLGMLQMLMDTELDTTQQDFVVTAQESGKALINLINEVLDLAKIESGRIELETVPFDVRDIIDNVVSLFYEKSQAKGIELAVLVSDQVPDVLIGDPWR

SEQ ID NO: 47566 - DNA, 634 bp, Panicum virgatum
  misc_feature: Ceres CLONE 2037327
  misc_feature: Encodes the peptide sequence at SEQ ID NO. 47567
aagccgagcaacgcagagaaaggcgtcttcgtactcgcctctctctgcgactcgaagctttccccccaacccacattccccaccgccgccgccgccccaccatgagggagtgcatctcgatccacatcggtcaggccggtatccaggtcggaaacgcgtgctgggagctctactgcctcgagcatggcattcaggctgatggccagatgcctggtgacaagaccattggaggaggtgatgatgctttcaacaccttcttcagtgagactggcgctgggaagcacgtcccccgtgctgtatttgttgaccttgagcccactgtgattgatgaagtgaggactggcacttaccgccagctcttccaccctgagcagctcatcagtggaaaggaggatgctgccaacaacttcgcccgtggtcactacaccattggcaaggagattgttgacctgtgccttgaccgcatcaggaagcttgccgacaactgtactggtctccagggcttccttgtcttcaacgctgttggtggaggaacaggctctggtcttggttccctcctccttgagcgcctgtctgttgactatggcaagaagtccaagctcgggttcactgtgtacccatctcccccaggtct

SEQ ID NO: 47567 - protein, 177 aa, Panicum virgatum
  misc_feature: Ceres CLONE 2037327
  misc_feature (49)..(177): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPPG

SEQ ID NO: 47568 - DNA, 703 bp, Panicum virgatum
  misc_feature: Ceres CLONE 2037347
  misc_feature: Encodes the peptide sequence at SEQ ID NO. 47569
aacccccgtcctccttccttccccaagtccccaacccccctcgcctctcccctccccaaaccctacacacctcgccccggcggtgctccgccgtccccatcgcgccgccccggcccggccacgcggaccagtgaccgcctccccaccgaaaggtaccgcgccgtgcggcgggtcgcgcagacggccaccccccactcggcgccgcccgccgcccgccgccgccgcctttgatgtctcccacctgcgacctcggcttcctctggccccggtcgcagaagagctcccaagaggttccccgagcggccacttccggcgcccagagattggcctccccaccgcagcggagatgagtggcggcggcagtggcagcggcgacaagatgttgctgttcgggtcctttacagaggatgagacgaagttgttccagggtcagcctctcaaaagtccgactaaaagtgcgaccaaatcatgggaacatccagagatccagtttggctcgctgaacttttcagttctgagtctacagaaagcatcaagtcctattgctaaaggtgttgttcttcctgcaaaatcagcagatgctcagagcagtgtcattacaaaagagaatgcatgcagtaataaaaaggaagctgtaggatctagctttccaaatggtggaccagttctggctaatggatgcccccttgtgaatgtttttcct

SEQ ID NO: 47569 - protein, 118 aa, Panicum virgatum
  misc_feature: Ceres CLONE 2037347
  misc_feature: SWISSPROT Homolog: EC 3.1.2.15 Ubiquitin thiolesterase
MSGGGSGSGDKMLLFGSFTEDETKLFQGQPLKSPTKSATKSWEHPEIQFGSLNFSVLSLQKASSPIAKGVVLPAKSADAQSSVITKENACSNKKEAVGSSFPNGGPVLANGCPLVNVF

SEQ ID NO: 47570 - DNA, 672 bp, Panicum virgatum
  misc_feature: Ceres CLONE 2037398
  misc_feature: Encodes the peptide sequence at SEQ ID NO. 47571
cacttcccccaggtcccagctctgctcgcctcccttccccagcgccgcccaagctcgcaagcgcgccgggacaccatccccatccaggcggaggagcaggagtagatccgcgcggcggcattcaggagtagagcttgtgagcacggtgttagcgcgggtagaggggcaacatgagtatgtacgggagggacccgtggggcgggccgctggagatatgccacgactcggcgacggacgacgaccggagccggaacctggacatcgaccggggcgcgctgtcgcggacgctcgacgagacgcagcagagctggctgctggccgggccgggggaccagggccgcaagaagaagaagtacgtcgacatcggctgcctcgtcgtcagccgcaagctcttcgtctggaccgtcggggtgctcgtcgccgccgcagtgttcgcgggggtcgttgcggggatcgccaaggccatccccaggcgccaccatccaccgccaccgccggacgactacaccgtcgcgctgcacaaggcgcttatgttcttcaatgcccagagatcgggaaagcttccgaagcacaacaacgtaccatggcgtgggaactcgtgcatgaaggatggactctcggatccagcagtgcggcgaagccttgtgggcgggtactatgatgctggcgatg

SEQ ID NO: 47571 - protein, 167 aa, Panicum virgatum
  misc_feature: Ceres CLONE 2037398
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MSMYGRDPWGGPLEICHDSATDDDRSRNLDIDRGALSRTLDETQQSWLLAGPGDQGRKKKKYVDIGCLVVSRKLFVWTVGVLVAAAVFAGVVAGIAKAIPRRHHPPPPPDDYTVALHKALMFFNAQRSGKLPKHNNVPWRGNSCMKDGLSDPAVRRSLVGGYYDAGD

SEQ ID NO: 47572 - DNA, 703 bp, Panicum virgatum
  misc_feature: Ceres CLONE 2037400
  misc_feature: Encodes the peptide sequence at SEQ ID NO. 47573
acagagcaaacctcacctagctcgccttcgtcctgtgcgttccatcatggcagccgccgttctcgccgtgctggtggcctccctgcccgtcctcctcggaccggcggaggcggccaccgagttcgtgttccccggcttcgcgcgcgccaacgtgacgaccagcggcgcggccgtggtcaccgcctcgggcctcctgcggctcaccaacgagaccaacgaggtgttcgggcacggcttctaccccgcgcccttgcgcttcaaggacgcctccacgggcgcgccgctctccttctccaccaccttcgtcgtcgccatcctgccgcgctacccggacgcgcacggccacgggatcgccttcgcgctggcgccgtcgccgaccgtgccgggagccgtggcggggaagtacctcggcctcttcaacacgtcggacaacaggggccaggggaggagcgccgcggtcgtcgccgtcgagctcgacacggccaaggacgaggagttctccgacatcgacaacaaccacgtcggcatcgacatcaacggactagtgtccgtgaactcaacaccggcggcatacgtcgaccccggcaccgccagcctcgtcagcctcagcctggtcagtgggaattccctgcaggtgtggatcgagtacgacggcgccagcatgcgcctggaggtgacggtgtcgccggccggcaagcccagg

SEQ ID NO: 47573 - protein, 218 aa, Panicum virgatum
  misc_feature: Ceres CLONE 2037400
  misc_feature (22)..(217): Pfam Name: Lectin_legB Pfam Description: Legume lectin domain
MAAAVLAVLVASLPVLLGPAEAATEFVFPGFARANVTTSGAAVVTASGLLRLTNETNEVFGHGFYPAPLRFKDASTGAPLSFSTTFVVAILPRYPDAHGHGIAFALAPSPTVPGAVAGKYLGLFNTSDNRGQGRSAAVVAVELDTAKDEEFSDIDNNHVGIDINGLVSVNSTPAAYVDPGTASLVSLSLVSGNSLQVWIEYDGASMRLEVTVSPAGKP

SEQ ID NO: 47574 - DNA, 588 bp, Panicum virgatum
  misc_feature: Ceres CLONE 2037410
  misc_feature: Encodes the peptide sequence at SEQ ID NO. 47575
gcatcgatgattttgctgcaaagcgaggcattgagctacagtagctgactgaatcttggctgaattggtgatggcaggacatgggggccccaagaagagcgagccgtcggcgctggtggggtggttcgagaagaaggacgtcaaggcggagcgggtggtgtacacggcggacttcgccgtcgacgcctccttcggcgagcccggcgcggtgaccgtgctcaaccggcaccggcgggagttcttcatcgagagcatcgtggtcgagggcttcccctccggcccggcgcacttcacctgcaactcgtgggtccagcccgaccgcgccccgcgcgtgttcttcatcaacaggccgtacctgccggacgagacgccgccggggctccgggagctccggcggcaggagctcagcgacctcaggggcgagggcgccgccgccgccgcgggcggcgagcgcaggctcaccgaccgggtgtgggagtacgacgtgtacaacgacctcggcaaccccgacaagggcgccgagttcgcgcgccccgtcctcggcggcgaccggctgccgtacccgcgccggatgcggacgggccggcc

SEQ ID NO: 47575 - protein, 172 aa, Panicum virgatum
  misc_feature: Ceres CLONE 2037410
  misc_feature (5)..(90): Pfam Name: PLAT Pfam Description: PLAT/LH2 domain
  misc_feature: SWISSPROT Homolog: EC 1.13.11.12 Lipoxygenase
MAGHGGPKKSEPSALVGWFEKKDVKAERVVYTADFAVDASFGEPGAVTVLNRHRREFFIESIVVEGFPSGPAHFTCNSWVQPDRAPRVFFINRPYLPDETPPGLRELRRQELSDLRGEGAAAAAGGERRLTDRVWEYDVYNDLGNPDKGAEFARPVLGGDRLPYPRRMRTGR

SEQ ID NO: 47576 - DNA, 664 bp, Panicum virgatum
  misc_feature: Ceres CLONE 2037413
  misc_feature: Encodes the peptide sequence at SEQ ID NO. 47577
tttaagtcgaattctccagaaccatggaattggaacatatatttgttccccttatggtgcttgggtgtagtgataagatatggaatactctttccactgaggtacttgagagtgttaagattcttttccctgaccctgagtattatttgttattgaggtgattatgttagtctattcttatactctaaattctaacccgctctttctttaacacttgtgttgttcacttgttctgcagtagtttgtttattgtcaacataaattgggacatgcttgtacccaacaatactagagcacaacttttagttagccaaaataggattcaggtaggccctttgttgaacctactcagttcagaattctaaatatgtatttgggcctattccgccaccatcaccacccataaccttcagttttaagagaacaatgtaaaaaattgcatgatctacacctgctttcatagaccagattgaaaagaaaaaatttcttttgatctaaccatctcatcctcattcagaaccttgaaatgtaaatgttgtgttcaggatgccaagaaatcacatcataagccatcttttctgacagattgtctgcatcttctttagttgcttcagctgaaatcttattttctggaaattcggttcacctgtaaagctttgccaat

SEQ ID NO: 47577 - protein, 51 aa, Panicum virgatum
  misc_feature: Ceres CLONE 2037413
  misc_feature: The sequence is a functional homolog of SEQ ID NO 26 in US patent 7235714
FKSNSPEPWNWNIYLFPLWCLGVVIRYGILFPLRYLRVLRFFSLTLSIICY

SEQ ID NO: 47578 - DNA, 635 bp, Panicum virgatum
  misc_feature: Ceres CLONE 2037416
  misc_feature: Encodes the peptide sequence at SEQ ID NO. 47579
aaggcagagcatcgctcacgcacacttgccccgcccggcgtcgccccccctgccctgccttggccgccgcgagcgccgccgtacctgcgggggatcggaggccatggaggcgagcgccgggctggtggccgggtcgcacaaccggaacgagctggtgctgatccgggggcacgaggagcccaagccgctgcgcgcgctgagcgggcaggtgtgcgagatatgcggcgacgaggtcgggcgcacggtggacggcgacctcttcgtcgcctgcaacgagtgcggcttccccgtctgccgcccctgctacgagtacgagcgccgggagggcacgcagaactgcccccagtgcaagacccgctacaagcgcctcaaggggagcccgagggtggccggggacgacgacgaggaggacatcgacgacctggagcacgagttcaacatcgacgacgacaagcagcagcagcagcagcagctggtgcaggccggcggaatgcagaacagccagatcaccgaggcgatgctgcacggcaagatgagctacgggaggggccccgacgacggcgagggcaacaacacgccgcagatcccgcagatcatcaccggctcccgctccgtgccggtgagcggcgagttcc

SEQ ID NO: 47579 - protein, 177 aa, Panicum virgatum
  misc_feature: Ceres CLONE 2037416
  misc_feature: SWISSPROT Homolog: EC 2.4.1.12 Cellulose synthase (UDP-forming)
  misc_feature: Functional homolog of the protein sequence given in SEQ ID NO 51500
  misc_feature: Useful for making plants with altered cell wall content and/or composition
  misc_feature: Useful for making plants with modulated biomass
  misc_feature: The sequence is a functional homolog of SEQ ID NO 26 in US patent 7312377
MEASAGLVAGSHNRNELVLIRGHEEPKPLRALSGQVCEICGDEVGRTVDGDLFVACNECGFPVCRPCYEYERREGTQNCPQCKTRYKRLKGSPRVAGDDDEEDIDDLEHEFNIDDDKQQQQQQLVQAGGMQNSQITEAMLHGKMSYGRGPDDGEGNNTPQIPQIITGSRSVPVSGEF

SEQ ID NO: 47580 - DNA, 653 bp, Panicum virgatum
  misc_feature: Ceres CLONE 2037424
  misc_feature: Encodes the peptide sequence at SEQ ID NO. 47581
tggcatcctaagaaaggacggagacactcgatcggttcgatcgatcactcgtgtgaacctgatcccagtggcagcctgctgcagagccctagctagctcgctcgctcctggaggtggaagctagctagtagtcttgagcaagagaagctaagacgatggcctctgctaccctgctcaagtcctccttccttcccaagaagtccgaatggggcgccagcaggcaggtcgccgcgcccaggccggtcaccgtgtccatggtcgtcgtccgcgccagcgcctacgccgatgagctcgtcaagacggcgaaaacggtggcgtcgccggggcggggcatcctggccatggacgagtcgaacgcgacgtgcgggaagcggctggcgtccatcgggctggagaacacggaggcgaaccggcaggcgtaccggacgctgctggtgaccgcgccggggctcgggcagtacatctcgggcgccatcctcttcgaggagacgctgtaccagtcggccgtggacgggcgcaagatcgtggacatcctggcggagcagggcatcgtgcccgggatcaaggtcgacaagggcctcgtcccgctcgccggctccaacaacgagtcgtggtgccaggggctcgacggcctcgccgcccgcgaggccgcc

SEQ ID NO: 47581 - protein, 165 aa, Panicum virgatum
  misc_feature: Ceres CLONE 2037424
  misc_feature (45)..(165): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Functional homolog of the protein sequence given in SEQ ID NO 50217
  misc_feature: Useful for making plants with modulated biomass
  misc_feature: Functional homolog of the protein sequence given in SEQ ID NO 50216
  misc_feature: Useful for making plants with modulated phosphate use efficiency
MASATLLKSSFLPKKSEWGASRQVAAPRPVTVSMVVVRASAYADELVKTAKTVASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLAAREA

SEQ ID NO: 47582 - DNA, 630 bp, Panicum virgatum
  misc_feature: Ceres CLONE 2037427
  misc_feature: Encodes the peptide sequence at SEQ ID NO. 47583
ccatcgaagattgtcacacgccaacgcatctccctccactccgctcccactcccccgccaccgccaccgccaccgccatggccgccgccgccgccgtgcactccctcctgcacccaccggcggcccgcaagggccccgcgccctcgccgctctcccctccctccccaccccacttcctccgcctcccggccgcgcacccccgcctaccccacctccaccgcctctgcgccgcctccccggccgccgcctccgacctcactgccttccccaacccgagcggcaacctcgcgcccattgacgtggacgccgccacggaggccgagcggcgggagaacgggttccggagcacgcgccgcaccaagctcgtctgcaccgtgggcccggccacctcgtccccggagcagctcgaggcgctcgccgtcggcgggatgaacgtggcccgcgtcaacatgtgccacggggaccgggagtggcaccggggcgtcatccgcgccgtgcggaggctcaacgaggagaagggcttcgccgtcgccgtcatgatggacaccgagggcagcgagatccacatgggggacctcggcggcgcggcctcggccaaggcggaagatggagaagtctggacatttagcg

SEQ ID NO: 47583 - protein, 184 aa, Panicum virgatum
  misc_feature: Ceres CLONE 2037427
  misc_feature: SWISSPROT Homolog: EC 2.7.1.40 Pyruvate kinase
MAAAAAVHSLLHPPAARKGPAPSPLSPPSPPHFLRLPAAHPRLPHLHRLCAASPAAASDLTAFPNPSGNLAPIDVDAATEAERRENGFRSTRRTKLVCTVGPATSSPEQLEALAVGGMNVARVNMCHGDREWHRGVIRAVRRLNEEKGFAVAVMMDTEGSEIHMGDLGGAASAKAEDGEVWTFS

SEQ ID NO: 47584 - DNA, 705 bp, Panicum virgatum
  misc_feature: Ceres CLONE 2037471
  misc_feature: Encodes the peptide sequence at SEQ ID NO. 47585
aggttacctggcaccgcagccattgcagagcacagaaccaaccgcggcggcgaacgcgagctgtagacagatgaggagtccgctgcagtcgctcaggaccgtgctcctgctcctcccgctgctcctcgcgctccggccgccggcagcggacgcgctgtcgccggacgggctggcgctgctggccttcaagtcggcggtgacggacgacccgtccgccgcgctctcctcatggtccggcgccgacgccgacccctgccgctgggtgggcgtcacttgcgccaacacctcatcgggcggcccgcgcgtcgtcgggctggccgtcgcggggaagaacctctccggccacgtggcccccgagctcggctccctcccgctcctccgccggctcaacctccacgggaaccgcctcacgggcgccgtcccgcccgcgctcgccaacgccacctccctccgctccctcttcctctacgacaaccgcctcgcgggcccgctccccgccgcggcgctgtgcgcgctccccaggctgcagaacctcgacctgtcccggaacgcgctcgacggcgcgctgccggcggagctcgcccggtgcggccagctggagcggctgctgctcgccgagaacgcgctgtcgggcgggatacaggcgggggtgtggcgcgggatgccgcggctgcagatgctggacctgtcgtccaccacctctcc

SEQ ID NO: 47585 - protein, 211 aa, Panicum virgatum
  misc_feature: Ceres CLONE 2037471
  misc_feature (29)..(70): Pfam Name: LRRNT_2 Pfam Description: Leucine rich repeat N-terminal domain
  misc_feature: SWISSPROT Homolog: EC 2.7.11.1 Non-specific serine/threonine protein kinase
MRSPLQSLRTVLLLLPLLLALRPPAADALSPDGLALLAFKSAVTDDPSAALSSWSGADADPCRWVGVTCANTSSGGPRVVGLAVAGKNLSGHVAPELGSLPLLRRLNLHGNRLTGAVPPALANATSLRSLFLYDNRLAGPLPAAALCALPRLQNLDLSRNALDGALPAELARCGQLERLLLAENALSGGIQAGVWRGMPRLQMLDLSSTTS

SEQ ID NO: 47586 - DNA, 664 bp, Panicum virgatum
  misc_feature: Ceres CLONE 2037488
  misc_feature: Encodes the peptide sequence at SEQ ID NO. 47587
accattggtgcggcgcggtgctgccacgaggccccgcgacaaatcctacccccgacggcatctccggcgcttcgccccccatccccttccagcatccatcccccctcacacaaattgcccccctccctccctcctccctcttgtttaccgctgccggccactgccgccaccaccagcagcaccagcaccgccccaccgcgcgctcgcagctgccaggggtgctaggtagccagccggagccgccgctgccgccgcgcccatggcctccgtggcggccacctccacgctggccccggccctcgccgctcgacggcgccgggagcggccagggatggggccgctgccgctgccgctgccgctgccgcagcgccgggccgcggtcgtgcggtgctcgctcgaaagcaacgtctccgacatgggcgtcaacgctcccaaaggattgttcccacctgagccggagcactacagggggcccaagctcaaggtggccatcataggtgcaggactcgcaggcatgtccactgccgttgagcttttggaccagggacatgaggttgatttgtacgagtcccggccgtttattggcggcaaggttggctcatttgtcgataggcaaggaaaccatatcgagatggggctgcacgtgttcttcgggtgttacagc

SEQ ID NO: 47587 - protein, 134 aa, Panicum virgatum
  misc_feature: Ceres CLONE 2037488
  misc_feature: SWISSPROT Homolog: EC 1.14.99.30 Carotene 7,8-desaturase
  misc_feature: Functional homolog of the protein sequence given in SEQ ID NO 51156
  misc_feature: Useful for making plants with modulated biomass
  misc_feature: Useful for making plants with modulated flowering time
MASVAATSTLAPALAARRRRERPGMGPLPLPLPLPQRRAAVVRCSLESNVSDMGVNAPKGLFPPEPEHYRGPKLKVAIIGAGLAGMSTAVELLDQGHEVDLYESRPFIGGKVGSFVDRQGNHIEMGLHVFFGCY

SEQ ID NO: 47588 - DNA, 709 bp, Panicum virgatum
  misc_feature: Ceres CLONE 2037490
  misc_feature: Encodes the peptide sequence at SEQ ID NO. 47589
tttagctcctcgcctcctgtagcaaggctagtgaagacttcagagcataaaaatggttactaacatacgtgtgatacttggaattataggatgtgcagtctgtatgcttctctattcagcaccaacattgacatttaaaagagtaatcaaggaggctagtgtaggcgaattctcatgcataccgtatatcctgactctgttcagctgcctcacatatagctggtatggttttccaattgttagctctgggtggaaaaacttgacagttttcctcatcagctcaataggagtaatctttgaaatatcattcatcggcatatacctatggtttgcaccaagagagaaaaaggtaagtcgtttctaaagaactcaatattgttccttaaggtagctggatgctaatctctgtcaggcttctctagtcatttccactatcatacttgatatggtaagctcaaatcagtaggacatcagcagatctaaactgtaaaaagacgaagcaaatgggttcaccccccaccccactcaaaaaaaactatacagtacaaaattccgcatactgccacacaatatgccagtatacagttcagctcaaacttcaaaagcaatcaattccttcatgcagcgccatgtaagcaattattgaggccatgatgcgatttcctcatcttcatgttcaattagccctgctaaaatggatgtcatgttg

SEQ ID NO: 47589 - protein, 103 aa, Panicum virgatum
  misc_feature: Ceres CLONE 2037490
  misc_feature (7)..(98): Pfam Name: MtN3_slv Pfam Description: MtN3/saliva family
MVTNIRVILGIIGCAVCMLLYSAPTLTFKRVIKEASVGEFSCIPYILTLFSCLTYSWYGFPIVSSGWKNLTVFLISSIGVIFEISFIGIYLWFAPREKKVSRF

SEQ ID NO: 47590 - DNA, 636 bp, Panicum virgatum
  misc_feature: Ceres CLONE 2037521
  misc_feature: Encodes the peptide sequence at SEQ ID NO. 47591
ctctctcctgcgccaactcctctttcctccaatcccaggcgaattcctcgccccccccccccaaccccctcctccagcgcgtgccggagcttcgtcttccccgaccctcccgccctgattcgccgctccgcgctccccccttccgccggaaagggggggaactcatggggaggctagtggctctggggttgggggtgggggtgggggtcctcgtcgtcgcccggggggaggcggagccacggtgcgcgcggggcggccggagcgcgcctccgcggccgcacagcgtgacgatcaccgagttcgtggccatcggcgacggcgtcaccctcaacacggtgcccttccagaacgccgttttctacgtgcggtccttcgccgacaagggtggcgcgcagctgtacgtgcccaagggactgtggctcaccggcagcttcaatctcaccagccacctcaccctcttcctggagagtggcgccgtcatcgtcggcacacaggaggtttcacaatggcctgttgcggaacctttgccatcatatggacggggaatggatcttccaggtccgagtcatcgtagcttaataaatgggcagaatctaattgatgttgtaataactgggaataatggaattattgatg

SEQ ID NO: 47591 - protein, 157 aa, Panicum virgatum
  misc_feature: Ceres CLONE 2037521
  misc_feature: SWISSPROT Homolog: EC 3.2.1.82 Exo-poly-alpha-galacturonosidase
  misc_feature: Functional homolog of the protein sequence given in SEQ ID NO 51645
  misc_feature: Useful for making plants with altered cell wall content and/or composition
  misc_feature: Functional homolog of the protein sequence given in SEQ ID NO 50944
  misc_feature: Useful for making plants with altered carbohydrate content
MGRLVALGLGVGVGVLVVARGEAEPRCARGGRSAPPRPHSVTITEFVAIGDGVTLNTVPFQNAVFYVRSFADKGGAQLYVPKGLWLTGSFNLTSHLTLFLESGAVIVGTQEVSQWPVAEPLPSYGRGMDLPGPSHRSLINGQNLIDVVITGNNGIID

SEQ ID NO: 47592 - DNA, 697 bp, Panicum virgatum
  misc_feature: Ceres CLONE 2037528
  misc_feature: Encodes the peptide sequence at SEQ ID NO. 47593
atccaaaaatatttactccctctttctctctccctgtctgctcccctttctcctcccctcgccgtcagggagcttcgccgctgccgccgccgccgcagctccgtctcttcgccgcggcagtcggccgccgcggacgcagctgtgactttagacaattgttggaacatcaagtgccgatggctggtgccgacataattgatgattctgctgcgagcagcagtgggttgggtgatgaggatcgcggtgtctctggtgattcgctttctgtgtggcgatcctgcgagcagcttgataatgggatcccatcaacttcccctcccttttgggacaccgatggtgatgatgatgatcctgggaccagacctttggatttatttgggcaatatacttggagaatagaaaacttttcaaaggagaagaagagagaaatgaaaagcgaaccttttgaagctggtggttacaagtggtatattctagtttaccctcaaggatgtgatgtctccaaccacttgtcattgtttctttgtgttgctaatcatgaaaaactcctcccaggatggagccattctgcacaatttactatagccgtgggcaatcttgatccaaaaaaaaataaatattcagacaccttacacagattctggaagaaggaacatgattgggggatggaaaaagtttatggagttgtcaaagattc

SEQ ID NO: 47593 - protein, 173 aa, Panicum virgatum
  misc_feature: Ceres CLONE 2037528
  misc_feature (74)..(173): Pfam Name: MATH Pfam Description: MATH domain
  misc_feature: SWISSPROT Homolog: EC 3.1.2.15 Ubiquitin thiolesterase
MAGADIIDDSAASSSGLGDEDRGVSGDSLSVWRSCEQLDNGIPSTSPPFWDTDGDDDDPGTRPLDLFGQYTWRIENFSKEKKREMKSEPFEAGGYKWYILVYPQGCDVSNHLSLFLCVANHEKLLPGWSHSAQFTIAVGNLDPKKNKYSDTLHRFWKKEHDWGMEKVYGVVKD

SEQ ID NO: 47594 - DNA, 674 bp, Panicum virgatum
  misc_feature: Ceres CLONE 2037569
  misc_feature: Encodes the peptide sequence at SEQ ID NO. 47595
aattcccttcgcttctcgatttcacagcctttgcagccgagttgaatcgtttggttcaaaatctcccttcccattcctctttctctctctctctctctctctctctctctctctctctcagccttgttggttggtttggttggtcttggttggttttcgcccctgatccaaaggcaagagccatggcgctgacgctgcgatccaccacgtcgttcctgtcgcccgtcgaccccatctccaagctcctccacaagcccggcgccgacgacgcgccgccgagctgcgccgccgtgccgtccccgccccacgccgccgcgccgagccgcaggctgcgcctcgtcagggcggccgccgcggcggcgggccgcgcgccggccggggccgccgagctgctgcacgccggcggcgcgggccaggagcacgggcgcgcgcgccgcggggtccccgtctacgtgatgctgccgctggacacggtggggcccggcggccagctgtcgcggcagcgcgcggtggcggcgagtctgatggcgctgcggggcgccggggtggagggcgtcatggtggacgtctggtggggcgtcgtcgagcgggagggccccggccgctacgactgggaggcctacgccgagctggtgcgcatggtggagcgcgccggcctggcggctcaggccgtc

SEQ ID NO: 47595 - protein, 163 aa, Panicum virgatum
  misc_feature: Ceres CLONE 2037569
  misc_feature: SWISSPROT Homolog: EC 3.2.1.2 Beta-amylase
MALTLRSTTSFLSPVDPISKLLHKPGADDAPPSCAAVPSPPHAAAPSRRLRLVRAAAAAAGRAPAGAAELLHAGGAGQEHGRARRGVPVYVMLPLDTVGPGGQLSRQRAVAASLMALRGAGVEGVMVDVWWGVVEREGPGRYDWEAYAELVRMVERAGLAAQA

SEQ ID NO: 47596 - DNA, 680 bp, Panicum virgatum
  misc_feature: Ceres CLONE 2037576
  misc_feature: Encodes the peptide sequence at SEQ ID NO. 47597
ctctccccatctccggctctccgctacctttcccttccctccccctcgcgctcctccacctcctccccccttcaccgcggctcggcaagcaacagctccccactgacccgccgccgccgccgccacacctcccaccaccatggcgtcgggcggccgcgctctcgccccgaggccatgactcggcgccgcccgtggccgtggctctccgtctcctccctctccctgcgacgacaacccctcccgttcctcctcctcctcctggggcggcggtagatggcggcggcgatggtggtagtcgggggcggcaaggaccgctcctcgcctggcggcggcggggcgccgcaggtggacacgggcaagtacgtgcgctacacccccgagcaggtcgaggcgctcgagcgggtctacagcgagtgccccaagcccagctcgctgcgccggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcgatgaacaagctgttgatggaggagaatgacaggctgcagaagcaggtgtcccgtcttgtttacgagaatgggtacatgcggcagcagctccataatcc

SEQ ID NO: 47597 - protein, 135 aa, Panicum virgatum
  misc_feature: Ceres CLONE 2037576
  misc_feature (29)..(87): Pfam Name: Homeobox Pfam Description: Homeobox domain
  misc_feature: Functional homolog of the protein sequence given in SEQ ID NO 50330
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
MAAAMVVVGGGKDRSSPGGGGAPQVDTGKYVRYTPEQVEALERVYSECPKPSSLRRQQLIRECPILSNIEPKQIKVWFQNRRCREKQRKEASRLQTVNRKLTAMNKLLMEENDRLQKQVSRLVYENGYMRQQLHN

SEQ ID NO: 47598 - DNA, 644 bp, Panicum virgatum
  misc_feature: Ceres CLONE 2037623
  misc_feature: Encodes the peptide sequence at SEQ ID NO. 47599
atacctcgtatcagctcaggcctcccacgctcgctccgacacctcggccgtcacgtcggagctgcgccgcaaaccagccgaaaatggcgaccgccagcgacggagacaagggggcggcagcgccgccgcagcttgagtcgtttctggccatcgggttggaccagcgcacggcggagaacgccctcgccaatcgcaaggtcacagccaacctcaccgccgtcatcgccgaggctggtgttactgggtgcgacaaatctgtggggaatctcctctacactgttgcgacgaagtacccggcaaatgcactagtgcaccgccccaatctcattaagtacattctgtcagaaaagatcaagaactctgcgcaattggatgctgcactgtcgtttctttctaccttgggtcctgattccttggatccggtgaagtttgaagaggcttgtggtgtgggggtagttgtttcatttgaagagattcagttggcagtctctgatgttctaaatgaaaatatggaagccatagtggaacagcgatatcgtataaatgttggtagcttatgtggacaagttaggaagaggcacccctggggtgatgctaagttggtcaaggaggaaattgagaaaaggcttgtggagattttaggt

SEQ ID NO: 47599 - protein, 186 aa, Panicum virgatum
  misc_feature: Ceres CLONE 2037623
  misc_feature (11)..(172): Pfam Name: tRNA_synt_1c_R1 Pfam Description: Glutaminyl-tRNA synthetase, non-specific RNA binding region part 1
  misc_feature: SWISSPROT Homolog: EC 6.1.1.18 Glutamine--tRNA ligase
MATASDGDKGAAAPPQLESFLAIGLDQRTAENALANRKVTANLTAVIAEAGVTGCDKSVGNLLYTVATKYPANALVHRPNLIKYILSEKIKNSAQLDAALSFLSTLGPDSLDPVKFEEACGVGVVVSFEEIQLAVSDVLNENMEAIVEQRYRINVGSLCGQVRKRHPWGDAKLVKEEIEKRLVEIL

SEQ ID NO: 47600 - DNA, 592 bp, Panicum virgatum
  misc_feature: Ceres CLONE 2037634
  misc_feature: Encodes the peptide sequence at SEQ ID NO. 47601
ttctcctgcaccgcaacggcacaacaagaaccaccaccaccacctccatcactctccagtcctcccccaccccgtccactgagccaccgctactgctgctgctgctgctgcgagctcggctgcagctcctctacctcctccggccccccgccctctctcctcccagcagccttgcacttgcagcgacttgctaacagtgcgctccccgggcagaatgaccaaagatgaggagttcaagctggtcaagatccagaaccatgtgctgagggtgaacatacactgcgacgggtgcaagcacaaggtcaagaagctgcttcagaagattgaaggcgtgtactcggtggccatcgatgtggacaaccacaaggtctcggtgacgggggacgtggacgccgagaccttgatccggaagctcaccaggggtggcaagcacgccgagctgtggtcacagcacaagggcggcggcaaccagggccacaagggcaataaccagcagaagcagcagcagaaccaccaccagcaccagcagcatcagcagcagcagaagcaaggtgccaatctgagcaaggatggccacaacaacaagaacaac

SEQ ID NO: 47601 - protein, 125 aa, Panicum virgatum
  misc_feature: Ceres CLONE 2037634
  misc_feature (16)..(76): Pfam Name: HMA Pfam Description: Heavy-metal-associated domain
MTKDEEFKLVKIQNHVLRVNIHCDGCKHKVKKLLQKIEGVYSVAIDVDNHKVSVTGDVDAETLIRKLTRGGKHAELWSQHKGGGNQGHKGNNQQKQQQNHHQHQQHQQQQKQGANLSKDGHNNKN

SEQ ID NO: 47602 - DNA, 678 bp, Panicum virgatum
  misc_feature: Ceres CLONE 2037635
  misc_feature: Encodes the peptide sequence at SEQ ID NO. 47603
aaaaggccaaagccaccaaccgaagtctgtgtgccaccgccgccgctccgatggaaaccgccgcgccggcgcgcgtccaggccctcgccgagaccggcgtgtcccgcctcccggcgcagtacatccagccgcccgagcaccgcccggcccacccatcgtcctcccccgtccccgccgcgctctccgtcccggtggtcgacctctcgtcccccaccgcggccgacgccgtccgcgccgcgtgcgcggactggggcgccttccacgtgctcgggcacggcgtgcccggggagctcctcgacgcggtgcgcggggccgggctcgccttcttccgcgcgcccatggaggacaagctccggttcgcgtgcgacccggccaggggcgccgccgcggaggggtacggcagccgcatgctcgccaacgacgactccgtgctcgactggcgcgactacttcgatcaccacacgctcccggagtcccgccgtgaccccgcccactggcccgatttcgtccccggatacaggtaattggcctgttcaacaataggaaaaatcttctctaccagttcaggcgttcagctcatctctggatgattctggtaagattacagttctgttcatacatgaatgagaaggtagagttcataaatcataagcataagagatgtaggaattttttgtc

SEQ ID NO: 47603 - protein, 157 aa, Panicum virgatum
  misc_feature: Ceres CLONE 2037635
  misc_feature: SWISSPROT Homolog: EC 1.14.11.19 Leucocyanidin oxygenase
METAAPARVQALAETGVSRLPAQYIQPPEHRPAHPSSSPVPAALSVPVVDLSSPTAADAVRAACADWGAFHVLGHGVPGELLDAVRGAGLAFFRAPMEDKLRFACDPARGAAAEGYGSRMLANDDSVLDWRDYFDHHTLPESRRDPAHWPDFVPGYR

SEQ ID NO: 47604 - DNA, 738 bp, Panicum virgatum
  misc_feature: Ceres CLONE 2037647
  misc_feature: Encodes the peptide sequence at SEQ ID NO. 47605
ccagcttctcccaagcgcgcgccgcccctcaccgccggcttctgcccctcctcctctgccccctcccctgccgccgccccgcagttagagacgctcgcctcgccggagatcatgtaccgcgccgcggggagccacctccgctccctcaagcatcatggtgctaccaggcttgctagtacaagtgttgtgaagcagtcccaaggtggtctttttggctggcttcttgggggaaaatcaagccaacttcctcccctagatgttccgttaacaggcattactattcccccacctctaccagactacgttgaaccatctaagacaaaaatcactactcttccaaatggcgtcaagattgcctcggaaacgtcaccgagcccagcagtctcagtgggtctgtacattgactgtggttccatttatgaaacacccgtttcatctggagtctcccatctattggagagaatggccttcaagagcacagtaaatcgaagtcacttacggctagttcgtgaggtagaagccattggaggaaatgtctccgcatcagcttcccgtgagcaaatgagctatacctatgatgcattgaagaactatacaccagaaatggttgaagttctcattgacagtgtgaggaatccagcatttctcgaatgggaggtcaaagagcagcttcagaagatcaaatctgaaatatctgaagtgtctgctaatcctcaaggtctacttctgggagcactt

SEQ ID NO: 47605 - protein, 208 aa, Panicum virgatum
  misc_feature: Ceres CLONE 2037647
  misc_feature (80)..(208): Pfam Name: Peptidase_M16 Pfam Description: Insulinase (Peptidase family M16)
  misc_feature: SWISSPROT Homolog: EC 3.4.24.64 Mitochondrial processing peptidase
MYRAAGSHLRSLKHHGATRLASTSVVKQSQGGLFGWLLGGKSSQLPPLDVPLTGITIPPPLPDYVEPSKTKITTLPNGVKIASETSPSPAVSVGLYIDCGSIYETPVSSGVSHLLERMAFKSTVNRSHLRLVREVEAIGGNVSASASREQMSYTYDALKNYTPEMVEVLIDSVRNPAFLEWEVKEQLQKIKSEISEVSANPQGLLLGA

SEQ ID NO: 47606 - DNA, 667 bp, Panicum virgatum
  misc_feature: Ceres CLONE 2037690
  misc_feature: Encodes the peptide sequence at SEQ ID NO. 47607
agaaatccccaagcaaaaccctcgtcttctcgtctccccctccctcggcggcggccgccatggcgaaccagaatccgtcgccattcgtgcacatcgacgcccgcagcgcggccggcgcgctgagccgcggccaggacccgcacgcactggagcggggcaccagggctgtcctctactacctctacacctccctccccgacctacccgtctccgcctccgcctgcctatccgccctcccggcctccccctccgctgatggtaccgaccgcatcagcgccctccccggcgccgtcctccgcgaaatcgtgtcccgcctccctgtcaaggacgcggcgcgcaccgcggtgctctccaagcgctggctcccgatctggcgcggcaccccgctcgtcctcgacgacaccaacctccgcccgcgcgccttggtgggccgggcacccacacgcgccgactcgccggccctcaccgccgccatcacccgcgtcctcgccgcgcacccggggcccttccgtgcggtctacctcgtccgcagctacatggacgcgcaccagcagcagctcgcgcactggctccggctgctcgccgccaagggggtggaggagctcgtcctcgtcaaccgcccgtggcccatcgacatgcccctccccggtacgattctcaacatcgc

SEQ ID NO: 47607 - protein, 202 aa, Panicum virgatum
  misc_feature: Ceres CLONE 2037690
  misc_feature (69)..(116): Pfam Name: F-box Pfam Description: F-box domain
MANQNPSPFVHIDARSAAGALSRGQDPHALERGTRAVLYYLYTSLPDLPVSASACLSALPASPSADGTDRISALPGAVLREIVSRLPVKDAARTAVLSKRWLPIWRGTPLVLDDTNLRPRALVGRAPTRADSPALTAAITRVLAAHPGPFRAVYLVRSYMDAHQQQLAHWLRLLAAKGVEELVLVNRPWPIDMPLPGTILNI

SEQ ID NO: 47608 - DNA, 702 bp, Panicum virgatum
  misc_feature: Ceres CLONE 2037693
  misc_feature: Encodes the peptide sequence at SEQ ID NO. 47609
aggcttgcatcatattgagttttgtctaccaggcttcttcaggccaacaagctaagtgtccaagaaactcactctatatgctgccccttcttctgctgatactgttgttgagccgtcacgcacggggaggcggcctctcgtcgccgttggacgatgcccagttcgcctaccaaggcttcgccggcgctaacctcacgctggacggcctcgccgccgtcctccccggcggcctcctcgcgctcaccaacttcacgttccagaccaaagcccacgccttccacccggtcccgatccgcttcctcgacaagcagcagccggcggcggcgacgaacgccaccgctgccgcggtgcgctccttctccacgtccttcgtgttcgccatcgtgtctcggtacgacggcctgagcgaccacgggcttgccttcgtcgtcgccccgaccacggacttcgcggcggccaacgccgggcagtacctgggcctgctcaacgcgaccaacggcacggcgggccgccccatcctcgcggtcgagctggacaccatcctgacccccgagttccgcgacatcaacagcaaccacgtcggcatcgacgtcaacagcctcgtgtcgcggcaggcccgcccggccggctactacgacgacgacgacgccgccgccggcgcgttccggaacctgagcctgaacagccgcaagccgatgcagg

SEQ ID NO: 47609 - protein, 208 aa, Panicum virgatum
  misc_feature: Ceres CLONE 2037693
  misc_feature (25)..(208): Pfam Name: Lectin_legB Pfam Description: Legume lectin domain
MLPLLLLILLLSRHARGGGLSSPLDDAQFAYQGFAGANLTLDGLAAVLPGGLLALTNFTFQTKAHAFHPVPIRFLDKQQPAAATNATAAAVRSFSTSFVFAIVSRYDGLSDHGLAFVVAPTTDFAAANAGQYLGLLNATNGTAGRPILAVELDTILTPEFRDINSNHVGIDVNSLVSRQARPAGYYDDDDAAAGAFRNLSLNSRKPMQ

SEQ ID NO: 47610 - DNA, 663 bp, Panicum virgatum
  misc_feature: Ceres CLONE 2037694
  misc_feature: Encodes the peptide sequence at SEQ ID NO. 47611
acgcgggatgccgctgctatttatgccgcccgtggacgcggtgaaagctccctgaggccgcgcgcagccagccggtgcttgcttctctgtcgccaccacttccgttccatccctgctccgtttctcgcgcgcccaggggagaaaggaggatcctgctctcgtctcgcggaatggcagcgtcccgggcacggctcagccgtgcggcggcggtgctgagcttcctcctgctgacggcggcagctgaggccgggccggcggatgtggagatggtgttcctgaagaacgcggtggccaaaggagcagtgtgcttggatgggagcctcccggtctaccacttctcgcccggctctggctctggcgccaacaactgggtggttcacatggagggaggagggtggtgcaggaatcctgatgagtgtgctgtcaggaagggcaacttcaggggctcctcgaagttcatgaggccgctctcgttttcagggatattaggcggcagccagaaatccaaccctgatttctacaattggaatagagtgaaggtcagatactgcgatggttcatcatttactggtgacgttgaggctgtggaatccgggaaaaacctctattacagaggtttcagagtttggcgcgccatcatggatgatctacttactgtgagag

SEQ ID NO: 47611 - protein, 164 aa, Panicum virgatum
  misc_feature: Ceres CLONE 2037694
  misc_feature (15)..(164): Pfam Name: PAE Pfam Description: Pectinacetylesterase
  misc_feature: Functional homolog of the protein sequence given in SEQ ID NO 51739
  misc_feature: Useful for making plants with altered cell wall content and/or composition
  misc_feature: Functional homolog of the protein sequence given in SEQ ID NO 50692
  misc_feature: Useful for making plants with altered carbohydrate content
MAASRARLSRAAAVLSFLLLTAAAEAGPADVEMVFLKNAVAKGAVCLDGSLPVYHFSPGSGSGANNWVVHMEGGGWCRNPDECAVRKGNFRGSSKFMRPLSFSGILGGSQKSNPDFYNWNRVKVRYCDGSSFTGDVEAVESGKNLYYRGFRVWRAIMDDLLTVR

SEQ ID NO: 47612 - DNA, 658 bp, Panicum virgatum
  misc_feature: Ceres CLONE 2037698
  misc_feature: Encodes the peptide sequence at SEQ ID NO. 47613
acggagcagcctcgacaagtagacattgtggggagggggggcgagatgaggcatggccgcagtgtgctagtgtggctggtgctcgtgtgctcatgcttcgaagaacctctagttcaggctcagcgaccagcaagagccgatccaatcgaagcggcggcgctgaacgcgatcctggggagatggggccagagcgcggcgcggtcgccggcgtggaagtggaacatcagcggcgagccctgcagcggcgccgccgtcgacggcaccgggctcgacggcaacaacggcttcaacccgggcatcacgtgcgcctgctcctccgacgacgacaacagcaccgtctgccacatcaccatgctgaaggtatacgccctgaacattgtcggccagataccgtcagagctgcagaacctcacctatctaacttacctgaacctggatctgaattacttgacaggtcccattccagcattcattgggcaattttctgcaatgcaacacctgagcctgggatttaatccattatctggaccacttccaaaggaacttgggaatctcacgaatctcaacttgctaggcatcagtttggacactttcagcggtggacttcctgaagaactgggcaatctgtccaaacttgagcaactgtacattgatagca

SEQ ID NO: 47613 - protein, 204 aa, Panicum virgatum
  misc_feature: Ceres CLONE 2037698
  misc_feature: SWISSPROT Homolog: EC 2.7.11.1 Non-specific serine/threonine protein kinase
MRHGRSVLVWLVLVCSCFEEPLVQAQRPARADPIEAAALNAILGRWGQSAARSPAWKWNISGEPCSGAAVDGTGLDGNNGFNPGITCACSSDDDNSTVCHITMLKVYALNIVGQIPSELQNLTYLTYLNLDLNYLTGPIPAFIGQFSAMQHLSLGFNPLSGPLPKELGNLTNLNLLGISLDTFSGGLPEELGNLSKLEQLYIDS

SEQ ID NO: 47614 - DNA, 561 bp, Panicum virgatum
  misc_feature: Ceres CLONE 2037721
  misc_feature: Encodes the peptide sequence at SEQ ID NO. 47615
agacactgtcatctccaaacactcgcgagccccttcgtgattcctcctcctcccgtccctccctctccctcctccaagatcactgctggtccgcggaggctgctcgcgcgcttagttaagaggagagagagaggaggccggtggagatggtggggaggcagcacgcggcaggggggtcgcggtggcgaggcggcggtggcgccgcggcggcgtggtggtgggtggccgtggtcctgggccatttagtggcgcccgcgcgggcggggctcctcgagaccaacccgggcctggcctacaacttctaccagaagagctgccccagcgtggactccatcgtccgcagcgtcacttgggcgcaggtcgccgccaaccccgcgctccccgcccgcctcctccgcctccacttccacgactgcttcgtcaaggtccgtgccgcccctccctcctcctccctcaatcgttcgtccatccattatccttctgccccctcgcctccccaatcatgcccgtcagccagccgtcggtgcggtaggagaatcgtttctagttggttcgcctgtg

SEQ ID NO: 47615 - protein, 138 aa, Panicum virgatum
  misc_feature: Ceres CLONE 2037721
  misc_feature: SWISSPROT Homolog: EC 1.11.1.7 Peroxidase
MVGRQHAAGGSRWRGGGGAAAAWWWVAVVLGHLVAPARAGLLETNPGLAYNFYQKSCPSVDSIVRSVTWAQVAANPALPARLLRLHFHDCFVKVRAAPPSSSLNRSSIHYPSAPSPPQSCPSASRRCGRRIVSSWFAC

SEQ ID NO: 47616 - DNA, 685 bp, Panicum virgatum
  misc_feature: Ceres CLONE 2037735
  misc_feature: Encodes the peptide sequence at SEQ ID NO. 47617
aggctactcccaaaccagctgaactagcagacggtgagagtgcgacacacaacttttactgcgacgccggcatggccgctcctcaagcttcccgcatgcaccaccaccactcccgggctcttcctcgccgcgcgccggtctgcttgtcggtactcatcgcactggcggcctccgccacggtggtgagcgcgcagctgtcgtcggaggactactacgacgcgtcctgccccgccgccctcctcaccatcaggtccgccgtggcgacggcggtgctgctcgaccgccgcatgggggcctccctcctccgcctccacttccacgactgcttcgtgcagggctgcgacgcgtcggtgctgctggacgacgacgcggcggcgggcttcaccggcgagaagggggcggggcccaacgcggggtcgctgcgcggcttcgacgtcatcgacaacatcaagacgctgctggagctgctgtgcccgcagaccgtctcctgcgccgacatcctcgccgtcgccgcccgcgactccgtcgagcagctgggaggcccatcctggacggttcccctgggcaggcgggacgcgaccacggcgagcgcgttcctggccaacagcgacctccctggacccaccgccaacctcaacggcctcctcaacgctttccccaacaagggttcagcaccaccgacatg

SEQ ID NO: 47617 - protein, 204 aa, Panicum virgatum
  misc_feature: Ceres CLONE 2037735
  misc_feature (59)..(204): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 50996
  misc_feature: Useful for making plants with altered carbohydrate content
  misc_feature: Functional homolog of the protein sequence given in SEQ ID NO 50229
  misc_feature: Useful for making plants with altered cell wall content and/or composition
  misc_feature: Functional homolog of the protein sequence given in SEQ ID NO 51034
  misc_feature: Useful for making plants with modulated nitrogen use efficiency
  misc_feature: Functional homolog of the protein sequence given in SEQ ID NO 51417
  misc_feature: Useful for making plants with modulated oxidative stress sensitivity
MAAPQASRMHHHHSRALPRRAPVCLSVLIALAASATVVSAQLSSEDYYDASCPAALLTIRSAVATAVLLDRRMGASLLRLHFHDCFVQGCDASVLLDDDAAAGFTGEKGAGPNAGSLRGFDVIDNIKTLLELLCPQTVSCADILAVAARDSVEQLGGPSWTVPLGRRDATTASAFLANSDLPGPTANLNGLLNAFPNKGSAPPT

SEQ ID NO: 47618 - DNA, 656 bp, Panicum virgatum
  misc_feature: Ceres CLONE 2037742
  misc_feature: Encodes the peptide sequence at SEQ ID NO. 47619
tcattagcatcagacgggttctacttaaggtcacccgggtatcctttcatgaggtacagtactggaagccatggttttccgtactccccggccgactctgggattgggtattcccatatgctcttcacgccagagaatttggcagcaatcacagatgactttgcagaggagaatcttttgggagaaggtggatttgggtgtgtgtttaagggcattttgccggatggtcgccctgtagctgtcaagaagctcaaagtcgggaatgggcaaggcgagcgtgagttcaaggccgaagttgatactatcagcagagtacatcatagacatttggtttcgttagtaggctattgcattgccgatggccagcgaatgctcgtttatgattttgttcccaacaacacactttattaccacctccatgtaagtgaagcagcgcttgattggcggacaagggttaagattgcagctggagcagcccgaggaattgcttacctgcatgaagattgtcatccacgtattatacatagagatattaaatcatccaatattttgttggataacaactttgaagctcaggtttctgattttgggcttgcaaggttagcggctgattccaatacacatgtcaccacacgtgtcatggggacattcgggta

SEQ ID NO: 47619 - protein, 218 aa, Panicum virgatum
  misc_feature: Ceres CLONE 2037742
  misc_feature (54)..(217): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature: Functional homolog of the protein sequence given in SEQ ID NO 50776
  misc_feature: Useful for making plants with altered carbohydrate content
SLASDGFYLRSPGYPFMRYSTGSHGFPYSPADSGIGYSHMLFTPENLAAITDDFAEENLLGEGGFGCVFKGILPDGRPVAVKKLKVGNGQGEREFKAEVDTISRVHHRHLVSLVGYCIADGQRMLVYDFVPNNTLYYHLHVSEAALDWRTRVKIAAGAARGIAYLHEDCHPRIIHRDIKSSNILLDNNFEAQVSDFGLARLAADSNTHVTTRVMGTFG

SEQ ID NO: 47620 - DNA, 667 bp, Panicum virgatum
  misc_feature: Ceres CLONE 2037764
  misc_feature: Encodes the peptide sequence at SEQ ID NO. 47621
cccgtgctctgctcctcgccatcatctcctccgtcctcctatcatcaccgccgctcgggtccccgtctccccgggtaaaaagatggcgtcccacattgttggataccctcgcatgggccccaagagggagctcaagtttgcccttgagtctttctgggatgggaagagcagcgccgaggatttggagaaggttgctaccgacctcagggccaacatctggaaacagatgtccgaggctgggatcaagtacgttcccagcaacactttctcctactacgaccaggtccttgacaccaccgccatgctcggtgctgtcccggagcgctactcatggaccggaggtgagatcgggttcgacacctacttctcgatggctaggggtaacgccactgtccctgctatggagatgaccaagtggtttgacaccaactaccactttattgtccctgagctgggtcccaacaccaagttctcctactcttctcacaaggctgttaatgaatacaaggaggccaaggcgcttggagttgacaccgtgccagtgcttattggaccagtctcctacctgttgctctcaaagcctgccaagggtgtggagaagggtttcccccttctttcccttcgtagcagcatcctccctgtctacaaggaggtcattgctgagctg

SEQ ID NO: 47621 - protein, 194 aa, Panicum virgatum
  misc_feature: Ceres CLONE 2037764
  misc_feature (2)..(194): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
MASHIVGYPRMGPKRELKFALESFWDGKSSAEDLEKVATDLRANIWKQMSEAGIKYVPSNTFSYYDQVLDTTAMLGAVPERYSWTGGEIGFDTYFSMARGNATVPAMEMTKWFDTNYHFIVPELGPNTKFSYSSHKAVNEYKEAKALGVDTVPVLIGPVSYLLLSKPAKGVEKGFPLLSLRSSILPVYKEVIAE

SEQ ID NO: 47622 - DNA, 754 bp, Panicum virgatum
  misc_feature: Ceres CLONE 2037766
  misc_feature: Encodes the peptide sequence at SEQ ID NO. 47623
accataccaccactccctcccgatccctccaccgccaccgccaccgccaccgcctcctccgcctcacccctcttctcgcctcgtgcgtcgaccggcggccgatcgtctgcggcccagacatggggctcttcactgtcacgaagcaggccaccacgcccttcgacggccagaagcccggcacctccggcctccgcaagaaggttactgtattccagcagcctcattatctgcagaactttgtccaatcaacattcaatgcccttcctgctgatcaagtaaaaggtgcgaccattgttgtctctggtgatggccgctatttctcgaaagatgctgttcagatcataacaaaaatggctgctgccaacggagtaagacgtgtttgggttggactaaacagtctcatgtcaacccctgctgtatctgctgttatccgtgaaagaaccggtgcagatggatcaaaggctaccggtgccttcatcctgacagcaagccataacccaggtggtccgactgaggattttgggatcaaatacaatatgggaaatggtgggcctgcacctgaatccgttactgatagtattttctctaatacaaagacaatctctgaatacctcatcgctgaagaccttccagatgttgatatttctgttgctggtgtcactagcttcagtgggcctgaaggcccctttgatgtggatgtctttgactccagtgtagattacataaagttgatgaagtcaatctttgactttgg

SEQ ID NO: 47623 - protein, 211 aa, Panicum virgatum
  misc_feature: Ceres CLONE 2037766
  misc_feature (16)..(165): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKQATTPFDGQKPGTSGLRKKVTVFQQPHYLQNFVQSTFNALPADQVKGATIVVSGDGRYFSKDAVQIITKMAAANGVRRVWVGLNSLMSTPAVSAVIRERTGADGSKATGAFILTASHNPGGPTEDFGIKYNMGNGGPAPESVTDSIFSNTKTISEYLIAEDLPDVDISVAGVTSFSGPEGPFDVDVFDSSVDYIKLMKSIFDF

SEQ ID NO: 47624 - DNA, 443 bp, Panicum virgatum
  misc_feature: Ceres CLONE 2037779
  misc_feature: Encodes the peptide sequence at SEQ ID NO. 47625
aaaaactccatcacttccagctccagcctcaagcatctcctctcctcctcccccccaatgccgccccgccggtagccgcgccccgagcccccgcgcccgtcgcaatgcccggcccccgcgcgcccctggcggcgctggcggacctgctcgcggtcgcctccctcgccccccgcgccgccgcggagccgccgcccagcgagcggtccgcgctgctggcgttcctcaccgcgaccccgcacgagcgccgcctcggatggaacacctccaccccgacgtgcagctgggtcggggtcacctgcgaccgctccggctccagcgtcgtcgaggcgcgcctcccgggcgtcagcatcgccagcgccatcccgccgggcacgctcggccggctcaccaacctccgcgtgctctcgctccgtctccaactgcgtcgtgggctccatccccca

SEQ ID NO: 47625 - protein, 112 aa, Panicum virgatum
  misc_feature: Ceres CLONE 2037779
  misc_feature (29)..(66): Pfam Name: LRRNT_2 Pfam Description: Leucine rich repeat N-terminal domain
MPGPRAPLAALADLLAVASLAPRAAAEPPPSERSALLAFLTATPHERRLGWNTSTPTCSWVGVTCDRSGSSVVEARLPGVSIASAIPPGTLGRLTNLRVLSLRLQLRRGLHP

SEQ ID NO: 47626 - DNA, 707 bp, Panicum virgatum
  misc_feature: Ceres CLONE 2037788
  misc_feature: Encodes the peptide sequence at SEQ ID NO. 47627
gtcgcaaagccgaggttctccccacatctcccccaccctcacggcgtcgccgggcggcagatccggccaccggcgcgatccccgctgcagcgcagtgaaattagtcaagttactctcaatgctccagatatagcagaaaaccatgggagaagttactgaaaataataattcagacatgtctgttctacaaagaattgctacgagcagcgtgccactgttgaaagactatggtctgaatggagttgttggtgctgtgcttctggctgtagttattcctttattgcttacctcaatgtttggcaaaaagacaaagaaaagggcagtgcaagctgatgtgggtggagaggcaggacttgccatgcgaaacagtagattttcatccttagttcaagtcccatgggagggtgccaccacaatggcagctctattcgagatggccagcaaaaagtactctcaacggaggtgtcttggcacaagaaagctaattaatagggaatttgtggagcctgctgatggtaggaagtttgagaaattgcatcttggagaatatcaatgggatacctatgcagaagcttttaatcgtgcatgtaattttgcttctggacttatcaagatgggccacaaactagatagtcatgcagcaatattttctgatacaagagctgagtggatcattgctgcccagggatgcttccgacaaaatttga

SEQ ID NO: 47627 - protein, 188 aa, Panicum virgatum
  misc_feature: Ceres CLONE 2037788
  misc_feature: SWISSPROT Homolog: EC 6.2.1.3 Long-chain-fatty-acid--CoA ligase
MGEVTENNNSDMSVLQRIATSSVPLLKDYGLNGVVGAVLLAVVIPLLLTSMFGKKTKKRAVQADVGGEAGLAMRNSRFSSLVQVPWEGATTMAALFEMASKKYSQRRCLGTRKLINREFVEPADGRKFEKLHLGEYQWDTYAEAFNRACNFASGLIKMGHKLDSHAAIFSDTRAEWIIAAQGCFRQNL

SEQ ID NO: 47628 - DNA, 674 bp, Panicum virgatum
  misc_feature: Ceres CLONE 2037796
  misc_feature: Encodes the peptide sequence at SEQ ID NO. 47629
cccttctcattatttatcccctctccctctccgcaccgacccgtctccgcctcgccccccgccgccgccgccgccggattcgcttccgcctccggcggccacgcccatttcccgcaccactacctcgccgcatccgccggctccgatcctcacggctgctgcggcaccatctttaccccacgaccacgccagccacaagaccagaaacgcctctcacaacggcaagaatccattcatccagtccactcatcaggggcgctgcgcccccatctttgactcgcactccgcgtccagatctaggccggtggagcgaggaaagatgaacggaggcaccgccccatccgcggccgcggccgcggcgacgccgcctcaccgacggctgccggacttcctccagagcgtgaacctcaagtacgtgaagctggggtaccactacctcatcacccacctgctcacgctgatgctgctcccgctcatggccgtgatcctcctcgaggccgggcgaaccgaccccgacgatctgcgccagctgtggctccacctccagtacaacctcgtctccgtgcttgtcctctccgccgtcctcgtcttcggcgccaccgtctatgtgctcacccgcccgcgacccgtctacctcgtcgacttcgcctggtacaagccgcccgcccacctcc

SEQ ID NO: 47629 - protein, 118 aa, Panicum virgatum
  misc_feature: Ceres CLONE 2037796
  misc_feature: SWISSPROT Homolog: EC 2.3.1.119 Icosanoyl-CoA synthase
MNGGTAPSAAAAAATPPHRRLPDFLQSVNLKYVKLGYHYLITHLLTLMLLPLMAVILLEAGRTDPDDLRQLWLHLQYNLVSVLVLSAVLVFGATVYVLTRPRPVYLVDFAWYKPPAHL

SEQ ID NO: 47630 - DNA, 636 bp, Panicum virgatum
  misc_feature: Ceres CLONE 2037801
  misc_feature: Encodes the peptide sequence at SEQ ID NO. 47631
actaggcctgttgggggtggggtggggggatgcaaatctttgagcaaggggagaggagagagaaccggaatctgtgtcttgatctgttgccgaagctgataaactcttttatcctgaattgtttcgctaagctggcggagtgggcacataataactctccactgttgcttctttcttccagcctcttctctctctagccctactagctctagcagcagcccatcctccccctgctcactccctctctcctccccccactctcgcaatcccttctccggccacctcgacggctcctcctcccccacatcgccgacccgctactttaatggttttaaggtagcgcgcgagctcatggaatccccggggctggtcgcggtggtggcgctcttcgtcgccgcggcggtggccgcctcagccgccgacgacgcccagctgctcgagcagttcaaggcggaggtgccggtccaggccgcggacctccgcgggtggagcgccgccgacggcgcctgcaggttccccggcgcgggctgcagggccggcaggctcacgtcgctgtcgctcgccggcgtgccgctcaatgccgacttccgggccgtcgcggccacgctgctgcagctgggcggcctcgagacgctc

SEQ ID NO: 47631 - protein, 94 aa, Panicum virgatum
  misc_feature: Ceres CLONE 2037801
  misc_feature: SWISSPROT Homolog: EC 2.7.11.1 Non-specific serine/threonine protein kinase
  misc_feature: The sequence is a functional homolog of SEQ ID NO 2 in US patent 7135625
MESPGLVAVVALFVAAAVAASAADDAQLLEQFKAEVPVQAADLRGWSAADGACRFPGAGCRAGRLTSLSLAGVPLNADFRAVAATLLQLGGLET

SEQ ID NO: 47632 - DNA, 608 bp, Panicum virgatum
  misc_feature: Ceres CLONE 2037821
  misc_feature: Encodes the peptide sequence at SEQ ID NO. 47633
tggattagcaaattgtttgggtttgatttcagggtggagtacagaccgggccgcctcaacacagtcgccgacgcgctgtctcgccgtgacagcgaggagttggcgatgcacgccatctccacgcccacgttccacttctactatgccctccggcgtgagatcgagactactccggagctcgcggcgttgcgccaggcgatcctcgacggccaccacgatgacacatggcgcatccaagatggactgatcctgcaccacgggaagctccatgtctcgccatcttccaacctgatccaggtgatcctggagctggctcacacgtcgggtcatgaaggcatccagaagactctgcaccgactccggaacgacttcagcgtcgaccgtgatcgccacctcgtccacgactacgtccgcacatgcactgtttgccagcgcaacaagaccgaggcgcttcatccggcgggtctgcttcagcctctccccgtcccgtcgcgcatttgggcggatatctccatcgacttcatcgaagcactccccaaggtacatggcaagagcgtgatactcaccgtggttgatcgtctgtcgaaatatgcccacttcattccact

SEQ ID NO: 47633 - protein, 202 aa, Panicum virgatum
  misc_feature: Ceres CLONE 2037821
  misc_feature: SWISSPROT Homolog: EC 2.7.7.49 RNA-directed DNA polymerase
WISKLFGFDFRVEYRPGRLNTVADALSRRDSEELAMHAISTPTFHFYYALRREIETTPELAALRQAILDGHHDDTWRIQDGLILHHGKLHVSPSSNLIQVILELAHTSGHEGIQKTLHRLRNDFSVDRDRHLVHDYVRTCTVCQRNKTEALHPAGLLQPLPVPSRIWADISIDFIEALPKVHGKSVILTVVDRLSKYAHFIP

SEQ ID NO: 47634 - DNA, 692 bp, Panicum virgatum
  misc_feature: Ceres CLONE 2037834
  misc_feature: Encodes the peptide sequence at SEQ ID NO. 47635
gccatcctgagtcgtcgcgtcgcgtctccaacaacaaactccgcacccaaatccacgaggaattccccttcctccccccaccaaaacccgccccggcgaaacccccctagcctgcgacgaacagggcgagcgccgccgccctttgccaggtttcgtcgggctcttctccagcgactacatctcgccaggttgcttcacaaaatttgtaacgtcaagggtacaactagccaaagagtcaataaactttctctggactcgcagagagcccatcctgcagggtgtctcagacatactgatggatggggaacccaagatccttgagaaattatcacatgaacgcatgtactcttggtacttcaccagggaagaactagagaagttatctccatcaaggaaagatggaattactgaaagcaaggagtcagaacttcggcatttatattgttcatttattcgggatgttggcatcaggctgaaactacctcagatgactgtagcgacagcaataatgttttgccatcgcttctatatacaccagtcccttgccaaaaatggatggcagacagttgcaactgtatgtgtatttctggcatcgaaagctgaagatactccttgccccctggaccatgtagttcgagtagcctatgagacaatgtataggcgggacactgctgcagctcaaaggatccgcc

SEQ ID NO: 47635 - protein, 132 aa, Panicum virgatum
  misc_feature: Ceres CLONE 2037834
  misc_feature (15)..(132): Pfam Name: Cyclin_N Pfam Description: Cyclin, N-terminal domain
MDGEPKILEKLSHERMYSWYFTREELEKLSPSRKDGITESKESELRHLYCSFIRDVGIRLKLPQMTVATAIMFCHRFYIHQSLAKNGWQTVATVCVFLASKAEDTPCPLDHVVRVAYETMYRRDTAAAQRIR

SEQ ID NO: 47636 - DNA, 390 bp, Panicum virgatum
  misc_feature: Ceres CLONE 2037862
  misc_feature: Encodes the peptide sequence at SEQ ID NO. 47637
cgagcgggggcggaggtcgccttacgaaccccttcggcggagtgctgtgcgccttcaccctcctcctcatccgcgtcatctttttttcgatccccctcttctcactgatcaagtacgacagcgttatctacgatttcgatccctacttcaactaccgcgtcactcattttttgtcaaagaatgcaatctaggaattctggaactggtttgatgacctagcttggtatcctctggcgcgtgatattggcaccacagtctatcgtggtttgacactaactgctggcacaatgtggtggatgcttatctcccttaacctcccattgttggcggagacggtcagtgtgttcaccgctctaatcttcgcggccaatgcttccggggcaacttaac

SEQ ID NO: 47637 - protein, 62 aa, Panicum virgatum
  misc_feature: Ceres CLONE 2037862
  misc_feature: SWISSPROT Homolog: EC 2.4.1.119 Dolichyl-diphosphooligosaccharide--protein glycotransferase
  misc_feature: Functional homolog of the protein sequence given in SEQ ID NO 51470
  misc_feature: Useful for making plants with altered carbohydrate content
SGGGGRLTNPFGGVLCAFTLLLIRVIFFSIPLFSLIKYDSVIYDFDPYFNYRVTHFLSKNAI

SEQ ID NO: 47638 - DNA, 672 bp, Panicum virgatum
  misc_feature: Ceres CLONE 2037866
  misc_feature: Encodes the peptide sequence at SEQ ID NO. 47639
aatcgcatctcacgctccctcgcgttccccacaaaccctagtcgactcctccctcgcgccgctgccgccgacctcgcctctgtcgctcctcgtgctcggaaaggaggtctcgcgatggcctctgagacggagacgttcgccttccaggcggagatcaaccagctgctctcgctcatcatcaacacgttctactccaacaaggagatcttcctccgggagctcatctccaactcctccgatgccttggacaagatcaggtttgagggcctgactgacaagaccaagctggatgcccagccagagctgttcatccacattgttcctgacaaggcctccaacactctgacaatcattgacagtggtattggtatgaccaagtcagacctcgtgaacaaccttggtaccattgcacggtcaggcacaaaggagtttatggaggctctggccgctggtgctgatgtttctatgattggtcaatttggtgttggtttctactctgcctaccttgtggctgagagagttgtcgtcaccaccaagcacaatgatgatgagcagtacgtgtgggagtctcaggctggtggatccttcactgtcacccgtgatacctctggggagccccttggcaggggtaccaagatgaccctctacctcaaggatgatcagttggagtac

SEQ ID NO: 47639 - protein, 185 aa, Panicum virgatum
  misc_feature: Ceres CLONE 2037866
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFEGLTDKTKLDAQPELFIHIVPDKASNTLTIIDSGIGMTKSDLVNNLGTIARSGTKEFMEALAAGADVSMIGQFGVGFYSAYLVAERVVVTTKHNDDEQYVWESQAGGSFTVTRDTSGEPLGRGTKMTLYLKDDQLE

SEQ ID NO: 47640 - DNA, 659 bp, Panicum virgatum
  misc_feature: Ceres CLONE 2037875
  misc_feature: Encodes the peptide sequence at SEQ ID NO. 47641
gtccccacccagcccggccgcgcgcccgccccgatcctcgctacccaccaccgcgcatgccagcgccgccgccgatcagcaggcgccaccaccccctcctccggcggcggatcagcagtagcttcgactctgagctgttcctgctcctgcggtgactctcgctagttctttctttccctcttcatccgtcgaggtgcgagggaaggaagcttgttgccggcttgaggagggttcgtcggagaccggaaggaaggtcgagcgtcgagcagctaatgcctcccaacgcccaggacgcgcacggaagcaccggcctcgccgtgacggcggcagcggcgaacaagatggactgcttcctgaccaccgcctgcacgccgctcaacctccagttcatcgacgtgtcgtaccgcgtgaagcagacggagcggtcggcggcggcgaaggcggcgccgcccggccggatatcctcgcactccggcgccggcggcggcgcagcggcggaggagcggacgatcctcaggggcgtcacgggcgaggcgcggccgggggaggtgctcgcggtgctgggcccgtcggggagcggcaagtcgacgctgctctccatcctcggcggccgcctcgcggggcgccacgccgggacggtcctcgccggcgggcggctg

SEQ ID NO: 47641 - protein, 128 aa, Panicum virgatum
  misc_feature: Ceres CLONE 2037875
  misc_feature: SWISSPROT Homolog: EC 3.6.3.25 Sulfate-transporting ATPase
MPPNAQDAHGSTGLAVTAAAANKMDCFLTTACTPLNLQFIDVSYRVKQTERSAAAKAAPPGRISSHSGAGGGAAAEERTILRGVTGEARPGEVLAVLGPSGSGKSTLLSILGGRLAGRHAGTVLAGGR

SEQ ID NO: 47642 - DNA, 743 bp, Panicum virgatum
  misc_feature: Ceres CLONE 2037876
  misc_feature: Encodes the peptide sequence at SEQ ID NO. 47643
tctgggctctgtctctttcggtctttcccatcccatcccttgcgctcactcagtgtgctgcggcggcggcgacggcggcgactgtggttggggatccttccgcgcctccaaatcgctgctgcctgcgggttctcttcatatcctaacagtcgagctcaatggcaaaagaacaggatggatcccccaagccccgccacccagaattccaaaggatgcgtgtaacactcaccataggcgtcattgggctctgtgtcacatcatacattcttggggcttggcaaggcacctccaacagcatcaagccatccttcataagcactaaaactcggtgcgataatatggtgcgatcctctggtactcacctggatttccaagcccaccaccaggtcagcttcaatgaatcgtcgcttgcgccagagaaattcccaccttgccagctcaagtacagtgagtataccccctgccaagacccgaggaaggcaaggaagttcccaaagaatatgatgcagtacagggagaggcactgccctaagaaagaggacatgctccgctgcttgattcctgcacctccaggctataagaatcccttcgagtggccgaaaagtcgggactatgcttggtacaataacattcctcatcggggactcagtattgaaaaggcagttcagaattggattcaggttgagggagacctgcttagattccctggaggtggcaccatgttttccacatggtgctgatgc

SEQ ID NO: 47643 - protein, 193 aa, Panicum virgatum
  misc_feature: Ceres CLONE 2037876
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
MAKEQDGSPKPRHPEFQRMRVTLTIGVIGLCVTSYILGAWQGTSNSIKPSFISTKTRCDNMVRSSGTHLDFQAHHQVSFNESSLAPEKFPPCQLKYSEYTPCQDPRKARKFPKNMMQYRERHCPKKEDMLRCLIPAPPGYKNPFEWPKSRDYAWYNNIPHRGLSIEKAVQNWIQVEGDLLRFPGGGTMFSTWC

SEQ ID NO: 47644 - DNA, 585 bp, Panicum virgatum
  misc_feature: Ceres CLONE 2037878
  misc_feature: Encodes the peptide sequence at SEQ ID NO. 47645
aatgccgccgtccgccccgccccgccccgcgtgagcacggctgggctcactccgctccactccactcctctcccagccgcccaccgtctccctccccgtggctatatagcgcgcgcctccgcggccctccggatcgaagcctatcctccgcagtcgcccagcccagcgcagccccccgcgtttcactcccagcggtcgcagaggcgggtttaagcgccggttggtcgcgcttcgatttcgatccatccgatccgatccggctgcggcgagatggcggcgctggcgccggcgttggcggtctccggggccgcggcgagggctccacggcccaccggcggcggggaccggaggcgcggggcagggcggccgtcgccgtcgctggccttcctctctcggggtgctcgagatgaggcttcgggaaggcgcggggccatgcgcgcggcggcggcggcgtccgggaaggtggttgttcccgagggcgagaacgacggcctgacatcctcgcccgactcggctcggttccagtccgacgaactggaggtaccagacatcactgacggtaagatcgagtcttcagaggcaatg

SEQ ID NO: 47645 - protein, 104 aa, Panicum virgatum
  misc_feature: Ceres CLONE 2037878
  misc_feature: SWISSPROT Homolog: EC 2.4.1.18 1,4-alpha-glucan branching enzyme
MAALAPALAVSGAAARAPRPTGGGDRRRGAGRPSPSLAFLSRGARDEASGRRGAMRAAAAASGKVVVPEGENDGLTSSPDSARFQSDELEVPDITDGKIESSEA

SEQ ID NO: 47646 - DNA, 736 bp, Panicum virgatum
  misc_feature: Ceres CLONE 2037920
  misc_feature: Encodes the peptide sequence at SEQ ID NO. 47647
aggaaggaatcgcactcgcggtctcgcgctcgcaacaccaccacctccaccattcgacgcaaagcgaggttctccccctcccccctccaccctcacggcgtcgccgggcggcagatccggccaccggcgcgattcccgctgcatcgcagtgaaattagtcaagttactcaatgctcctgaagtcctgatatagcagaaaaccatgggagaagttagtgaaaataattcagacatgtctgttctacaaaaaattgctacgagtggtgtgccactgttgaaggactatggtctgagtggagttgtttgtgctgtgcttctggctatagttattcctttattgcttacctcaatgtttggcaaaaagacaaagaaaagggcagtgcaagctgatgtgggtggagaggcaggacttgccatgcgaaacagtagattttcatccttagttcaagtcccatgggagggtgccaccacaatggcagcactattcgagatggccagcaaaaagtactctctacggaggagtcttggcacaagaaagctaattaatagggaatttgtggagtctgctgatggtagaaagtttgagaaattgcatcttggtgaatatcaatgggatacctatgcagaagcttttaatcgtgcatgtaattttgcttctggacttatcaagatgggccacaaactagatagtcatgcagcaatcttttctgatacaagagctgagtggatcattgct

SEQ ID NO: 47647 - protein, 177 aa, Panicum virgatum
  misc_feature: Ceres CLONE 2037920
  misc_feature: SWISSPROT Homolog: EC 6.2.1.3 Long-chain-fatty-acid--CoA ligase
MGEVSENNSDMSVLQKIATSGVPLLKDYGLSGVVCAVLLAIVIPLLLTSMFGKKTKKRAVQADVGGEAGLAMRNSRFSSLVQVPWEGATTMAALFEMASKKYSLRRSLGTRKLINREFVESADGRKFEKLHLGEYQWDTYAEAFNRACNFASGLIKMGHKLDSHAAIFSDTRAEWII

SEQ ID NO: 47648 - DNA, 612 bp, Panicum virgatum
  misc_feature: Ceres CLONE 2037929
  misc_feature: Encodes the peptide sequence at SEQ ID NO. 47649
cttctctctctctctctccactgttgcttctttcttccagcctcttctctctctagccctactaactctagcagcagcccatcctccccctgctcgctccctctctcctcccccactctcgcaatcccttctcccgccacctcgacggctcctcctcccccacatcgccgacccgctactttaatggttttaaggtagcgcgcgagctcatggaatccccggggctggtcgcggtggtggcgctcttcgtcgccgcggcggtggccgcctcagccgccgacgacgcccagctgctcgagcagttcaaggcggaggtgccggtccaggccgcggacctccgcgggtggagcgccgccgacggcgcctgcaggttccccggcgcgggctgcagggccggcaggctcacgtcgctgtcgctcgccggcgtgccgctcaatgccgacttccgggccgtcgcggccacgctgctgcagctgggcggcctcgagacgctcagcctccgcggcgccaacgtcagcggcgcgctggccgccgccccgaggtgcggggctaggctgcagacgctcgacctgtccgggaatgccggcctgcggggctccgtcgccgacgtcg

SEQ ID NO: 47649 - protein, 134 aa, Panicum virgatum
  misc_feature: Ceres CLONE 2037929
  misc_feature: SWISSPROT Homolog: EC 2.7.11.1 Non-specific serine/threonine protein kinase
  misc_feature: The sequence is a functional homolog of SEQ ID NO 2 in US patent 7135625
MESPGLVAVVALFVAAAVAASAADDAQLLEQFKAEVPVQAADLRGWSAADGACRFPGAGCRAGRLTSLSLAGVPLNADFRAVAATLLQLGGLETLSLRGANVSGALAAAPRCGARLQTLDLSGNAGLRGSVADV

SEQ ID NO: 47650 - DNA, 728 bp, Panicum virgatum
  misc_feature: Ceres CLONE 2037949
  misc_feature: Encodes the peptide sequence at SEQ ID NO. 47651
accacttcactctccccccacccaccagtgctcactgctcagtgcctgcctcactcacctcaccatggctgagggagagctcgaataaataggccggacccgtggtgctactctcttgcccccctcccccctctggaactaggggtttcgctgcctcttcttcgtcctccactcgtcttggcatcctccaggctccagtgctctgccttcctgagctggcttcttgctcgcaggagccatgccgaaggagtacccagcttctcccaaagcccaacagctgcaggaatccaagaagcagcgcctaacatacatcctcgtggtgagctcgctctgcatcgccttttatgtccttggtgcatggcagaacaccacgcttccaaagcccgtgggcaactctgcggacatcacccgggttgggtgtgaccccaccaccgccacggcacagtcctctggctctggctccgtgccatccttcggaccaggttccggtgaggcactcgacttcgatgcacaccaccggctcatcatcaatgacacagatgctggggcggaactgcagcagtttccagcttgcccgctcaacttcagcgagtacacgccgtgtgaggaccgtacgcgtgggcgccggttcgaccgcggcatgcttgtgtaccgggagcggcactgccctggcaaggacgagcagattcgatgtctcattcccgcgccgcctgggtacatgaccccct

SEQ ID NO: 47651 - protein, 163 aa, Panicum virgatum
  misc_feature: Ceres CLONE 2037949
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
MPKEYPASPKAQQLQESKKQRLTYILVVSSLCIAFYVLGAWQNTTLPKPVGNSADITRVGCDPTTATAQSSGSGSVPSFGPGSGEALDFDAHHRLIINDTDAGAELQQFPACPLNFSEYTPCEDRTRGRRFDRGMLVYRERHCPGKDEQIRCLIPAPPGYMTP

SEQ ID NO: 47652 - DNA, 592 bp, Panicum virgatum
  misc_feature: Ceres CLONE 2037975
  misc_feature: Encodes the peptide sequence at SEQ ID NO. 47653
ccagagaaaggatctccagctttccaaacattgatatgtgatggatatgtaaaagaagatatgaagatcttatcaaaatacaactctattagagcattaaagatcgatcggggctcattcctaaggccgaaatatcttcatcacctgaggtatcttgatctctcaggaagtgatattgaagcacttcctgaagacatcagcatcctgtatcatctgcaaacactcaacctttctgattgccgtgttcttcagcgacttccaaaggaactgaagtatttgacttccctccgtcacctctacactcacaaatgtccaaagttgaaaagcatgcccgcagagctcggacacctctcttgcctgcagacactcacatgctttgttgtaggtactgacaccagttgcagtaatgtgagagagctgcagaatttggaccttggtggtagactagagctaagacagctcgaaaatgtcgcaagagcagatgttgtagaagcagcaggacttggaaataagaaaaaactgaccgaactggagttagtatggactgattatgaccagcaggcacagaataataatcataaagaggtggggc

SEQ ID NO: 47653 - protein, 197 aa, Panicum virgatum
  misc_feature: Ceres CLONE 2037975
  misc_feature: SWISSPROT Homolog: EC 4.6.1.1 Adenylate cyclase
PEKGSPAFQTLICDGYVKEDMKILSKYNSIRALKIDRGSFLRPKYLHHLRYLDLSGSDIEALPEDISILYHLQTLNLSDCRVLQRLPKELKYLTSLRHLYTHKCPKLKSMPAELGHLSCLQTLTCFVVGTDTSCSNVRELQNLDLGGRLELRQLENVARADVVEAAGLGNKKKLTELELVWTDYDQQAQNNNHKEVG

SEQ ID NO: 47654 - DNA, 719 bp, Panicum virgatum
  misc_feature: Ceres CLONE 2037993
  misc_feature: Encodes the peptide sequence at SEQ ID NO. 47655
cttccttaacttcatagagtcaatatggccaagatggaccagacaatcgctgcagcaaaatcatgtgatgtagaatgcactaatgttgagaaaaagctgacgcagttgcttgatatgactgaagatgaagctctttttcatgcaagacagagtgcttatctttacaggtttggagttcagacattgcccaagagcctccactgcctttcaatgagattgactgttgactacttcaatgcatcatctgacatggagcattcagatgctgaaaagtttggaaatccagcattccagcactatgtcattttctccaccaaccttcttgcgtcatccatgactatcaactcaagtgtgataaattctgaggaatcagcaaatatggttttccatctgatgaccgatggacaaaacttttatgcatttaagaactggttcatcagaaattcctacaagggagctaccataagagtccttaattttgaagatttccaagtgaagaatttgggaaatgggatagttgatcaattatcaccatctgaagagttccgaatcacctccaatagcaatgctcgaacgttaaatactcttacgaggactgagtatatttcaatgtttggacactcccttttcttgcttcctgaattatttaccaatcttaaaagggtcattgtcttggaagacgatactatagtccagagagacttgtcgctcctgtggac

SEQ ID NO: 47655 - protein, 231 aa, Panicum virgatum
  misc_feature: Ceres CLONE 2037993
  misc_feature: Functional homolog of the protein sequence given in SEQ ID NO 51740
  misc_feature: Useful for making plants with altered cell wall content and/or composition
MAKMDQTIAAAKSCDVECTNVEKKLTQLLDMTEDEALFHARQSAYLYRFGVQTLPKSLHCLSMRLTVDYFNASSDMEHSDAEKFGNPAFQHYVIFSTNLLASSMTINSSVINSEESANMVFHLMTDGQNFYAFKNWFIRNSYKGATIRVLNFEDFQVKNLGNGIVDQLSPSEEFRITSNSNARTLNTLTRTEYISMFGHSLFLLPELFTNLKRVIVLEDDTIVQRDLSLLW

SEQ ID NO: 47656 - DNA, 747 bp, Panicum virgatum
  misc_feature: Ceres CLONE 2038004
  misc_feature: Encodes the peptide sequence at SEQ ID NO. 47657
aatcaacattcgttcgctgctagcttgccacagcgaacgctcgcccactagtgccccccctttgccgttcgctcgcccactagtgccccctctttgccttctcgtcctagattctaagaagcaagctgagtaacgaacaaacatccatacctctgatgaatatcaccatcagcgtcctcctcctcggagtcgtccaaaccctttctgcgctcgtccgcggagccggcgatgaccagttcatctactctagcttcaccagcgccaacctcaccatggacggcacggccactgtcaggccagccgggctcctggagctgaccaacggcacgctccagctcaaaggccacgccttccacccgacgccgctccgcttccgggagagcggtggcgcaggcgcggtgaggtcgttctccacctcattcgtatttggcatcctctccgcttacccagacatgagtgcccacggcatcatcttcgtcgtgtccccaaccacggatttctccactgcgctggcgagccagtacctgggcctcgtcaatgtcaccagcaacggcgacgagcgcaaccggatattcgccgtcgagctggacaccttgcagcaggacgagttccgcgacatcaacgacaaccacgtcggcgtggacatcaacagcctcatttctctggactccagcgatgccggctactacgatgatgaaggaagctttaagaatctctcgctaataagccacgaggagatgcgagtgt

SEQ ID NO: 47657 - protein, 158 aa, Panicum virgatum
  misc_feature: Ceres CLONE 2038004
  misc_feature (1)..(158): Pfam Name: Lectin_legB Pfam Description: Legume lectin domain
MDGTATVRPAGLLELTNGTLQLKGHAFHPTPLRFRESGGAGAVRSFSTSFVFGILSAYPDMSAHGIIFVVSPTTDFSTALASQYLGLVNVTSNGDERNRIFAVELDTLQQDEFRDINDNHVGVDINSLISLDSSDAGYYDDEGSFKNLSLISHEEMRV

SEQ ID NO: 47658 - DNA, 717 bp, Panicum virgatum
  misc_feature: Ceres CLONE 2038005
  misc_feature: Encodes the peptide sequence at SEQ ID NO. 47659
cttttcctccgcatccgccggcagccgctgccgctgctttccttcccgtctccgctccactctcccagtctcccctccgcctcgctgctcgctctccgccagcgccagccgtctcctcgatcccggcttcaccggcgtgggagcgtaggctcgcttgcctcagggttgggctccgctttgggattgatttggttccgccgaccggcctccggattcgaggccgagctccgctgtggcttgccggctcgtcgccagcgattcgaattcgaatccagaggaacgagatcgacggcgccgccgggaccgagcgagttccggccgccaatgccgccgccgctcctgctcctgctcctcctgctggccgcgtcgacggcgccggcgccggcgcgggcgggggacccctacgcctactacgactgggaggtgtcgtacgtctccgcgcagccgctcggcgtcaagcagaaggtgattggcatcaacgggcagttcccgggcccgccgctgaacgtggcgaccaactggaacgtggtggtgaacgtccgcaacgcgctggacgagccgctgctgctcacctggaacggcgtgcagcagcgcaagacagcgtggcaggacggcgtgctcggcaccaactgcgccatccccgcggggtggaactggacctacgcgttccaggtcaaggaccaggtcggcagcttcttctacttcccctccacgccg

SEQ ID NO: 47659 - protein, 130 aa, Panicum virgatum
  misc_feature: Ceres CLONE 2038005
  misc_feature (33)..(130): Pfam Name: Cu-oxidase_3 Pfam Description: Multicopper oxidase
  misc_feature: SWISSPROT Homolog: EC 1.10.3.3 L-ascorbate oxidase
MPPPLLLLLLLLAASTAPAPARAGDPYAYYDWEVSYVSAQPLGVKQKVIGINGQFPGPPLNVATNWNVVVNVRNALDEPLLLTWNGVQQRKTAWQDGVLGTNCAIPAGWNWTYAFQVKDQVGSFFYFPST

SEQ ID NO: 47660 - DNA, 699 bp, Panicum virgatum
  misc_feature: Ceres CLONE 2038009
  misc_feature: Encodes the peptide sequence at SEQ ID NO. 47661
aacatcgtcgcaaaataaaataccgcggcttccccttccaccctctctctccccctctctctctccccacccacacggtgctgagctggttcgcagtcctccgtccccttgcttcagctcagcggcatcagcagcttcccccctctatcccttccctcctcttcttcataagctcactcccaaacggaagtggagcggagccagcagttgaagtgtagaagtagcaagcattgggatttcgtgtgaaggggatagttgggtgcgccaaaggaaaaaggagacccaggattagcgtgtggcggattgggtggctattttgggagcgggggaggacgagaggcgtggccttggccgggggaggcggcggcttcttggaccggccattgatggcgccgtggagcggcttgtggggcggcaaggccggcggcgacgcctaccggggcacgccggtggtggtcaagatggagaaccccaactggtccatctccgagatctcctcgccggaggatgacgacgaggacatcttggccgctggcggccgccgcaaggggggccgctccaagaacgccaagcagatcaggtgggtgctgctgctcaaggcgcaccgcgccgccggctgcctcgcctcgctcgcctccgccgccgtctcgctcggcggcgccgccaggcgaagggtcgccgcggggaggaccgacgctg

SEQ ID NO: 47661 - protein, 104 aa, Panicum virgatum
  misc_feature: Ceres CLONE 2038009
  misc_feature: Functional homolog of the protein sequence given in SEQ ID NO 50470
  misc_feature: Useful for making plants with altered carbohydrate content
  misc_feature: Functional homolog of the protein sequence given in SEQ ID NO 50471
  misc_feature: Useful for making plants with altered cell wall content and/or composition
MAPWSGLWGGKAGGDAYRGTPVVVKMENPNWSISEISSPEDDDEDILAAGGRRKGGRSKNAKQIRWVLLLKAHRAAGCLASLASAAVSLGGAARRRVAAGRTDA

SEQ ID NO: 47662 - DNA, 726 bp, Panicum virgatum
  misc_feature: Ceres CLONE 2038023
  misc_feature: Encodes the peptide sequence at SEQ ID NO. 47663
atactgtacaggtcgaaggaacatttgtggatggaacaaaactaatcactgtacatgaccctatttctttggatgatggaaatttggagctagcactgcatggttcttttctcccaggtcatctattcttatcagcataattggttcaattatgttcaaactgttttctgaattatatggctataaaattctttgattaatgtgttttatggagtctctggagatgtgcctgtttcagaatgttttttagggcagtgctgttcctaaaagtctttggcctattctgttttcaagaatacttgactagtggaaacaataaggtaaaaaaaaagaactgtacagaataatatgtaactgctgcagtgccttcacctgaaaagttctccgggggtgatgttgaagactatcctggtgaagtacattacagttctggtcgcatagttctaaaccttcatcgcagggctttaactttgaaggttattaataaggcagacagacctgttcagattggaagccattatcactttatagaggccaatccttacctagtttttgatagaaaaagggcctatggcatgaggttgaacatacttgctggaacagctgttcgatttgagccaggggattcaaaaagtgttacacttgttagcatcggaggccataaggtaatcagaggtggaaatggcattgttgatggtcctattgaccgttcacagattaatgagg

SEQ ID NO: 47663 - protein, 45 aa, Panicum virgatum
  misc_feature: Ceres CLONE 2038023
  misc_feature: SWISSPROT Homolog: EC 3.5.1.5 Urease
TVQVEGTFVDGTKLITVHDPISLDDGNLELALHGSFLPGHLFLSA

SEQ ID NO: 47664 - DNA, 733 bp, Panicum virgatum
  misc_feature: Ceres CLONE 2038031
  misc_feature: Encodes the peptide sequence at SEQ ID NO. 47665
aaaaaccctctctcccctcacctccgtcccggatcaaacggccaccggaaaatccccgaaaaataactatcagcccatagtgcaggggcgggagatggggttcctcctgctccagctcggcttcgccatatttgcgctacgcatgcttcgaccggagatcgcgttgcccggttcagagccccggccgcagacgacgtacgtcagtgtaccgtacagcgacttcctggcgagcatagacaaggaccaggtgaagaaggtcgaggtggacggggtgcacatcatgttccggctccggccagaggttgaggccggtgtggtggagcagacaccagtgcagcgtggagcagatgttgtcgttgatagcgcaggagtttccaggagaattgtcttcacgaccactcgaccagtggatataaagacaccatacgagaagatggtggagaacatggttgaatttggatcaccggacaagaggtctggcggcatgctcaactctgccctggtggctcttatttatgttgtattaattgcagtagttttgcagcggttgccgattagcttttctcagcattcagcaggtcagctgagaaataggaagaattcaaattccagcggagcaaaagtttctgaaagtacggatatagttacatttgctgatgtggctggagtagatgaggcaaaagaagaattggaagaaattgtggagttttaaggaacccagaaaggtatattc

SEQ ID NO: 47665 - protein, 236 aa, Panicum virgatum
  misc_feature: Ceres CLONE 2038031
  misc_feature (67)..(227): Pfam Name: FtsH_ext Pfam Description: FtsH Extracellular
KTLSPLTSVPDQTATGKSPKNNYQPIVQGREMGFLLLQLGFAIFALRMLRPEIALPGSEPRPQTTYVSVPYSDFLASIDKDQVKKVEVDGVHIMFRLRPEVEAGVVEQTPVQRGADVVVDSAGVSRRIVFTTTRPVDIKTPYEKMVENMVEFGSPDKRSGGMLNSALVALIYVVLIAVVLQRLPISFSQHSAGQLRNRKNSNSSGAKVSESTDIVTFADVAGVDEAKEELEEIVEF

SEQ ID NO: 47666 - DNA, 696 bp, Panicum virgatum
  misc_feature: Ceres CLONE 2038034
  misc_feature: Encodes the peptide sequence at SEQ ID NO. 47667
gaagtcgccatttccgggaggtcctggtggtcaggtgtgtctgctgcaaatggagaggtacgaggcgctgaaggagctgggcgccggtaacttcggggtagcgaggctggtcaaggacaagcggaccaaggagctcgtcgccgtcaagtacatcgagaggggcaagaagattgatgagaatgtgcagagggagatcatcaatcaccagtcgctccggcaccctaacatcgtacggttcaaggaggtaattcaggaaaaaactgaactcatcgattgattgattgattgattatctttatcttttgattttatcgaatttattcatgacgtttgatggttccaaagtctgaaattttgaactgagaagtatgtctacaaagtagaagtggtactctgcccgttctatgcttatcagcactgaatccactattaactgagctgcacaaagccacaatctattatcaattgatagttgtcagagtagtttcagaggcatcctaatttattctgaagtatgagcctagctgaatcattttcaaacgttgagaaatttatcatcttatgaccaaattgcatgacaaactcatcgtttgttctgcgaatcaatgggtaataggtttgcttaacgcccacacatcttgccattgtaatggaatatgctgctggtggagagctctttgagaaaatctgcagcgc

SEQ ID NO: 47667 - protein, 75 aa, Panicum virgatum
  misc_feature: Ceres CLONE 2038034
  misc_feature: SWISSPROT Homolog: EC 2.7.11.1 Non-specific serine/threonine protein kinase
  misc_feature: Functional homolog of the protein sequence given in SEQ ID NO 50598
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 50599
  misc_feature: Useful for making plants with modulated water use efficiency
MERYEALKELGAGNFGVARLVKDKRTKELVAVKYIERGKKIDENVQREIINHQSLRHPNIVRFKEVIQEKTELID

SEQ ID NO: 47668 - DNA, 761 bp, Panicum virgatum
  misc_feature: Ceres CLONE 2038067
  misc_feature: Encodes the peptide sequence at SEQ ID NO. 47669
  misc_feature (665)..(665): n is a, c, t, g, unknown, or other
atctttcgacttttccagagcgagcacagagggaggcggcggagggggcaccggcgatgtcgacgacgaccgaggcggcgaagagcgccgccgccacgccggtgcggtgccagcggatcggctgcgacgccatgttcaccgacgacaacaaccctgagggctcctgccagtaccacccctccgcacctttatttcatgatggcatgaaagagtggagctgctgcaagcaacgaagccatgattttagcttatttttggcgataccaggatgcacaacagggaagcacacgactgaaaaaccagtcacaaaagctgtttctgcaaaccgtccaaaggcaacaccagtccagtcttctcagcagactgtaggagccgatgcttgcgcaaggtgtcgtcagggtttcttttgttctgaccatggatcacagccgaaggtacaaaaaccagctgctaccgatgatacaaacaaggaacctgttgaaaaatcctcggttcctcctcccaagaaaaggatcgatataaatgaaccgagaacatgtagaaataaaggatgcggtaaatcctacaaggagaaggataaccatgattctgcgtgcgattaccatccaggtcctgcagttttccatgacaggatgagagggtggaaatgttgcaatattcatgtncaggagtttgatgagtttatggagatacctccatgcaccaagggctggcataacgctgatgctgtgtgaattcacacatgcctatggctgctatcg

SEQ ID NO: 47669 - protein, 225 aa, Panicum virgatum
  misc_feature: Ceres CLONE 2038067
  misc_feature (14)..(78): Pfam Name: CHORD Pfam Description: CHORD
  misc_feature (157)..(221): Pfam Name: CHORD Pfam Description: CHORD
  misc_feature: Functional homolog of the protein sequence given in SEQ ID NO 50434
  misc_feature: Useful for making plants with modulated biotic stress sensitivity
MSTTTEAAKSAAATPVRCQRIGCDAMFTDDNNPEGSCQYHPSAPLFHDGMKEWSCCKQRSHDFSLFLAIPGCTTGKHTTEKPVTKAVSANRPKATPVQSSQQTVGADACARCRQGFFCSDHGSQPKVQKPAATDDTNKEPVEKSSVPPPKKRIDINEPRTCRNKGCGKSYKEKDNHDSACDYHPGPAVFHDRMRGWKCCNIHVQEFDEFMEIPPCTKGWHNADAV

SEQ ID NO: 47670 - DNA, 701 bp, Panicum virgatum
  misc_feature: Ceres CLONE 2038069
  misc_feature: Encodes the peptide sequence at SEQ ID NO. 47671
attccaaccgcgtctcatctgctctcctcggacccgctccctcttcctccccacgaaaccctaggagagtccagcgcgcgacatggccgacggcggtgcgggcctggcggagcagctcgcggggctctccacgggcggcggcggcgacgacaagcagaaccctgcgccggcgggtgagggcggagaggagccgcagctctcgaagaacgccaagaaaagagaggagaagaggaagaagcaggaggaggagcggaggctcaaggaggaagagaagaagaacaaggcggctgctgctgctgccagtggaaagactcagaaggcatctactgccgacgatgaggacatggatcccactcaatattaccagaataggctcaacacacttgattcgctcaaagccacaggtgtagacgtctatccacataaattcccagttggcatctctgtagccgactacattgagaagtacaagagcttgaacaatggagagaagctaacagatgtgacggagtgtttagctgggcggatcatgaacaagagaacatcctcatctaagctattcttttatgatctttatggtggtggcgtgaaggttcaagtgatggctgatgccaagacctcagagttagagaatgaagctgaattcactaagtaccactcgggtgtgaagcgaggtgatattgttggcatatgtggctatc

SEQ ID NO: 47671 - protein, 206 aa, Panicum virgatum
  misc_feature: Ceres CLONE 2038069
  misc_feature: SWISSPROT Homolog: EC 6.1.1.6 Lysine--tRNA ligase
MADGGAGLAEQLAGLSTGGGGDDKQNPAPAGEGGEEPQLSKNAKKREEKRKKQEEERRLKEEEKKNKAAAAAASGKTQKASTADDEDMDPTQYYQNRLNTLDSLKATGVDVYPHKFPVGISVADYIEKYKSLNNGEKLTDVTECLAGRIMNKRTSSSKLFFYDLYGGGVKVQVMADAKTSELENEAEFTKYHSGVKRGDIVGICGY

SEQ ID NO: 47672 - DNA, 584 bp, Panicum virgatum
  misc_feature: Ceres CLONE 2038078
  misc_feature: Encodes the peptide sequence at SEQ ID NO. 47673
ctcaacttctttagggtttgctgctaagcctccaaactttcgctcctcctgatctatccccatgggcaagtccggcgccaaaaagaagaagccggccgccgccgccgccgccgccgccgcgaagccggccgccgccgccgctgcgaagccggcgcccgcattggccgagccaaaggcgacggcgcctccgaccacgccctccgcggtgaacggcacggggccacaccaggtggtggacgccggcgtcctcctgcggcgcgcgcacgagctcaaggaggagggcaaccgcctgttccagtcgcgcgagtacgatggggcgctgcgccagtacgagctcgcgctccgcatcgccccgcttggccaccccgacagcgccgtcttccatagcaaccgcgccgcctgtctcctccagctccgccccgtcgaccacgaggccgtcgcccaggagtgctccctcgcgctccaggccgagccgcgcttcccgcgagcgctcctccgccgcgcccgcgcggctcgaggcgctcggccgacacgagctcgccctcgccgacgcgctcgcgctcctcgcactcgaccccgaccac

SEQ ID NO: 47673 - protein, 174 aa, Panicum virgatum
  misc_feature: Ceres CLONE 2038078
  misc_feature: SWISSPROT Homolog: EC 3.1.3.16 Phosphoprotein phosphatase
MGKSGAKKKKPAAAAAAAAAKPAAAAAAKPAPALAEPKATAPPTTPSAVNGTGPHQVVDAGVLLRRAHELKEEGNRLFQSREYDGALRQYELALRIAPLGHPDSAVFHSNRAACLLQLRPVDHEAVAQECSLALQAEPRFPRALLRRARAARGARPTRARPRRRARAPRTRPRP

SEQ ID NO: 47674 - DNA, 737 bp, Panicum virgatum
  misc_feature: Ceres CLONE 2038082
  misc_feature: Encodes the peptide sequence at SEQ ID NO. 47675
gaagcacagcactgagcactgagcaccagtagtcttcttcctccccattattccattccatcaatcatggccatgaatccagccgtgcctctcgtggtcttggggattctcctctccctccacctacacatcctcccgtgccacgctgccacggacaccatctcagctggccgagagctcgccagcggcgacaagctcctgtccagcaatggcaggttcgcgctcggcttcttccaaaccgagcgcaattcctccaacagcactccaaaatggtacctgggaatttggttcaacacggtccccaaattcactcctgtctgggttgccaaccgtgaaaacccaatcgccaacctctcatcgtgcaagctcctgctttccctcgatggcaaccttctgatcctagatgaccacctggccaatggatccacggtttggtctagcaaatccaactccacaaccaacagcaccgtcgctgctctcctggacaatggaaaccttgtcatacgcagcgcttccaacgcatcccttattttctggcaaagcttcgaccacccaactgatgctcttcttcaaggtgcaaagatcggctggaacaacgccactggtttggtccgccgtattgtctccaccaagaacaccattgaccaagctcccggcgtgtactctttcgagttatctggccacaatggttatacttccatggtttctacgtttaactcgtcgaaaacatattggtc

SEQ ID NO: 47675 - protein, 223 aa, Panicum virgatum
  misc_feature: Ceres CLONE 2038082
  misc_feature (80)..(195): Pfam Name: B_lectin Pfam Description: D-mannose binding lectin
MAMNPAVPLVVLGILLSLHLHILPCHAATDTISAGRELASGDKLLSSNGRFALGFFQTERNSSNSTPKWYLGIWFNTVPKFTPVWVANRENPIANLSSCKLLLSLDGNLLILDDHLANGSTVWSSKSNSTTNSTVAALLDNGNLVIRSASNASLIFWQSFDHPTDALLQGAKIGWNNATGLVRRIVSTKNTIDQAPGVYSFELSGHNGYTSMVSTFNSSKTYW

SEQ ID NO: 47676 - DNA, 694 bp, Panicum virgatum
  misc_feature: Ceres CLONE 2038094
  misc_feature: Encodes the peptide sequence at SEQ ID NO. 47677
aatcgcgaaaaaatctttttctcgcctctcctcgctcctcgccgtttctctctcctcccctccgcctcacccgccgctcgccgcgaaatccacccgcggacgccgcccgctcgccgtggagagcctcggattagagcgcgccccgtcgagggccttcatggacaaatttctagatgcaggcacggagagatttcgaagcaactatgtttgggattggttgatatgatacttgttcacgttgggggatgcagacccccccctctgtgggggttgattgaagaagttaacagcactcttagacgaacttgtgtcctactgatactgaaagtttcttggtttcgaggcaagtagcattactaagagtaggaccttggtggcatagatggatgaactgactgaaaacttcaacgcggtgttgattacaggctcttgagctaccaagtatgtcagcttcaaatgagaagtggatcgatgggctccagttcacatcactgttctggcctccaccccaggatgtgcaacagaagcaggcacaaattttggcctatgttgagtactttggccagtttacagctgacagcgagcaattccctgaagatgtagcacagctcattcaaagttgctacccatcgaaagaaaaacgcttggtagatgaagtgttggcaacttttgttcttcatcatcccgagcatgg

SEQ ID NO: 47677 - protein, 83 aa, Panicum virgatum
  misc_feature: Ceres CLONE 2038094
  misc_feature: Functional homolog of the protein sequence given in SEQ ID NO 50888
  misc_feature: Useful for making plants with modulated flowering time
  misc_feature: Functional homolog of the protein sequence given in SEQ ID NO 50889
  misc_feature: Useful for making plants with modulated biomass
MSASNEKWIDGLQFTSLFWPPPQDVQQKQAQILAYVEYFGQFTADSEQFPEDVAQLIQSCYPSKEKRLVDEVLATFVLHHPEH

SEQ ID NO: 47678 - DNA, 686 bp, Panicum virgatum
  misc_feature: Ceres CLONE 2038096
  misc_feature: Encodes the peptide sequence at SEQ ID NO. 47679
agcaagcgcagcgcgacgcgcgacgcaacaaaggaaaggagccccgagccaagcaaagcgcggcgcccctcccccttctccccagtaatctcccctcttccgcgttccgtccccccccccattccctcctgcagccgccgccgcacgcgcgccgccctcactcggccggcggggtagccagaggaggagccgcctgagatctggtagggcgagggggatggaggccagcgccgggctggtcgccggctcgcacaaccggaacgagctcgtcgtcatccgccgcgatggcgagccagggccgaagccgatgaaccagcagaacgggcaggtgtgccagatttgcggcgacgacgtggggctcaaccccgacggcgagcccttcgttgcctgcaacgagtgcgccttccccatctgccgggactgctacgagtacgagcgccgcgagggcacgcagaactgcccgcagtgcaagacccgcttcaagcgcctcaaggggtgcgcgcgtgtcccgggggatgaggaggaggacggcgtcgacgacctggagaacgagttcaactgggcggacaagcacgactcccagtatgtcgccgagtccatgctccacgcccacatgagctacggccgcggcgccgacttcgacggcgtgccgcaacccttccagcccatccaaaatgttcccctcc

SEQ ID NO: 47679 - protein, 156 aa, Panicum virgatum
  misc_feature: Ceres CLONE 2038096
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Functional homolog of the protein sequence given in SEQ ID NO 51500
  misc_feature: Useful for making plants with altered cell wall content and/or composition
  misc_feature: Useful for making plants with modulated biomass
MEASAGLVAGSHNRNELVVIRRDGEPGPKPMNQQNGQVCQICGDDVGLNPDGEPFVACNECAFPICRDCYEYERREGTQNCPQCKTRFKRLKGCARVPGDEEEDGVDDLENEFNWADKHDSQYVAESMLHAHMSYGRGADFDGVPQPFQPIQNVPL

SEQ ID NO: 47680 - DNA, 724 bp, Panicum virgatum
  misc_feature: Ceres CLONE 2038097
  misc_feature: Encodes the peptide sequence at SEQ ID NO. 47681
aaccaaaccccacccaccacgcagccggcggcggcggcggcaccccttctgtctccgccaccaaacccaagcccgcccccggcgccgcatgcagaagcagcgcagcgagccagcgaccggagacaacggcccaacacgtaatccacgaccagagagagagagagagagagagagaggcagcctaccaaccccggacccgtagccgccgccgcgccgccatccacgagcgcagcagcggcgccctcctcgcgacctcgcctcgccacctggggttggttatttatacgggcgccatcgcgcgacccccgcggcattaggtgtcgcacgctcccctcgcaccaccccgcacccgcacccgcacccgcgcccgcgctgggagcctgggacacggaagggcatggcctcctcagcggcggcggcggctccggcgcgtgccggcttggctccccagaatggaatctttggatctaattcgaagccaccattcgctggtttcatgctcaagacagctcagcaggttggatccctgtcactctgtgtgaggggatctgtttcttcttcaccaaggaagctgttctcccctaaggcagcagcagcagcagcagcaactaaatcaggggacagggtgcgcattgcagtcctaggggccagcggttatactggagctgagatcgttcgtattctggcgaaccaccctcagtttgagataaaagtgatgactgca

SEQ ID NO: 47681 - protein, 108 aa, Panicum virgatum
  misc_feature: Ceres CLONE 2038097
  misc_feature: SWISSPROT Homolog: EC 1.2.1.38 N-acetyl-gamma-glutamyl-phosphate reductase
MASSAAAAAPARAGLAPQNGIFGSNSKPPFAGFMLKTAQQVGSLSLCVRGSVSSSPRKLFSPKAAAAAAATKSGDRVRIAVLGASGYTGAEIVRILANHPQFEIKVMT

SEQ ID NO: 47682 - DNA, 742 bp, Panicum virgatum
  misc_feature: Ceres CLONE 2038111
  misc_feature: Encodes the peptide sequence at SEQ ID NO. 47683
gtgtttccgtcctcctgttctgacttctctgtttctctcgatcccctcccccatcctgccagcctccccgccggccaccgctctccgccgccgccgccctcggcctccagctagttaggcgatatccgtcctcctaccaggttcagttcctctggcgaaacaagccgtgcagacgggagcaagagcgaggagacgagaggagggatgcagcagctgcagccgaagcagatgcactgggtgagggccgactcctccgacttcgggggcgaccgccccgccccccgcagcgggcacacggcggtgagcattggcaagtccaaggtggtcttcttcggcggattcgccgacaagcgcttcctctctgacgtctccgtctacgacgtcgagaataagctatggtactcgcctgagtgtaccgttaatggatcggatgggcaggcaggcccgagcccaagggcgtttcatgtagctgtcgtgattgactgcaacatgttcatatttggtggccgttctgggggcaagcggttaggtgatttttggatgctagacaccgacctatggcagtggtcggagatgactggctttggtgatttgccatcacctcgggagtttgctgctgcttcagccataggaaatagaaaaattgttatgtatggtggttgggatggcaaaaaatggctttcagatgtatacatcatggacacaatgtcactggagtggacagaattagcagttactggat

SEQ ID NO: 47683 - protein, 179 aa, Panicum virgatum
  misc_feature: Ceres CLONE 2038111
  misc_feature (83)..(128): Pfam Name: Kelch_2 Pfam Description: Kelch motif
  misc_feature (134)..(179): Pfam Name: Kelch_2 Pfam Description: Kelch motif
  misc_feature: SWISSPROT Homolog: EC 3.1.3.16 Phosphoprotein phosphatase
MQQLQPKQMHWVRADSSDFGGDRPAPRSGHTAVSIGKSKVVFFGGFADKRFLSDVSVYDVENKLWYSPECTVNGSDGQAGPSPRAFHVAVVIDCNMFIFGGRSGGKRLGDFWMLDTDLWQWSEMTGFGDLPSPREFAAASAIGNRKIVMYGGWDGKKWLSDVYIMDTMSLEWTELAVTG

SEQ ID NO: 47684 - DNA, 659 bp, Panicum virgatum
  misc_feature: Ceres CLONE 2038119
  misc_feature: Encodes the peptide sequence at SEQ ID NO. 47685
aaccatctccccggccccccgccgcgcccatcccggcgccgcctcctcccccgaagccgcgctccctgccactagccgccgccgccgccgcccccactcccgcaccctccgcgggcggggggacactctgcgccgtccagcgggaatttgattcagtcggattccgctgtgatagcggggaaggcgccgatggagcggcaccagtcgatcgacgcgcagctgcggctgctggcgccaggcaaggtgtccgaggacgacaagctagtcgagtacgacgccctcctggtcgaccgcttcctcgacatcctccaggacctgcacggcccgcacctccgcgaattcgtccaggagtgctacgagctctcagcggagtacgagaacgaccgcgacgaggcgcggctcggcgagctcgggagaaagctcaccagcctgccgccgggggactccatcgtcgtcgccagctccttctcgcacatgcttaacctcgccaacctcgccgaggaggtgcagatcgcgcaccgccgccggatcaagctcaagcgtggggacttcgccgatgaggcctcggcgcccaccgagtccgacatcgaggagacgctcaagcgcctcgtctcgcagctcggcaagtcgcgcgaggaggtcttcgacgcgctcaagaa

SEQ ID NO: 47685 - protein, 156 aa, Panicum virgatum
  misc_feature: Ceres CLONE 2038119
  misc_feature: SWISSPROT Homolog: EC 4.1.1.31 Phosphoenolpyruvate carboxylase
MERHQSIDAQLRLLAPGKVSEDDKLVEYDALLVDRFLDILQDLHGPHLREFVQECYELSAEYENDRDEARLGELGRKLTSLPPGDSIVVASSFSHMLNLANLAEEVQIAHRRRIKLKRGDFADEASAPTESDIEETLKRLVSQLGKSREEVFDALK

SEQ ID NO: 47686 - DNA, 695 bp, Panicum virgatum
  misc_feature: Ceres CLONE 2038146
  misc_feature: Encodes the peptide sequence at SEQ ID NO. 47687
atgcttcttctgctttgctcctccgccctccgcctcccgctcgccgtctccgccgcccgcctccgcaccaatcctacccgactcctcttcgccgccctcccctcctcctccccgctccgcgccttctgcccgacggcgcgcccctctcccgccacctgtcccgcccaactctactactcctcctcctcctattccgccgccatgaccgacgacaaccccctcctcctcgccgacttcgacttcccgcccttcgatcgcgtcgagccgcgccacgtccgacccggcatgcgcgacctcctcaccaccctcgagggtgagcttgaggacctcgagaagggcgtccagcccacctgggggaagctggttgagcctctcgagcgcatcaccgacaggctcgaggtcatctggggcatggtccagcacctcaaggccgtcaaggactctgacgacctccgcgccgccgtcgaggaagtccagcctgacaaagtcaagtttcaactcaggctgggccagagcaagcctatctaccaagctttcaaggccattaggaactccccggactgggacaccctaagtgatgctcgcaaacgtatagtagaagaacaactaaaggaagctgttctcagcggagttgcccttgaggatgagcagagggagaaatttaatcagattgaacaggagcttgaaaagttgtc

SEQ ID NO: 47687 - protein, 164 aa, Panicum virgatum
  misc_feature: Ceres CLONE 2038146
  misc_feature: SWISSPROT Homolog: EC 3.4.24.70 Oligopeptidase A
MTDDNPLLLADFDFPPFDRVEPRHVRPGMRDLLTTLEGELEDLEKGVQPTWGKLVEPLERITDRLEVIWGMVQHLKAVKDSDDLRAAVEEVQPDKVKFQLRLGQSKPIYQAFKAIRNSPDWDTLSDARKRIVEEQLKEAVLSGVALEDEQREKFNQIEQELEKL

SEQ ID NO: 47688 - DNA, 662 bp, Panicum virgatum
  misc_feature: Ceres CLONE 2038155
  misc_feature: Encodes the peptide sequence at SEQ ID NO. 47689
gcggatagccagcgagccgggagagcgccggccgccggagtcccgccccgcctcgccccgcccgggcgggcgatcgccggcgcgggcgccacccacccgcgccccgggctcgatcggcgcgccattggggccgctgctcccgcgcggcgggttcttcccagggggggatttcgccgttcccgccgccccggcatctcggtcggattcgttcgctccggcgcgggaggggcttcctcctggcgtgtgggggcgccgcgatgccggaggccgggcactacgggtacaagaagaccgacggcatctgcgacggcgtgtgcggcgagcctgtgtcaaaggcagctctgaccatgtcaaggctaaagtgtgcgctacggggatttgatctcagggcacttatggctctcttgattggtgtgccaatgctgatcttaatgatatatgctcatggtcagaaggtcacatacttcctccggccgatctgggaatctcctcccaagcctttcaagacaatccctcactactaccatgaaaatgtcaccatggagaatctctgcaagctacatgggtggaaagttcgggatacccctcgccgtgtatttgacgctgtactcttcagcaatgagcttgatatccttgaaatccgctggaatgagcttagtccc

SEQ ID NO: 47689 - protein, 134 aa, Panicum virgatum
  misc_feature: Ceres CLONE 2038155
  misc_feature: Functional homolog of the protein sequence given in SEQ ID NO 50780
  misc_feature: Useful for making plants with altered carbohydrate content
MPEAGHYGYKKTDGICDGVCGEPVSKAALTMSRLKCALRGFDLRALMALLIGVPMLILMIYAHGQKVTYFLRPIWESPPKPFKTIPHYYHENVTMENLCKLHGWKVRDTPRRVFDAVLFSNELDILEIRWNELS

SEQ ID NO: 47690 - DNA, 736 bp, Panicum virgatum
  misc_feature: Ceres CLONE 2038182
  misc_feature: Encodes the peptide sequence at SEQ ID NO. 47691
actgctgaggtcagcctaatggtggagctcctcacctccttatccccagcgccgcggcgcccgtctccgactccggcagctcctcgccgggggccgccacctcgcggccgtgcctactcccctcgcggagtgaccctccgcgccgccaccgtcgcggatgccgcgcccggcgccgacgactaccactccaccatccgctccctcaactcccgcggccgccacgtcccccgcaagtcgctcggccagaactacatgctcaactccaaggtgaacgaggagctggcggcggcggcgggggtggaggagggggacgtcgtgctcgagatcggacagggaaccgggtcgctcaccgccgcgctgctcgaggccggcgcaaccgtcttcgccatcgagaaggataagcatatggctacccttgtgaaagataggtttggatctacagaacgactgaaggtcatcgaagaagacatcacaaaatttcacattcgctcccattttcttcctttcatgaaggagaaatatcataacactacaaaacgtgcaaaggttgtttcaaacttaccattcaatgtcagcaccgaagttgtgaaactactactcccaatgggggatattttctctgttgtggtgcttatgcttcaggatgaaacagcagcgcgccttgcagattcttcaatacaaactctagagtaccgacctataaatgtgtttgtgaacttctactcaggtaaacttt

SEQ ID NO: 47691 - protein, 239 aa, Panicum virgatum
  misc_feature: Ceres CLONE 2038182
  misc_feature (67)..(237): Pfam Name: RrnaAD Pfam Description: Ribosomal RNA adenine dimethylase
  misc_feature: SWISSPROT Homolog: EC 2.1.1.48 rRNA (adenine-N(6)-)-methyltransferase
MVELLTSLSPAPRRPSPTPAAPRRGPPPRGRAYSPRGVTLRAATVADAAPGADDYHSTIRSLNSRGRHVPRKSLGQNYMLNSKVNEELAAAAGVEEGDVVLEIGQGTGSLTAALLEAGATVFAIEKDKHMATLVKDRFGSTERLKVIEEDITKFHIRSHFLPFMKEKYHNTTKRAKVVSNLPFNVSTEVVKLLLPMGDIFSVVVLMLQDETAARLADSSIQTLEYRPINVFVNFYSGKL

SEQ ID NO: 47692 - DNA, 619 bp, Panicum virgatum
  misc_feature: Ceres CLONE 2038186
  misc_feature: Encodes the peptide sequence at SEQ ID NO. 47693
acacacctctctgccgtccgcactctcctcgccgagcgggtggtgtgagcctccccgcctgaccgcctatcccctcttccccccctcatctccgccgccgcacccgagaggaagcgaagcccaatgcgcctcctcccgctgctcctgctcctggccctcgccgcgggcgcggcgggcggcggcgcggacgcggacgcgggcgcgctgcgcgcggcgaaggcggcgctctccgaccccaccggcgcgctcgcgtcctggaacgccacctccgcccccgaccactgcgcgtgggcgggggtcacctgcagtgatgccggcgtcgtggtggggctcgacgtctccggactcaacctctccggcgcgctcccgccggcgctctcgcggctgcgcggcctgcagcgcctctccgtcgccgccaacaccttctgcgggcccatcccgccgtcgctagcgcgcctgcagcagcttctccacctcaacctctccaacaacgccttcaacggctccttcccgccggcgctcgcgcgcctccggggcctccgcgtcctcgacctctacgacaacaaccttaccagcgccacgctgccgctcgaggtcacacagatgcccatgctccgcc

SEQ ID NO: 47693 - protein, 165 aa, Panicum virgatum
  misc_feature: Ceres CLONE 2038186
  misc_feature (21)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MRLLPLLLLLALAAGAAGGGADADAGALRAAKAALSDPTGALASWNATSAPDHCAWAGVTCSDAGVVVGLDVSGLNLSGALPPALSRLRGLQRLSVAANTFCGPIPPSLARLQQLLHLNLSNNAFNGSFPPALARLRGLRVLDLYDNNLTSATLPLEVTQMPMLR

SEQ ID NO: 47694 - DNA, 687 bp, Panicum virgatum
  misc_feature: Ceres CLONE 2038193
  misc_feature: Encodes the peptide sequence at SEQ ID NO. 47695
gccgtgccgtgccgccctgttcatcgggtcaaatccctcgtcttcttcctcctcgcttcccctctccacctcctccccactccccctcccccgcctaatccccaatccggaacctcaccgccgagaaccccagatcaaacccctccccccgcccattcacattcccattcctctcgcgcgatccagccttcttccctgtccgccggagggaggacaagaaatcgggccaggaatctcaccagccaccggggggtttcttgatccgggcgcgggattggtcgcgcccaggacccggagcaaggcgaatcaagaacgccccgcggtgccagggccggggagcaatcaagatcgtttttttcccttcttcaccttctcttgagggctgtcggttctgttcccctccccgcgcggcaatgccggatccggccggcggcgccccccgcccccacaccgccgggctggcatgccccgcctgagccaccccgccggccgccgcggctcccgatgctcgtctggtccacgggggcgggagagggagcagcggccgtgcgcgtgggcggccgccagcgaggatgcagatccgcctgtcgccgagcatgaggagcatcaccatctccactagccatggcctgctagactttatgaggctcaaggccgccgcgcggcacttctcctaccgcaccgtct

SEQ ID NO: 47695 - protein, 38 aa, Panicum virgatum
  misc_feature: Ceres CLONE 2038193
  misc_feature: Functional homolog of the protein sequence given in SEQ ID NO 51640
  misc_feature: Useful for making plants with altered cell wall content and/or composition
  misc_feature: Functional homolog of the protein sequence given in SEQ ID NO 51741
  misc_feature: Useful for making plants with altered carbohydrate content
MQIRLSPSMRSITISTSHGLLDFMRLKAAARHFSYRTV

SEQ ID NO: 47696 - DNA, 732 bp, Panicum virgatum
  misc_feature: Ceres CLONE 2038205
  misc_feature: Encodes the peptide sequence at SEQ ID NO. 47697
tgttaaagattataatgagtatgttatgcggaatctggccaggggctacactagaaaggatcttggtgtcagctatgtgaaggaaaaacgtctgcgagttaacatgggattgaaaaacctgcgtgacaaagtaaagcaacaccaagaaaaagtgggagagaagtggagcacagttgcaaaactccaggaagagtgggtggaaaatgcagaccgctgggttgctggcttcctagagaagtttgaggaaggttgccactcaatgggaacagccatcaaggagaggatccaggagaggctcaaggcacaatccagggacttcggtagccttttacagtacgacagagacgatgaagaggaaggtatcatagatgaggatggagagatagctgaggacgatcctcgatcaaatgctgcagctacacaaaatggtgctaactgattgtgttcaatatagaatatctgcgtggctccctgcatctgcttgtgacaaccagattctctcttttatgcaagctgatcattcaccaagttgagaatgcggatatgcatttgtatctcattaaaacatcgtatctttttgtggttgcggagcatattgtgtgatacctgtgctgtttgtgaaccaaaaccagagatctgtcatgttatgtttgttgtcattatagtttgtcactgaaagtagtttatgaactttgatgtgtttgtgcagtcccggttttgtctggatgaaat

SEQ ID NO: 47697 - protein, 145 aa, Panicum virgatum
  misc_feature: Ceres CLONE 2038205
  misc_feature: SWISSPROT Homolog: EC 2.7.7.15 Choline-phosphate cytidylyltransferase
VKDYNEYVMRNLARGYTRKDLGVSYVKEKRLRVNMGLKNLRDKVKQHQEKVGEKWSTVAKLQEEWVENADRWVAGFLEKFEEGCHSMGTAIKERIQERLKAQSRDFGSLLQYDRDDEEEGIIDEDGEIAEDDPRSNAAATQNGAN

SEQ ID NO: 47698 - DNA, 673 bp, Panicum virgatum
  misc_feature: Ceres CLONE 2038210
  misc_feature: Encodes the peptide sequence at SEQ ID NO. 47699
actccccccctcgcctccagatcacaccaccgttgcctccgcctccaaatccattcctaggctggtgctcttgctgcgagcgagctcgggttgggttcagggctctagggtttcgcctctccgctccctgttcacaacttctggagcttggcccgtcgggttagggttggctcgcggctgcgtggtccgtggggtgggggtgcggccgatgcggcgatcgccggcgatcgggaggctgtagcagcggcgggggagggggatctcccgggaggtttctccggcgatggccgcggacgcgctctccatcatcccgggcgccgtgctgcggaacctctccgacaagctctacgagaagcggaagaacgccgcgcttgagattgaggggatcgtgaagcagctcgcaacggctggggagcatgagaagatttcagcggtcatctcgctgctcatcaacgatttcacctactcgccacaagcgaaccatcggaagggtgggttgattggcctcgcagcagttaccgtcggactcaccagtgaggcagctcagcatctcgagcaaattgtgcctcctgtgcttagttctttcttggaccaagatagcagagtgcgctactatgcttgtgaagcactatacaacatagcaaaagttgtaagaggggatttcttcatctac

SEQ ID NO: 47699 - protein, 129 aa, Panicum virgatum
  misc_feature: Ceres CLONE 2038210
  misc_feature (87)..(123): Pfam Name: HEAT Pfam Description: HEAT repeat
MAADALSIIPGAVLRNLSDKLYEKRKNAALEIEGIVKQLATAGEHEKISAVISLLINDFTYSPQANHRKGGLIGLAAVTVGLTSEAAQHLEQIVPPVLSSFLDQDSRVRYYACEALYNIAKVVRGDFFI

SEQ ID NO: 47700 - DNA, 612 bp, Panicum virgatum
  misc_feature: Ceres CLONE 2038230
  misc_feature: Encodes the peptide sequence at SEQ ID NO. 47701
atcacgatctacagttccatcctcccccaatcccccgcctccgccatactgcgccgcacgttctggtccccgcgccgccgtgccgccaggcacgcggatcgccccccacaccgacgcgcgatccccccctcgctctagcttaagctatggatcggctcgcccccgccgcggccgccgccctcatggcgtcgtaccgccccgagcatccaaatccggccgcccgacgcccgcggcccgtcgtgctcctcatgctcgccttcttcgccctccagctcctcatcttcctctccttccgcgccgtgcggccccctcccgccccggcctccgccgccgacactgcggccgccgtgccggtgctggcgtcggcacccgcgcgccgggacgggaatggttcgagctgcggcggcgggctggtgtacgtctacgacctcccggcggccttcaacgaggatctcctgcggatgtgcgacaagctcgcgccgatgtactcgctgtgcccctacctcgccaacgacgggctcgggctccccgcggggggtaccaacctgtcgtcgctcctgctgcgggagctgctcgggtcgtggtacgcgtccgaccagttcgcgctggagc

SEQ ID NO: 47701 - protein, 143 aa, Panicum virgatum
  misc_feature: Ceres CLONE 2038230
  misc_feature: Functional homolog of the protein sequence given in SEQ ID NO 51742
  misc_feature: Useful for making plants with altered carbohydrate content
MASYRPEHPNPAARRPRPVVLLMLAFFALQLLIFLSFRAVRPPPAPASAADTAAAVPVLASAPARRDGNGSSCGGGLVYVYDLPAAFNEDLLRMCDKLAPMYSLCPYLANDGLGLPAGGTNLSSLLLRELLGSWYASDQFALE

SEQ ID NO: 47702 - DNA, 689 bp, Panicum virgatum
  misc_feature: Ceres CLONE 2038274
  misc_feature: Encodes the peptide sequence at SEQ ID NO. 47703
ccctccctcccttgggccgccttggccatctctgatctgagcagccttgccttgctctgactcctcctccgaccactgccgcgtcgccgacccccagatctgccgcagatctgccgcccgccatggactccggcaccgggggcggcggggccacggccatccgcgtgccctaccgccacctccgcgacgccgagatggagctcgtcagcctcaacggcagcccccgcgcaggggaggggccgcccaaggacccgcaccgggacgccgacggggcgcgccaggcggggggcgccggcacctccaggaccaagctcgtgctcgcctgcatggtcgccgcgggcgtgcagttcggatgggcgctgcagctctccctcctcacaccctacatccagaccctaggaatagatcatgccatggcatcatttatttggctctgtggacctataaccggttttgtggttcaaccatgtgtcggtgtgtggagtgacaaatgccgctcaaagtacgggagaagaagaccatttattttggctggatgcttgatgatatgtgctgctgtaactttaatcgggttttctgcagaccttggttacttcttaggagacaccactgagcactgcagaacatacaaaggttcaagatatcgagctgctattgttttcattcttggattctggatgttggacctt

SEQ ID NO: 47703 - protein, 188 aa, Panicum virgatum
  misc_feature: Ceres CLONE 2038274
  misc_feature: Functional homolog of the protein sequence given in SEQ ID NO 50772
  misc_feature: Useful for making plants with modulated heat sensitivity
MDSGTGGGGATAIRVPYRHLRDAEMELVSLNGSPRAGEGPPKDPHRDADGARQAGGAGTSRTKLVLACMVAAGVQFGWALQLSLLTPYIQTLGIDHAMASFIWLCGPITGFVVQPCVGVWSDKCRSKYGRRRPFILAGCLMICAAVTLIGFSADLGYFLGDTTEHCRTYKGSRYRAAIVFILGFWMLD

SEQ ID NO: 47704 - DNA, 697 bp, Panicum virgatum
  misc_feature: Ceres CLONE 2038279
  misc_feature: Encodes the peptide sequence at SEQ ID NO. 47705
aattgccatcactaatcacgacatcgcctctccctccctctctagccttgctctctctctctcctcgggaggcttctccctcctctccttcgccaatcgcccccattgcctttgggctatatagggagggattggattggaaaaggagctcccggcgagtttgaacccatccaaaacctcatctttctctcgtctcccccacacgcttcccgacgccgccgccgccgccgccgtataggatcaaatgcggcgagatctgtgcgcgtgacgccgtcgcccgccagagcctgctccctctgagtttcggaacagggagcgcctggttcaggtcttcaagatctctctggtggttaaggactgtaggacataagcttactttgagtgagctgcagactaccgaaggatggatcagtatgaggtattggagcagattggaaaaggagcatttggttctgcactgttggtgaggcacaaggtggagaagaagaagtatgtgctcaagaagattcgacttgcgcgacaaacggaccgaactcgcaggtctgctcatcaggagatgcagcttattgcaacagtcaggaatccatttatcgtggagtacaaagattcatgggtggaaaagggttgctatgtttgcattgttataggttactgtgagggaggagacatggctgatgctatcaaaaaagccaacggt

SEQ ID NO: 47705 - protein, 97 aa, Panicum virgatum
  misc_feature: Ceres CLONE 2038279
  misc_feature: SWISSPROT Homolog: EC 2.7.11.1 Non-specific serine/threonine protein kinase
MDQYEVLEQIGKGAFGSALLVRHKVEKKKYVLKKIRLARQTDRTRRSAHQEMQLIATVRNPFIVEYKDSWVEKGCYVCIVIGYCEGGDMADAIKKAN

SEQ ID NO: 47706 - DNA, 712 bp, Panicum virgatum
  misc_feature: Ceres CLONE 2038300
  misc_feature: Encodes the peptide sequence at SEQ ID NO. 47707
ctctctctctctccctcacacacacacacacaagagtcaaagaggagaagagcagatctacatctgctccaccgatgagcgcttctcggttcatcaagtgcgtcaccgtgggggacggcgccgtcggcaagacctgcatgcttatctcctacacctccaacactttccccaccgtgagttgattttctttctttctttcttcgccccctttgtacggcttggccatctggcctatatatgagatagaatagactggctcctcctcctcactcacggagtcaggggagaggataaacggacgaaattcatcttctttcgcacattgatttctgcctaatataaataataaccatctggatacagcttagctgattctcccgacaaacaggcataaatacctactcccagatgattttttcgaggaggggaaaaaagaaggaaatcacgcaactgtaatcagggattagaaaaatcgtaccatacccatagtttagcttgatttgcccgctgtcgttggagagccccataggatagggcaggggcggcatgggtgtacagatgtacacccaataatttgggcaaaaaaaattagcatatatatatatatatatatatatatatatatatatatatatatatatatatatatatatatatatatatatatatatatgtatatatatatatatatatatacatatttatatatata

SEQ ID NO: 47707 - protein, 35 aa, Panicum virgatum
  misc_feature: Ceres CLONE 2038300
  misc_feature: Functional homolog of the protein sequence given in SEQ ID NO 50617
  misc_feature: Useful for making plants with modulated nitrogen use efficiency
MSASRFIKCVTVGDGAVGKTCMLISYTSNTFPTVS

SEQ ID NO: 47708 - DNA, 700 bp, Panicum virgatum
  misc_feature: Ceres CLONE 2038301
  misc_feature: Encodes the peptide sequence at SEQ ID NO. 47709
agtcggacaaacccaccccgagcacgcgagccgccgccgccgccggaagctgcacaccagagcaaggcagcgcagacgccgccgggtacctcgctgccgatcctcctcgcctcctcgtcacaattcgttgggttaaaagccctatacggcgaggcttggctcctccggccgcggccgcgtcctccgccgccatgctgtacatcgtgggcctcggcctcggcgacgagcgcgacatcacggtgcgggggctcgacgccgtgcgcggctgctccaagatctacatggaggcctacacctccctcctctccctcggcctggaccccgccgcgctcgccaacctcgagaagctgtatgggaaggagatcacggtcgccgaccgggagatggtggaggagcgcgtcgatcaggtgctgctcgaggctgccgacacagacgtcgccttccttgtggtcggcgacccgttcgggtaacagttgatttgcttcttctttcttcttcttcttcttcttgagttggttgtgccagagtgtctgtagatggtaggtgcgggctcatctctcaaataaagttctggatacaagtgtctgtagatggtatggtaggtgcccaggaacatgaggataccaatgatggagcacaaaccgagcactgtcatgccataatcgtgcattctcagatgtcactcaatagaaatgtcttt

SEQ ID NO: 47709 - protein, 92 aa, Panicum virgatum
  misc_feature: Ceres CLONE 2038301
  misc_feature: SWISSPROT Homolog: EC 2.1.1.98 Diphthine synthase
MLYIVGLGLGDERDITVRGLDAVRGCSKIYMEAYTSLLSLGLDPAALANLEKLYGKEITVADREMVEERVDQVLLEAADTDVAFLVVGDPFG

SEQ ID NO: 47710 - DNA, 642 bp, Panicum virgatum
  misc_feature: Ceres CLONE 2038315
  misc_feature: Encodes the peptide sequence at SEQ ID NO. 47711
aaccaagcaccattcctcacatcttgccaacaccggcaaggtagctagcgaatttatctcggttcttccatttctctctcgccatgcgcctcctccagctcgcccttgttgcgctcgtttcctccctgcacacaccctcatcctccgccgacacagacacactctcacacggccgcgtgctcgtccacgacgagaggcttgtctctagcaatggcaagttcgcgctcggcttctttcaaacgggcaaaaagtcctccagcaacactctcaactcgtacctcggaatatggttcaacaaagtccccaagctaacgccggtgtggaccgctaatggggataacccaagtgccggccctacttcaccggagttcatgatctccagtgatggcaacctgatcatcttggttcaacgtaccatcatttggactgcccaggccaacgtcacaaccaacgacactgttgctgtactggcggacagtggaaaccttattctgaggagttcctcgaactcttctgacatattctggcagagctttgactacccaacggacacacttctttcaggtgcaaagattggtcgaaacatggtcacgggtttcagccaccgttatgtttctagaaagaatgttattgaccaagctc

SEQ ID NO: 47711 - protein, 186 aa, Panicum virgatum
  misc_feature: Ceres CLONE 2038315
  misc_feature (75)..(178): Pfam Name: B_lectin Pfam Description: D-mannose binding lectin
MRLLQLALVALVSSLHTPSSSADTDTLSHGRVLVHDERLVSSNGKFALGFFQTGKKSSSNTLNSYLGIWFNKVPKLTPVWTANGDNPSAGPTSPEFMISSDGNLIILVQRTIIWTAQANVTTNDTVAVLADSGNLILRSSSNSSDIFWQSFDYPTDTLLSGAKIGRNMVTGFSHRYVSRKNVIDQA

SEQ ID NO: 47712 - DNA, 636 bp, Panicum virgatum
  misc_feature: Ceres CLONE 2038328
  misc_feature: Encodes the peptide sequence at SEQ ID NO. 47713
cacggcccgaattccccacctcccacccgccccccatggccgccgccgccctcctcctccgcacccatcaccaccacccctgcaagccgccgacgccgcctcctcccgcggcgcgcgccgccgtcatctgccgcgcggcggcggggacgtcggcgtggccggcgtcggcggcggcgctgcggtcgctggccccgcccacgcggccggagctcctctccctcgacctcccccgctacgacccgtcccgcgcccgccccgtggacctcgccgtcgtcggcggcgggccggcgggcctcgccgtcgtcggcggcgggccggcgggcctcgccgtggcgcagcgcgtcgcggaggcgggcctgtccgtgtgcgccatcgacccgtccccggcgctcgtctggcccaacaactacggcgtgtgggtggacgagttcgaggccatggggctcgcccactgcctcgacaccgtctggccgtcggcctccgtcttcatctccgacgacggcaagaccaagtctctcgaccgcccctacgcccgcgtcgcgcggcgcaagctcaagtccaccatgatggaccgctgcgtcgccaacggcgtcgtcttccaccaggccaaggtcggcaaggccgtccacagcgacg

SEQ ID NO: 47713 - protein, 200 aa, Panicum virgatum
  misc_feature: Ceres CLONE 2038328
  misc_feature: SWISSPROT Homolog: EC 5.3.99.8 Capsanthin/capsorubin synthase
MAAAALLLRTHHHHPCKPPTPPPPAARAAVICRAAAGTSAWPASAAALRSLAPPTRPELLSLDLPRYDPSRARPVDLAVVGGGPAGLAVVGGGPAGLAVAQRVAEAGLSVCAIDPSPALVWPNNYGVWVDEFEAMGLAHCLDTVWPSASVFISDDGKTKSLDRPYARVARRKLKSTMMDRCVANGVVFHQAKVGKAVHSD

SEQ ID NO: 47714 - DNA, 702 bp, Panicum virgatum
  misc_feature: Ceres CLONE 2038332
  misc_feature: Encodes the peptide sequence at SEQ ID NO. 47715
aaaagctagctctgtagaccgcgacaagaaacgtcaaacaatcagctcgtcaccagtcactactcccccacttcccttcccatccacactcgccatggatccgagctcggaagtcatactggattgtccattcttccgcatctacagcgaccggcgcatcgaccgcctgatcggcaccaccactgtgccgcccagcttcgacgccagtaccggcgtcacgtcgaaggaggtcgtcatcgacggcgacaccgacctctacgttcgcctctacctcccggacacggcctcccgatccgatgtcggcagcaagaagctccccgtgctcgtctactaccacggcggcggtttcgtcacccagtcagccgcgtcgccggtgtaccagcgcttcctcaactccctggccgcgagggccggcctgctcctcttctccgtgaattaccgcctcgcgcccgagcacccgctgccggccggctacgaggactccctccgcgcgctcaagtgggcggtctctggtagcggggacccctggctgtcgcagcacggcgacctcggccgcctcttcctggccggcgacagcgccggcgggaacatcgtctacaacgtcgcgatgatggccgcggccgaaggcgaggcgggctcgggcacgccggcggcgggggcgcggatcgagggcgcggtcctgctccacgcggggttcggcgg

SEQ ID NO: 47715 - protein, 202 aa, Panicum virgatum
  misc_feature: Ceres CLONE 2038332
  misc_feature (77)..(202): Pfam Name: Abhydrolase_3 Pfam Description: alpha/beta hydrolase fold
  misc_feature: SWISSPROT Homolog: EC 3.1.1.79 Hormone-sensitive lipase
MDPSSEVILDCPFFRIYSDRRIDRLIGTTTVPPSFDASTGVTSKEVVIDGDTDLYVRLYLPDTASRSDVGSKKLPVLVYYHGGGFVTQSAASPVYQRFLNSLAARAGLLLFSVNYRLAPEHPLPAGYEDSLRALKWAVSGSGDPWLSQHGDLGRLFLAGDSAGGNIVYNVAMMAAAEGEAGSGTPAAGARIEGAVLLHAGFG

SEQ ID NO: 47716 - DNA, 695 bp, Panicum virgatum
  misc_feature: Ceres CLONE 2038343
  misc_feature: Encodes the peptide sequence at SEQ ID NO. 47717
aagacccgctcgccgccgctccaccaccattcccccaaggccccaaccaggcaccagtccacactctccgcagcgccgcgacgcgagcgagcgaccgaccgggctccctgtcctccgctcccctcccgccgcgcgcgctggtccgggcgcgcctgggctgggctggtctcgtctggctctcggttgatgcagcagcggggcctcgcccacaaccgccgctcccgcggcttctcccgctcccgcctcgccgtcgagggcgcctgaacgcacgaaccccccacgcggtgctcaccccaacaaaaagaaaaaccaaagctttctaactagagaacgaaagagaacagagaaaacaccgtcgagatggacgccggccgcgcccccgtgatggccgtcgcgaatgggatcggtgaggtggagcggaaggtgcagaagagctactgggaggagcactccaaggacctcaccgtcgagtccatgatgctcgactccctcgccgccgacctcgacaaggaggagcgcccagagatcctgtcgttgcttccatcttacaaagggaaatcagttcttgagcttggtgctggaataggacgctttactggagacctggcaaaagaagctggccacgttctagcactggattttattgaaagtgtgattaagaagaatgaaagcataaatggacacaacaagaacat

SEQ ID NO: 47717 - protein, 111 aa, Panicum virgatum
  misc_feature: Ceres CLONE 2038343
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MDAGRAPVMAVANGIGEVERKVQKSYWEEHSKDLTVESMMLDSLAADLDKEERPEILSLLPSYKGKSVLELGAGIGRFTGDLAKEAGHVLALDFIESVIKKNESINGHNKN

SEQ ID NO: 47718 - DNA, 706 bp, Panicum virgatum
  misc_feature: Ceres CLONE 2038346
  misc_feature: Encodes the peptide sequence at SEQ ID NO. 47719
gttatcaatcagttcagcatcctccttgttttgtttcttcaccttgcctctgctcctagctcgttacagctgccatccatggggattccttctttctacaagtggcttgtgaccaaatacccaagcatcgtctcctccgcaaaggaggaaccagaggggagccctgatggcgtcatctatgacaacctctacctcgacataaattgcatcatccaccattgcttccacccgcaagacagcatgcatgcagacatagatgtgtgccctccgacgacggtcaccgaggtcttggagtccattttcgagtacttggatcgcctgttccgcatcgtcaggccgagaaggctcctctacttggcagtagatggcgttgctccttgcgccaaaatgaaccgaatgcgacggggacgtttccactctgcttggctagcaagggatgaggcgcttgaagaggaagagatgcggagggaattaagagctcaagggaaggaggtgccaccgccagagatttcagaggtttctgaccccaatgtcatcacaccagggactgaattcatggagaagctatcacaagcgctccaatactacatccgtgccagactgaatactgacccggggtggaaagacataatggtcatactctctgatgcaaatgttcccggagaaggagagcacaagatcatgtcctttcatccgtgcacaacgc

SEQ ID NO: 47719 - protein, 209 aa, Panicum virgatum
  misc_feature: Ceres CLONE 2038346
  misc_feature (1)..(209): Pfam Name: XRN_N Pfam Description: XRN 5'-3' exonuclease N-terminus
MGIPSFYKWLVTKYPSIVSSAKEEPEGSPDGVIYDNLYLDINCIIHHCFHPQDSMHADIDVCPPTTVTEVLESIFEYLDRLFRIVRPRRLLYLAVDGVAPCAKMNRMRRGRFHSAWLARDEALEEEEMRRELRAQGKEVPPPEISEVSDPNVITPGTEFMEKLSQALQYYIRARLNTDPGWKDIMVILSDANVPGEGEHKIMSFHPCTT

SEQ ID NO: 47720 - DNA, 659 bp, Panicum virgatum
  misc_feature: Ceres CLONE 2038378
  misc_feature: Encodes the peptide sequence at SEQ ID NO. 47721
aaccatcacgaatcgctccttccaccgttcgtcaagctcgcgcggtcgcgagcctcccccaaaatccccagaaccctagcagagctcgagacccccccacccccactcgcgatggcgtcggagagcgagacgacggcggtctccaccataacaagcgcgacggtcgacgatggtggcgcgcacgagagcaagcgggagctcggcagtggcgcggccaccagccccggcgtggggcaggaggaggacgaggagatgttagggccgggcccggcgccggcgaagcagcggaagaagcgcccgctccagttcgagcaggccttcctcgacgccctcccctccgccgccatgtacgagaagagctatatgcatcgggacgtcgtcacccacgtcgccgtctctccggccgacttcttcatcactgggagcgcagatgggcacctcaagttttggaagaagaaacctgttgggattgaatttgctaaacattttaggtctcatctcagtcccatcgaaggcctagctgtgagcgttgatggattgctttgctgcacgatatccagcgaccgttctgtgaagatatatgatgttgtaaactatgacatgatgttcatgatgcgtctcccatttgttcctggggctattgagtgggttcatcgaga

SEQ ID NO: 47721 - protein, 182 aa, Panicum virgatum
  misc_feature: Ceres CLONE 2038378
  misc_feature (120)..(158): Pfam Name: WD40 Pfam Description: WD domain, G-beta repeat
  misc_feature (77)..(114): Pfam Name: WD40 Pfam Description: WD domain, G-beta repeat
  misc_feature: SWISSPROT Homolog: EC 5.2.1.8 Peptidylprolyl isomerase
MASESETTAVSTITSATVDDGGAHESKRELGSGAATSPGVGQEEDEEMLGPGPAPAKQRKKRPLQFEQAFLDALPSAAMYEKSYMHRDVVTHVAVSPADFFITGSADGHLKFWKKKPVGIEFAKHFRSHLSPIEGLAVSVDGLLCCTISSDRSVKIYDVVNYDMMFMMRLPFVPGAIEWVHR

SEQ ID NO: 47722 - DNA, 704 bp, Panicum virgatum
  misc_feature: Ceres CLONE 2038390
  misc_feature: Encodes the peptide sequence at SEQ ID NO. 47723
actctcccccactccgattcttgcctgggaatcacggccggatcctgccaaggaaataagcgagaggtgtcagggtgatgcttcaattgtgaagtagtgttatctacaaaggagaggctagattcattcgcacaggcgctcgatgacagatcattttgcttctctgacggctcttacaatcttgttgctaagtgtcacttgtctcggttctgaactcgatgtgcaatgcttgagagatgtacagcgttcagtgatcgaccctaatggtgtactcaattccacatggactttcagaaatagcagtaagggtttcatatgccaatttactggtgtggagtgctggcacccggatgagaaccgggttcttgctttgcgcctcagcaaccttggtcttcggggtccatttcctcaaggtcttcagaattgtaccagtatgacggcgctggatctgtcaagtaacagcttttcagggtcgatccctctagatatctcccggcaagtgccatttttgacatcgctggacctctcaaataatggcttttcaggcccaatcccagtaaatatctcgaatatgacatacctaaacacccttaatctccagcacaaccagttgagcggcttagttccagggcagttcaatgcactttctcggttaacaacgttcagtgttgcagacaaccagctaatagggcctattccatctg

SEQ ID NO: 47723 - protein, 187 aa, Panicum virgatum
  misc_feature: Ceres CLONE 2038390
  misc_feature: SWISSPROT Homolog: EC 2.7.11.1 Non-specific serine/threonine protein kinase
MTDHFASLTALTILLLSVTCLGSELDVQCLRDVQRSVIDPNGVLNSTWTFRNSSKGFICQFTGVECWHPDENRVLALRLSNLGLRGPFPQGLQNCTSMTALDLSSNSFSGSIPLDISRQVPFLTSLDLSNNGFSGPIPVNISNMTYLNTLNLQHNQLSGLVPGQFNALSRLTTFSVADNQLIGPIPS

SEQ ID NO: 47724 - DNA, 748 bp, Panicum virgatum
  misc_feature: Ceres CLONE 2038393
  misc_feature: Encodes the peptide sequence at SEQ ID NO. 47725
acgctacctgctgctgcggtcgcctcccacgccacctgaccaacggtgaggtgggggagtatttaactgacggggcgaggcgaggatgcgagctctcgcggcagcagcaactgcagtggcggcgcctactcccgcgcgcctccgtctccgcctcccgctcgcgccccgcgccccgcgctccggtcattgtagagcagcttcttcctccaggcttctgcggatctcctgcagcgccaccaccatgggagacgagacctcgacctccgttcctgcccaggagcagggacctgctgtgggtgctgggagtgtcaagcaacagctctccaagctggtcatttcatccctccgggctacggtgcctgaagtggaggtagaaccgatggttgaagtttcagcaaagtttgctgactaccagtgcaacaatgctatgggattatggtcaaagattaaaggatctagaaccagtttcaaaaaccctaatgctattggacaggccattgcaaagaacttgccttcctctgacattattgagtccacatctgtcgctggacctggttttgtgaatattactttatcgaaccgctgggttgctaagagaatacaagatatgcttgtcaatggtattaatacttgggcacctattctgccagtaaagagggcagtgattgatttttcgtcacctaacattgcaaaggaaatgcatgttggacatttaaggtctaccataattggagatacattagcacgc

SEQ ID NO: 47725 - protein, 168 aa, Panicum virgatum
  misc_feature: Ceres CLONE 2038393
  misc_feature (25)..(111): Pfam Name: Arg_tRNA_synt_N Pfam Description: Arginyl tRNA synthetase N terminal domain
  misc_feature: SWISSPROT Homolog: EC 6.1.1.19 Arginine--tRNA ligase
MGDETSTSVPAQEQGPAVGAGSVKQQLSKLVISSLRATVPEVEVEPMVEVSAKFADYQCNNAMGLWSKIKGSRTSFKNPNAIGQAIAKNLPSSDIIESTSVAGPGFVNITLSNRWVAKRIQDMLVNGINTWAPILPVKRAVIDFSSPNIAKEMHVGHLRSTIIGDTLA

SEQ ID NO: 47726 - DNA, 634 bp, Panicum virgatum
  misc_feature: Ceres CLONE 2038397
  misc_feature: Encodes the peptide sequence at SEQ ID NO. 47727
agcacacgcaaataatctccatcaggccaggccaccatcacatcagcgatcgatcgatcaagtttggcttgccatgcccatgacactcgctgccgtggccgccgaggtgcgcgcgcagcgcggcatcgccctccccctcatcgccatgaacctcacctggttcgccaagctcgccgtcaccaccgccttcctgggccgcctcggcgacctggagctggccgccggcacgctcggctacagcttcgccaatgtcaccggcttcgccgtcctcaccggcctctgcggcgccatggagcccatctgcggccaggcgcacggcgccaggaacgtgcccctcctccgccggacgctcgtcatggccaccctcctgctcctcgcagcctccgtccccatcgcgctcctctgggtgcgcgtcgacgccgtcctcctgcgcttcggccagcagcccgacatcgctgccacggccaggacctacgtgctctgcctcctcccggacctcgccgtcacctccttgctcagcccgctcaaggcctacctcagctcgcaggaggtgacgctccccacgctgctggccgccgccctgggcctcgccctccacatcccgctcaccatctgcctctccgcgaggatgggc

SEQ ID NO: 47727 - protein, 186 aa, Panicum virgatum
  misc_feature: Ceres CLONE 2038397
  misc_feature (21)..(181): Pfam Name: MatE Pfam Description: MatE
MPMTLAAVAAEVRAQRGIALPLIAMNLTWFAKLAVTTAFLGRLGDLELAAGTLGYSFANVTGFAVLTGLCGAMEPICGQAHGARNVPLLRRTLVMATLLLLAASVPIALLWVRVDAVLLRFGQQPDIAATARTYVLCLLPDLAVTSLLSPLKAYLSSQEVTLPTLLAAALGLALHIPLTICLSARM

SEQ ID NO: 47728 - DNA, 746 bp, Panicum virgatum
  misc_feature: Ceres CLONE 2038398
  misc_feature: Encodes the peptide sequence at SEQ ID NO. 47729
aacccccagttctcatcctccctcctaagcgcaactgctgctagtcaacaccctgagtcttccctcgatttgcggcgaaagcccgcgttttttttcttctttggtttagttttggagccgcgaggttcttgattccgctgctggttttggtgcacttgtctcacgattggtggactaaagctgccgcctttcttgcattttgcgctgttcttggagcgattcctgcctgtcctgctcgagctcagcttgggctgttgcaacgcgtcgtcctcgggcattacaggttggcttttggtggtttcttgtttcaagaactaaagcttcttgattactgttctagttcattgcagatggatggttgtgattgcattgagccactttggcaggctgatgatctcctaatgaagtatcagtacatatctgacttcttcatcgcacttgcgtacttctcaatccctttggagctcatatactttgttcagaagtctgctttcttcccgtaccgatgggtgctcatacagtttggtgctttcatcgttctctgtggggcaacccacttgataaacatgtggactttcaccacgtataccaagactatagctgtggtattaacggtggcaaaagtagcgacagcaattgtatcatgcataacagctttgatgctagttcatatcattcctgattttgtgagtgtcaaattgagggagcggttcctaaaggctaaagctgaggagcttgatagggag

SEQ ID NO: 47729 - protein, 131 aa, Panicum virgatum
  misc_feature: Ceres CLONE 2038398
  misc_feature: SWISSPROT Homolog: EC 2.7.13.3 Histidine kinase
  misc_feature: Functional homolog of the protein sequence given in SEQ ID NO 51743
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
  misc_feature: The sequence is a functional homolog of SEQ ID NO 6 in US patent 7105654
MDGCDCIEPLWQADDLLMKYQYISDFFIALAYFSIPLELIYFVQKSAFFPYRWVLIQFGAFIVLCGATHLINMWTFTTYTKTIAVVLTVAKVATAIVSCITALMLVHIIPDFVSVKLRERFLKAKAEELDR

SEQ ID NO: 47730 - DNA, 700 bp, Panicum virgatum
  misc_feature: Ceres CLONE 2038400
  misc_feature: Encodes the peptide sequence at SEQ ID NO. 47731
acattatctaactgaaaagtctatgtttgtatctccaaaactgtttgccttctttgattcttctctccctgggaccttaaaggggtgccactgggtattgctatatagcacctggaagcatgggatatctctaagaacacttcttcgtaaaactgagaatattcagggtccatgcctattgattgttggggatatgcaaggggctgtgtttggtggcttattgaacagtcctttgcggcctacagagaaaaggaaataccaggtaaaaacagattctactatttgtgcttgaatgatgctttggcgtttggaggtggtggaagcttcgcattgtgtgttgatgaagatttgttacatggaagcagtggatcatgcgatacatttggaaattcatgcttggcgtatactccagagtttgaactaaagaatgttgagctgtgggggttcacgcactcgtggagccgttcgaagtagctgatgctagttgtccccaaactacgaccgtcagctgtattcaatacttcaatccggtgtatacttgtctaaaaaaaaaagaaaaaagaaagatacagtgtactccacacgaccgtcagctgtggttaatccagtctagtataaaaagggaaaaagaaagaaagatacagtgtacttgttcgttgtgatgccagtattcttccccatatttaacatcgttttcgtt

SEQ ID NO: 47731 - protein, 96 aa, Panicum virgatum
  misc_feature: Ceres CLONE 2038400
  misc_feature: Functional homolog of the protein sequence given in SEQ ID NO 50650
  misc_feature: Useful for making plants with altered protein content
HYLTEKSMFVSPKLFAFFDSSLPGTLKGCHWVLLYSTWKHGISLRTLLRKTENIQGPCLLIVGDMQGAVFGGLLNSPLRPTEKRKYQVKTDSTICA

SEQ ID NO: 47732 - DNA, 665 bp, Panicum virgatum
  misc_feature: Ceres CLONE 2038414
  misc_feature: Encodes the peptide sequence at SEQ ID NO. 47733
taactcctggttattgtgaaatgtctcctgtgatggccaatcaattttcgatctttgtcactaggggaggaaacaagaaatatgcttcagttttggcccctggccaacttgatggtttgaagaaatctagcgatgatggtatatcgtcctgggattggaaattaaagggcgatcgttcgacataccatgctttgtttcctcgggcatggactgtttatgatggtgaaccagatccagagctgaaagtatcttgccgtcaaatatcgccattcattccacacaactacgaagagagcagtcttcctacctctgtttttgtatacactctagtgaataccggaaaggaaagggcaaaagttagcctattgatgacttgggcggtattagctactacgatctggtgtttggagctttgcgctgaatttggatttttatgatatattagatctaatcacgttttattcttgattttctactagaattccattggaggactttcacatcatactggtggccatgtaaatgagccattcataggagaaaatggagtttctggcgttcttctacatcacaagacagccaataataatcctcctgtaacatttgcaattgcggcatgtgaaaaccaaaatgtaaatgtcacagtattgcctgttttttgggct

SEQ ID NO: 47733 - protein, 144 aa, Panicum virgatum
  misc_feature: Ceres CLONE 2038414
  misc_feature: SWISSPROT Homolog: EC 3.2.1.45 Glucosylceramidase
TPGYCEMSPVMANQFSIFVTRGGNKKYASVLAPGQLDGLKKSSDDGISSWDWKLKGDRSTYHALFPRAWTVYDGEPDPELKVSCRQISPFIPHNYEESSLPTSVFVYTLVNTGKERAKVSLLMTWAVLATTIWCLELCAEFGFL

SEQ ID NO: 47734 - DNA, 694 bp, Panicum virgatum
  misc_feature: Ceres CLONE 2038426
  misc_feature: Encodes the peptide sequence at SEQ ID NO. 47735
aatattcttcagcttcagtttactatacagaggctcgaggaaactacagttgcgaaggagaatttgctgttgagagagaaggagcagaatgatgcaacaacaaaagcgcacattgaaattcaagaaaaatatgaagaattactaaaaaaatttgttgatgttgacacgaaaatcgaccttcttcaaggtaccatcgaaaggtttggagaaaatacaacaacaaaggatgctctgttgctatcagagagacatgaaaaggatgcaattaaaaaggcacttactgaggccgacgagaaaaatgaagagttgctgatgaaagttgaagatgctaatgaaaaaattgaacaccttcaaactatgattaataagcttgaagataatatagctgcaaaagatgtttctttggaagctgcaacaaaggaaaatgacacaatcaggaaatctcttgccaaagctcaagagcgaaatgatgaattactcaagaaaataagtgacagtgaatacaggatccacttacttcaagacacagtacaaaagcttcaagtagatgcaatatcaagattgtcttcttttgtaatggaaaaacaagaaagtgatgctgcaaagagagctgttactgaagctcatgaaagaaatgaagatttactgaagagaaatgaggacctcctcaacaggaatgatgctttgattaaga

SEQ ID NO: 47735 - protein, 231 aa, Panicum virgatum
  misc_feature: Ceres CLONE 2038426
  misc_feature: SWISSPROT Homolog: EC 2.7.11.1 Non-specific serine/threonine protein kinase
NILQLQFTIQRLEETTVAKENLLLREKEQNDATTKAHIEIQEKYEELLKKFVDVDTKIDLLQGTIERFGENTTTKDALLLSERHEKDAIKKALTEADEKNEELLMKVEDANEKIEHLQTMINKLEDNIAAKDVSLEAATKENDTIRKSLAKAQERNDELLKKISDSEYRIHLLQDTVQKLQVDAISRLSSFVMEKQESDAAKRAVTEAHERNEDLLKRNEDLLNRNDALIK

SEQ ID NO: 47736 - DNA, 700 bp, Panicum virgatum
  misc_feature: Ceres CLONE 2038453
  misc_feature: Encodes the peptide sequence at SEQ ID NO. 47737
atctcgcaccctcgccgctgctgctgcaattaacgccaccgccggccaacaacccgaaacctacctccgccgtggtcgccgcaaccgccgccaacatggcgagccaaggggagccgtcggcctccgcttcggatccgaagggcaagaaggattactccacggccatcttggagcggaagaagtcgccgaaccgcctggtcgttgatgaggccaccaacgacgacaactccgtcgtcgctctccacccggataccatggagaggctgcagctcttccgcggcgataccgtgcttcttaagggtaagaagaggaaagacactatatgcattgtccttgcggatgaaacctgtgaggaaccaaaggttcggatgaacaaggttgtccgccagaacctgagggtgaggcttggtgatgtggtttccgtccatcagtgccaggatgtgaaatatgggaagcgtgtacacattcttccaattgatgatacagttgaaggcattacagggaacctgtttgatgtcttcttgaaaccatacttcctagaagcgtaccgtcctgtgaggaaaggagaccttttccttgtcaggggtggaatgagaagtgtggagttcaaagtaatagagactgatcctgctgagtattgcatcgttgccccagatactgaaatattttgtgatggggagcctattaagagggaggatga

SEQ ID NO: 47737 - protein, 201 aa, Panicum virgatum
  misc_feature: Ceres CLONE 2038453
  misc_feature (30)..(116): Pfam Name: CDC48_N Pfam Description: Cell division protein 48 (CDC48), N-terminal domain
MASQGEPSASASDPKGKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDVFLKPYFLEAYRPVRKGDLFLVRGGMRSVEFKVIETDPAEYCIVAPDTEIFCDGEPIKRED

SEQ ID NO: 47738 - DNA, 626 bp, Panicum virgatum
  misc_feature: Ceres CLONE 2038463
  misc_feature: Encodes the peptide sequence at SEQ ID NO. 47739
acgaggccacgagggaaaagtttttttccctccccctggtagcacgcgcagcgaagcaaccccagcagcagcaaaagaggcgagccttttgctcgccgctgccacagccaccacctcgtctcggcctcgcgcgcgcgcgcgcgggatctcgcgctcgctcgccgcgcgcaccgaggagggagggcgctcccgtacgcagggtttggaggcgcggggcgatccggcggcgatggggagccgggtcaaggaggacgagaggcacgagcggatcatacggggcctgctcaagctgcccgccaacaagcgctgcatcaactgcaacaacttgggaccacaatatgtctgcacaaatttctggaccttcgtttgtaccaattgcagcggagctcatcgggagttcacacatcgagtgaaatcagtttccatggccaaatttaccgcacaagaagttacggcccttcaaggaggaaatgagcgtgctagagaagtattcttcaaggaatgggatcctcaacgcaatggataccctgacagcagtaatgcagataaattgagaaacttcattaagcatgtgtatgtggaacggagatacacaggagaaagaattactgataggccacctaggg

SEQ ID NO: 47739 - protein, 132 aa, Panicum virgatum
  misc_feature: Ceres CLONE 2038463
  misc_feature (12)..(129): Pfam Name: ArfGap Pfam Description: Putative GTPase activating protein for Arf
MGSRVKEDERHERIIRGLLKLPANKRCINCNNLGPQYVCTNFWTFVCTNCSGAHREFTHRVKSVSMAKFTAQEVTALQGGNERAREVFFKEWDPQRNGYPDSSNADKLRNFIKHVYVERRYTGERITDRPPR

SEQ ID NO: 47740 - DNA, 652 bp, Panicum virgatum
  misc_feature: Ceres CLONE 2038465
  misc_feature: Encodes the peptide sequence at SEQ ID NO. 47741
cgcggctcaatcaccagcttcccccgcttgggaagccgttcctccgctccgcctcctacctcaaggaggccctcctcctcgcgctcgccgaaggttaccacggcacctgccgcctcacatcaccactggaagttgccctcaagctcgcggcgtacaagtctttctctgacctgtcgcccgtgctccagttcaccaacttcacggcaacgcaggcgcttcttgacgaaattgcaggcagcacggcttcctgcatccatgtcattgattttgatctcggcgttggaggccagtgggcatccttcttgcaggagcttgcacaccgccgcggcgcaggtggtgcagctctgccgttcgttaagctcactgcctttgtatcagctgcttcccaccatccactggagctgcgtcttacccgggataacatcgcacagtttgctgcagaccttggaattgcctttgagttcaatgctgtcagtgcggatatgatcaatcctgcggagcttatttctaccactggtgatgaagttgtagccgttgtcctccctgttggttgctctgctcgtgcaccaccgctgccggcaatccttcggttggtgaaacagcttagccctaagattgtggttgccatagaccatggcggtgatcgtgctga

SEQ ID NO: 47741 - protein, 216 aa, Panicum virgatum
  misc_feature: Ceres CLONE 2038465
  misc_feature (1)..(216): Pfam Name: GRAS Pfam Description: GRAS family transcription factor
RLNHQLPPLGKPFLRSASYLKEALLLALAEGYHGTCRLTSPLEVALKLAAYKSFSDLSPVLQFTNFTATQALLDEIAGSTASCIHVIDFDLGVGGQWASFLQELAHRRGAGGAALPFVKLTAFVSAASHHPLELRLTRDNIAQFAADLGIAFEFNAVSADMINPAELISTTGDEVVAVVLPVGCSARAPPLPAILRLVKQLSPKIVVAIDHGGDRA

SEQ ID NO: 47742 - DNA, 703 bp, Panicum virgatum
  misc_feature: Ceres CLONE 2038486
  misc_feature: Encodes the peptide sequence at SEQ ID NO. 47743
acccacaccacgcctccactcactcccacttcaggcttccacccacattgccaggcagctgccggccggccacctcctgtggagtcgcgcgccgctcctggactggaagatggagaacccccggtggtccctcgccgccctcgcccccctgctgctgctgctcctgtccatgtccatgtccctgccgccccgcgccgcggcgtacctccaggagcgcaagaactacatcgtgcacctccggccgcgcgacggcggcggcggctccgtcgaggagtggcaccgctcgttcctgccgcaggcggcggggccggactccgcggccgacgccgacggcggcccgcggatcatctactcctacagcgacgtgttccccggcttcgcggcgcggctgacggacgaggaggcggacgcgctgcgggccaccgacggctgcgtgcgcctgtacccggaggtgttcctgccgctggccaccacccgctcgccgggcttcctcggcctccacctcgggaacgagggcttctggagccgctccggcttcggccgcggggtggtgatcgggatcctcgacaccgggatcctgcccagccacccgtccttcggcgacgacgggatgcagccgccgcccaaggggtggaagggcgcctgcgagttcaaggccgtcgcccggggcggatgcaacaacaagatcatcggggcgcgggcg

SEQ ID NO: 47743 - protein, 197 aa, Panicum virgatum
  misc_feature: Ceres CLONE 2038486
  misc_feature (37)..(120): Pfam Name: Subtilisin_N Pfam Description: Subtilisin N-terminal Region
  misc_feature: SWISSPROT Homolog: EC 3.4.21.25 Cucumisin
MENPRWSLAALAPLLLLLLSMSMSLPPRAAAYLQERKNYIVHLRPRDGGGGSVEEWHRSFLPQAAGPDSAADADGGPRIIYSYSDVFPGFAARLTDEEADALRATDGCVRLYPEVFLPLATTRSPGFLGLHLGNEGFWSRSGFGRGVVIGILDTGILPSHPSFGDDGMQPPPKGWKGACEFKAVARGGCNNKIIGAR

SEQ ID NO: 47744 - DNA, 718 bp, Panicum virgatum
  misc_feature: Ceres CLONE 2038495
  misc_feature: Encodes the peptide sequence at SEQ ID NO. 47745
acttggcgccgcgacacacgcgcagcacacagccatgggacgccgcgcgcgctcctccccccacgtcgccgcgccggcggcggccctcctcgtgcacctgctgacgctggcgccgcaccacgccgccgcggcgtccgacccgccctacacctgcggcgccggcgcgccgcccaacatcccgttctgcgacacgggcctgccgatcgaccggcgcgtgggcgacctcgtcgcgcggatgacggtggcggagaagatctcgcagctcggcgacgagtccccggccgtccccaggctcggcgtgccggcgtacaagtggtggtccgaggcgctgcacggcgtgtcggaccagggccgcggcgtccacctcagcggcccgctccgcgccgtcaccagcttcccgcaggtcatcctcaccgccgcgtccttcaacccgcacctctggtaccgcatcggccaggtgatcggcgtggaggctcgggcggtgtacaacaacgggcaggcggaggggctcacgttctgggcccccaacatcaacgtgttccgggacccgcggtggggcaggggccaggagacccccggcgaggacccgacggtggccggcaagtacgccgccgtcttcgaccgcggcgtgcagggctacggcatctgcagccccatcaactccaccgacctcgaggcctccgcctgctgcaagcacttcaccggctacgacctcgag

SEQ ID NO: 47745 - protein, 227 aa, Panicum virgatum
  misc_feature: Ceres CLONE 2038495
  misc_feature (81)..(224): Pfam Name: Glyco_hydro_3 Pfam Description: Glycosyl hydrolase family 3 N terminal domain
  misc_feature: SWISSPROT Homolog: EC 3.2.1.21 Beta-glucosidase
MGRRARSSPHVAAPAAALLVHLLTLAPHHAAAASDPPYTCGAGAPPNIPFCDTGLPIDRRVGDLVARMTVAEKISQLGDESPAVPRLGVPAYKWWSEALHGVSDQGRGVHLSGPLRAVTSFPQVILTAASFNPHLWYRIGQVIGVEARAVYNNGQAEGLTFWAPNINVFRDPRWGRGQETPGEDPTVAGKYAAVFDRGVQGYGICSPINSTDLEASACCKHFTGYDL

SEQ ID NO: 47746 - DNA, 682 bp, Panicum virgatum
  misc_feature: Ceres CLONE 2038513
  misc_feature: Encodes the peptide sequence at SEQ ID NO. 47747
gtgcgtctctttcacagcagtcggctctggatctgagggtctctctcacactcaagagcctagacggaacatggcaggaggaagatccagctcgatgccggaaagagattgatcccaggagcggcatctccatcggacaggaaacagaatagcagagaactttctactgctccggatccatggtcaagggcacccacgggggcaaactgaaagatggtgccggtgctgctgcctcctccggcagtggtgtggcggccgaggcatccaccagcacggctgctatggctgaaacctcaagaacagcagcggcacggcgacaacctccgagcggtgtggtgaggagagggcgtctatctccttcggctttgtctgttgctgtgtttctatcgaagaaggggaaacttgtgcgaaaaaaggcaggcaacgcaagcggactgaataggctggggagcgtgttagcggatccatgtgtacaatcacacagatttacactagcagagttgagaaagatcacacatgatttctctgatgagcaactacttggcgaaggcgctttcggcaaggtgtataagggagtcctacaaaatggggatacaattgctgtgaagaggctgaagttgacaatggaagtaattcatcaggataagcaatatgagaatgaagcccgccatctgatgaggct

SEQ ID NO: 47747 - protein, 167 aa, Panicum virgatum
  misc_feature: Ceres CLONE 2038513
  misc_feature: SWISSPROT Homolog: EC 2.7.11.1 Non-specific serine/threonine protein kinase
MVKGTHGGKLKDGAGAAASSGSGVAAEASTSTAAMAETSRTAAARRQPPSGVVRRGRLSPSALSVAVFLSKKGKLVRKKAGNASGLNRLGSVLADPCVQSHRFTLAELRKITHDFSDEQLLGEGAFGKVYKGVLQNGDTIAVKRLKLTMEVIHQDKQYENEARHLMR

SEQ ID NO: 47748 - DNA, 697 bp, Panicum virgatum
  misc_feature: Ceres CLONE 2038516
  misc_feature: Encodes the peptide sequence at SEQ ID NO. 47749
ctcctagctctcccccatcctccacttctttcccaaaaatatggcggccgccgctgccgttctccgcgccgccgtccgccggtgtcgtccggctactgcggccctgctgcaccaccgtcccatcccttccgcccggagcctaccgtcgtctccgcctctcggtcgagcgcttcctccgctcccgcggctgccgttctccgccggactcggctactccactgcctccgaggagtttgtgccccccgtgaggcccaagggcaaggccaaggccaggaagaacccaatgaagcagtcgcgcttcgacttcaccaaggtggacgccgcgcttctgcccaccgtcatcctcgttggccgccccaacgtcggcaagtcagcccttttcaacagatttatacggaggagggaggcgttggtgtacaatactcctggggatcatgtcactcgtgatatccgtgaaggaattgcgaagcttggagatctccgtttccgtgtgcttgactcagctgggctcgagacagcagcaacttctggaagcattctcgctcggacagcggacatgacagggaatgtgttagctaggtcccaatttgccattttcttgattgatgtgagggatggcctacagccgctggatcttgaggttgggcaatggctgcgtaagcatgcatctgggatacatacccttgttgcaatgaac

SEQ ID NO: 47749 - protein, 218 aa, Panicum virgatum
  misc_feature: Ceres CLONE 2038516
  misc_feature (98)..(211): Pfam Name: MMR_HSR1 Pfam Description: GTPase of unknown function
MAAAAAVLRAAVRRCRPATAALLHHRPIPSARSLPSSPPLGRALPPLPRLPFSAGLGYSTASEEFVPPVRPKGKAKARKNPMKQSRFDFTKVDAALLPTVILVGRPNVGKSALFNRFIRRREALVYNTPGDHVTRDIREGIAKLGDLRFRVLDSAGLETAATSGSILARTADMTGNVLARSQFAIFLIDVRDGLQPLDLEVGQWLRKHASGIHTLVAM

SEQ ID NO: 47750 - DNA, 721 bp, Panicum virgatum
  misc_feature: Ceres CLONE 2038526
  misc_feature: Encodes the peptide sequence at SEQ ID NO. 47751
agtcccacaagctgtacacaacccgaaacgaattcccacggcccaaggcaacctgcgcaccgccatcaccgacgccaccgccgccgcaatcccgattcccgcacacacctccctcctcctcctcccaaccccaatcaaaggcaccgccgaatcgaacccactagcggcgctcgtcttaatccggtagcggtggttggacccgcgccctgctgccgtcgacgtcgagcgagccacgcctcggagttcgcggggggcatcatcaattcaatggcgtcggagtcgcgtcgccgggcatagggagcctgaggtgcccacgcgatcagttgtcaccccgctgctcctctctccgcggcgcattttgttgtctcgaggcatgcatacgtcgccggagatgaatggccgggctcggcggccggcggcggcgcacggcgcaagggccgccgcgaagagcgccagtagagtgatggacaaggatccgaggaaggccgcgacgccggtgaagggaccggcggccaacgcgggcaccaggggcgccatgaacagaattcagtcgaggagagaccggaagctcgcgctgcagcaagacgtcgataagctgaagaagaagctgcgccacgaggagaacgtccacagagctctggagcgggcgttcacgcggccgctcggcgccctgcctcgcctgccgccgtatctgccgtctcagacgctagctcttctcgcg

SEQ ID NO: 47751 - protein, 109 aa, Panicum virgatum
  misc_feature: Ceres CLONE 2038526
  misc_feature: Functional homolog of the protein sequence given in SEQ ID NO 51289
  misc_feature: Useful for making plants with modulated biomass
  misc_feature: Useful for making plants with modulated flowering time
MNGRARRPAAAHGARAAAKSASRVMDKDPRKAATPVKGPAANAGTRGAMNRIQSRRDRKLALQQDVDKLKKKLRHEENVHRALERAFTRPLGALPRLPPYLPSQTLALL

SEQ ID NO: 47752 - DNA, 693 bp, Panicum virgatum
  misc_feature: Ceres CLONE 2038538
  misc_feature: Encodes the peptide sequence at SEQ ID NO. 47753
tccgatcttgcggattgattggggcacgacggcacccgtgacatatttccatcccggcggcgacggctgggcgagcggcggcgcccttctccagttcttcgttgaacccttctctggcgacgagcatccaccagattttaggctcgttaatcaccatggctcatcaaaagcgtgaaggcagctccaccgacgatgattgtgcatccaagcgcctgaaaggcaccgacactgcttctgaaatgaggggcagtgtagaagctagtgtttcacaagaaacgggttctgaagtaacgagaacctgccaaaaggaaagcgaggtgccatcggaaaaatgtgtttcggatgggaaagccgctgcaaactctaaaaattcaggcgagcaaaacatggtactaactgcacttgaggcagatgctgcggaagacaagggttgcaggcacactatggaggacgcctgggtgctgctccccagtgctggtgcggaatctccaggaagtttgaggtgcgcgcattttgcgatttatgatgggcatggtggtcgtttggcagcggattttgcacagaagcatttgcatcagaatgtcatcgctgcaggattaccacgtgagttgatggatgttaaagctgcaaagaaggccataattgaaggtttccgtcgaactgatgaatccttactacaagaaagtactaaag

SEQ ID NO: 47753 - protein, 179 aa, Panicum virgatum
  misc_feature: Ceres CLONE 2038538
  misc_feature: SWISSPROT Homolog: EC 3.1.3.16 Phosphoprotein phosphatase
MAHQKREGSSTDDDCASKRLKGTDTASEMRGSVEASVSQETGSEVTRTCQKESEVPSEKCVSDGKAAANSKNSGEQNMVLTALEADAAEDKGCRHTMEDAWVLLPSAGAESPGSLRCAHFAIYDGHGGRLAADFAQKHLHQNVIAAGLPRELMDVKAAKKAIIEGFRRTDESLLQESTK

SEQ ID NO: 47754 - DNA, 546 bp, Panicum virgatum
  misc_feature: Ceres CLONE 2038560
  misc_feature: Encodes the peptide sequence at SEQ ID NO. 47755
aaaaagccaaacattccgcccttcgccgccgccgctttcgatcttctccccgcgcgccccgaagtccgaaccggcgaacctcgcggccaccgcaggagattcgcccacgcccggcacgggggcccggcggcctcgatttggaggaggaggaggagggaggagggagggaggccgggcgggcggcgggcaagatgaggctgctgcgggttgccacgtgcaacctcaaccagtgggcgatggacttcgacaccaacctccgcaacgtcaaggagtctatcgcccgcgccaaggccgccggctccgccgtccgcgtcggccccgagctcgagctcaccggctacggctgcgaggaccacttcctcgagcaggacaccaccgcgcacgcatgggagtgcttaaaggacattttaactggggactatacagacaacatcttatgcagcataggaatgccagttattttcaatagcgtacgggataattgccaagtcttctgcctgaatcgcaagataatcatgattcgaccaaagatgtcccttgcgaatg

SEQ ID NO: 47755 - protein, 118 aa, Panicum virgatum
  misc_feature: Ceres CLONE 2038560
  misc_feature: SWISSPROT Homolog: EC 6.3.5.1 NAD(+) synthase (glutamine-hydrolyzing)
MRLLRVATCNLNQWAMDFDTNLRNVKESIARAKAAGSAVRVGPELELTGYGCEDHFLEQDTTAHAWECLKDILTGDYTDNILCSIGMPVIFNSVRDNCQVFCLNRKIIMIRPKMSLAN

SEQ ID NO: 47756 - DNA, 661 bp, Panicum virgatum
  misc_feature: Ceres CLONE 2038589
  misc_feature: Encodes the peptide sequence at SEQ ID NO. 47757
tgtctctctctctctctctctcaagaaatcagtagctcaatccttcctctcaccctttacgcctttgtatttaccaaaagtcgctgctagctccttcttcgatccattgctgggataacgcaagctaaggtgacccgggaggaatgtcgtcggcccagatcgcgccgccgccggagcatgtgtgctacgtgcactgcaatttctgcaacacaattctcgcggtcagtgtcccgagcaatagcatgctgaacatcgtgacagtccgttgtgggcattgcactagcctgctgtcagtgaacttgataggactgatccaatcacttcctgtccagaatcactcacagttggtgcaggagaatttcaaggttcacaatattcacaatatcagctttactgaaaactactctgagtatgctccttcgtcttcaaaattccggatgccaatgatgttctcagcaaaaggagatcaggatcatatgctgcacgtgcgtggtaagattgatgatatgcatgtttttcggataacttaaatatatatatatggaacctaattatttatcaatatgtggacataataaactgttttggacattgcttccctcaacaaatatttggtcaaaatcggttaaattctacgcacgtgcacttgagtgcatgcatg

SEQ ID NO: 47757 - protein, 128 aa, Panicum virgatum
  misc_feature: Ceres CLONE 2038589
  misc_feature (4)..(118): Pfam Name: YABBY Pfam Description: YABBY protein
MSSAQIAPPPEHVCYVHCNFCNTILAVSVPSNSMLNIVTVRCGHCTSLLSVNLIGLIQSLPVQNHSQLVQENFKVHNIHNISFTENYSEYAPSSSKFRMPMMFSAKGDQDHMLHVRGKIDDMHVFRIT

SEQ ID NO: 47758 - DNA, 693 bp, Panicum virgatum
  misc_feature: Ceres CLONE 2038591
  misc_feature: Encodes the peptide sequence at SEQ ID NO. 47759
aaaaattcgaattctccgtctcccccaccccatcccccgctcctccccacctcgccgtacaaattttgaaatctcctctcctccgactccgagccaccgccccccttcgccgccgcgttcgccatgtcgtcgcggcaggacaaggagaaggcggtgaacgtgcaggtcctcctccgctgcaggcccttcagcgacgacgagctcaggagcaacgcgccgcaggtcgtcacctgcaacgactaccagcgggaggtcgctgtcacgcagaccatcgccggcaagcagttcgaccgggtcttcaccttcgacaaggtttttggaccggcagcaaagcagcaggacttgtatgaccaggcgattattcctattgttaatgaggtcttggaggggttcaactgtaccatatttgcctatggccagacaggcacaggaaagacatataccatggaaggcgagtgcaggagagcaaagagcgggccaaagggccagttacctgctgatgctggagtcatacctagggcagtgaagcagatctttgataccctggagaggcagaatactgaatacagtgttaaagtcacgttcctggagctgtacaatgaagaaatcacagatcttcttgcaccggaggagatatctaaggttgctctcgaagatagacagaagaaaaacttacctcttatggaggacggg

SEQ ID NO: 47759 - protein, 189 aa, Panicum virgatum
  misc_feature: Ceres CLONE 2038591
  misc_feature (18)..(188): Pfam Name: Kinesin Pfam Description: Kinesin motor domain
MSSRQDKEKAVNVQVLLRCRPFSDDELRSNAPQVVTCNDYQREVAVTQTIAGKQFDRVFTFDKVFGPAAKQQDLYDQAIIPIVNEVLEGFNCTIFAYGQTGTGKTYTMEGECRRAKSGPKGQLPADAGVIPRAVKQIFDTLERQNTEYSVKVTFLELYNEEITDLLAPEEISKVALEDRQKKNLPLMED

SEQ ID NO: 47760 - DNA, 717 bp, Panicum virgatum
  misc_feature: Ceres CLONE 2038601
  misc_feature: Encodes the peptide sequence at SEQ ID NO. 47761
agctgctagttgcctcgccagttgcgtcgctgctcggctcgtgcccagtcccataccaccaccaccaccccgccatccatctcctcctcctccgccgccgcctcgctcttccgtccactcctccccgtccacgcctctctccctctctctagcgcgcgccccattgcttctcggatctgggcggcctcgcctcgcgctcccggcggttgcgatctgacgcgggtgctgggcgcttggctgctgaagggcgcccgcgcggcgaatggtgtgatcggcgggccgggaaccgggagcgaggcgatgcggcggggtccggagctcccgctgctgctggcggcggcgctcctcgcattggcggcggcacccgggcccgcccgcgcggccaccgacgcggccgacgtcgctgccataaatggattgtacgtcgcactgggatcgccaactcttcctggatggactggaaatggtggagacccctgcggtgagctctggcagggtattgtgtgcactggctctactataactggaataaccatgaatgctgcaaacttgggagggcagctgggcagtttagggaacttcacttcgatcatcaccataaatcttagtaacaataagattggtggaaacataccagaagacctacctattacattgcagcagcttttcctctctgctaatcagctcactggaagcatccccaagtcactggtcaag

SEQ ID NO: 47761 - protein, 138 aa, Panicum virgatum
  misc_feature: Ceres CLONE 2038601
  misc_feature: SWISSPROT Homolog: EC 2.7.11.1 Non-specific serine/threonine protein kinase
  misc_feature: Functional homolog of the protein sequence given in SEQ ID NO 50266
  misc_feature: Useful for making plants with altered cell wall content and/or composition
MRRGPELPLLLAAALLALAAAPGPARAATDAADVAAINGLYVALGSPTLPGWTGNGGDPCGELWQGIVCTGSTITGITMNAANLGGQLGSLGNFTSIITINLSNNKIGGNIPEDLPITLQQLFLSANQLTGSIPKSLV

SEQ ID NO: 47762 - DNA, 428 bp, Panicum virgatum
  misc_feature: Ceres CLONE 2038660
  misc_feature: Encodes the peptide sequence at SEQ ID NO. 47763
aacctgcttggggatgaacctcgccaagatcatgatgctcatctttctgcaccggcttgttacgaccttcagatgggagatggcagacgaggacacaagccttgagaagtgggcaatgttccctaggctcaagaacggatgccccattcaccttacacccatctgatgaaccatggatcagatcggatcagataataacttggggaaaatcaagcacctaattctgtatgggaaagaatggcatgctcatgtgcatactcctaaatgctcccattcaataatacaaggaatttctttatttcaacctagtcttgaagttgattaagattctggccatcattagttctgtcacaaatgtatcgttttatataaaatgcaatactctattttttttctaatggagggagcaggtgcatatatgttgcact

SEQ ID NO: 47763 - protein, 54 aa, Panicum virgatum
  misc_feature: Ceres CLONE 2038660
  misc_feature: SWISSPROT Homolog: EC 1.14.13.93 (+)-abscisic acid 8'-hydroxylase
TCLGMNLAKIMMLIFLHRLVTTFRWEMADEDTSLEKWAMFPRLKNGCPIHLTPI

SEQ ID NO: 47764 - DNA, 662 bp, Panicum virgatum
  misc_feature: Ceres CLONE 2038666
  misc_feature: Encodes the peptide sequence at SEQ ID NO. 47765
acagaagttcacacacagccgcgcagtgcgtgcctcgttgtgtccgcctcgaatccggcggcggcggcggcggcggcggcggcaggggagatggaggcggcggcggcgggcggagggggcgggaggtggtgcgtggtgactggcggccgcggcttcgcggccaggcacctggtgacgatgctgctccgctccggcgagtggcgggtgcgcgtggccgacctggcccccgccatcgcgctcgaccgcgacgaagaggaggggcacctgggcgccgcgctccgcgaaggccaggccgcctacgtctccgcggacctccgcgataaggcccaggtcgccagagcttttgaaggggccgaagtagttttccatatggctgctccagattcatccatcaacaacttccatcttcattattcagtcaacgtcgagggaacaaaaaatgttattgatgcttgtatccgttgcaaggtgaagagactcatctacactagttcaccgagtgttgtatttgatggagttcatggaatttttaatgcagatgaatcaatgccttacccagataagtttaatgattcatattcagaaacgaaggcagatggagaaaaactggtgatgaaggctaatggtaggggagggcttcttacttgctgtatacgcccaag

SEQ ID NO: 47765 - protein, 190 aa, Panicum virgatum
  misc_feature: Ceres CLONE 2038666
  misc_feature (15)..(190): Pfam Name: 3Beta_HSD Pfam Description: 3-beta hydroxysteroid dehydrogenase/isomerase family
  misc_feature: SWISSPROT Homolog: EC 1.1.1.170 Sterol-4-alpha-carboxylate 3-dehydrogenase (decarboxylating)
MEAAAAGGGGGRWCVVTGGRGFAARHLVTMLLRSGEWRVRVADLAPAIALDRDEEEGHLGAALREGQAAYVSADLRDKAQVARAFEGAEVVFHMAAPDSSINNFHLHYSVNVEGTKNVIDACIRCKVKRLIYTSSPSVVFDGVHGIFNADESMPYPDKFNDSYSETKADGEKLVMKANGRGGLLTCCIRP

SEQ ID NO: 47766 - DNA, 657 bp, Panicum virgatum
  misc_feature: Ceres CLONE 2038672
  misc_feature: Encodes the peptide sequence at SEQ ID NO. 47767
aagaatctgccagtcaaattcccaactcaattctctattccctccccctcccctcccatcccctcccctgctgcacatcacgccttccgccttctctctctacccgcttccgctcttggtccccccgggccccgccgcggccaccgccgcgggcggttaaaaagcgcgcgcgggcgcggcagcaacggcgtcgctacggcccgggagcgctcctccaccttgccctgtcgcctccgcttcccctccactctctctctctctctctctctctctctctctctctcttcgccgcggggctgggagcacgcgctgtagcgtcgcgccgcgcatttaaggcgccgcttggatcttgatctgcccggcggtctcatccaccaccaacacctcctcctcctccttgtcggcggcgccagccggcaccggtcgcgcggcgttccgccgaacgggcggcgggcaggcgcgccccactctgctgtaactacggaagaagtctgaatttcagagggtgaagtaatggcggagccctaccagatgaacggcatactgaacggaatgcctaatttgaggcatccgtcctctccatcagaggtcgatgaattctgtaaagcgcttggtggcgattcaccaatacacagtgtgctagtcgccaacaatggg

SEQ ID NO: 47767 - protein, 47 aa, Panicum virgatum
  misc_feature: Ceres CLONE 2038672
  misc_feature: Functional homolog of the protein sequence given in SEQ ID NO 51511
  misc_feature: Useful for making plants with altered oil content
  misc_feature: Useful for making plants with modulated herbicide sensitivity
MAEPYQMNGILNGMPNLRHPSSPSEVDEFCKALGGDSPIHSVLVANN

SEQ ID NO: 47768 - DNA, 673 bp, Panicum virgatum
  misc_feature: Ceres CLONE 2038686
  misc_feature: Encodes the peptide sequence at SEQ ID NO. 47769
attgacacctcacacctcaacagtggagggagtctctgcagcctgcttccctccctgcgcgcgggtccgtcaggactcaggaaagggctgagaggcagagggagaggcggatagcaaggagcggcgcggcggaatggcggcgccgccgaaggcctggaaggcggagtacgccaagtccgggcgggcctcgtgcaagtcgtgccggtcccccatcgccaaggaccagctccgcctcggcaagatggtgcaggcgacccagttcgacggcttcatgcccatgtggaaccatgctaaatgcatctttggtaagaagaaccagataaaatctgttgatgatgttgaaggaatagatgcacttcgatgggatgatcaagagaagataaggaactatgttggaagtgcctcagctgctataagttccacagcttctgttcctgataaatgtaccgttgatgttgctccatctgctcgaacttcatgcagacgatgcagtgaaaagattacaaaaggaacggtccgtgtttcagctaagcttgaaggtcaagcttccaagggtataccatggtatcatgtcaactgtttctttgaggtgtccccatctgcatctgttgagaatttctcgggctgggatactttgtcagacgaggataaaaggactgtgcttgatctcgtt

SEQ ID NO: 47769 - protein, 179 aa, Panicum virgatum
  misc_feature: Ceres CLONE 2038686
  misc_feature (11)..(88): Pfam Name: zf-PARP Pfam Description: Poly(ADP-ribose) polymerase and DNA-Ligase Zn-finger region
  misc_feature (107)..(178): Pfam Name: zf-PARP Pfam Description: Poly(ADP-ribose) polymerase and DNA-Ligase Zn-finger region
  misc_feature: SWISSPROT Homolog: EC 2.4.2.30 NAD(+) ADP-ribosyltransferase
  misc_feature: Functional homolog of the protein sequence given in SEQ ID NO 51560
  misc_feature: Useful for making plants with modulated abiotic stress sensitivity
MAAPPKAWKAEYAKSGRASCKSCRSPIAKDQLRLGKMVQATQFDGFMPMWNHAKCIFGKKNQIKSVDDVEGIDALRWDDQEKIRNYVGSASAAISSTASVPDKCTVDVAPSARTSCRRCSEKITKGTVRVSAKLEGQASKGIPWYHVNCFFEVSPSASVENFSGWDTLSDEDKRTVLDL

SEQ ID NO: 47770 - DNA, 661 bp, Panicum virgatum
  misc_feature: Ceres CLONE 2038702
  misc_feature: Encodes the peptide sequence at SEQ ID NO. 47771
ctagatcccaaatccaccacccgtcatcccctgatcgacgtacctgacccttctctttgcagtcgattctacgccgacccgctcgtttctcttttccgccgtccccgagatctcgaggcaggatggtggaggcgaaggacaacgaggtgtacgaggaggatctcgtcgactacgaggaggaggtggagaatgtcgccgacggcgccccaaccaacggctccgccgatgtcgtcaagaaggggtacgtggggatccacagctcggggttcagagacttcctgctcaaaccggagcttctccgtgccatccaggactgcggatttgagcatccttccgaaggtacaaattcttctgacatttccttctggaggagaatatggtataacttttcattaacggacacagaaggttgatttttttcttactggggtgctgctccaactttgtttggttccacatcagtgcaacatgaatgcatccctcaagccattcttggaatggatgttatctgtcaagcaaaatctgggatgggtaagactgcggttttcgtcctctcaactcttcagcagattgatcctgttgctggccaagtagctgcgcttgtgttgtgccacacaagagagttagcttaccagatttgccatgaatttgagagatttag

SEQ ID NO: 47771 - protein, 96 aa, Panicum virgatum
  misc_feature: Ceres CLONE 2038702
  misc_feature: Functional homolog of the protein sequence given in SEQ ID NO 50368
  misc_feature: Useful for biocontainment applications
  misc_feature: Useful for making plants with modulated biomass
  misc_feature: Useful for making plants with modulated cold sensitivity
MVEAKDNEVYEEDLVDYEEEVENVADGAPTNGSADVVKKGYVGIHSSGFRDFLLKPELLRAIQDCGFEHPSEGTNSSDISFWRRIWYNFSLTDTEG

SEQ ID NO: 47772 - DNA, 676 bp, Panicum virgatum
  misc_feature: Ceres CLONE 2038735
  misc_feature: Encodes the peptide sequence at SEQ ID NO. 47773
aaaaaaaaaaatccaccggcttctcgtggtctccttccaaaccctagcgccgcgccgcccccgcccccacctcgccgtcgccgccgcgcgctcatggcgaagtcgcggccgcccaagcggatcctcgagtcctacaccatcaagggatccgacaaagtcatcaagcctggtgattgtgtgctaatgagagcatttgatgcatcaaagccaccctatgtggcaagagttgaggcaattgaggcagcaggatctcgaggcacaaatgtgagagtacgggtgcgatggtattataggcctgaggagtccattggtgggaggcggccttttcacggttccaaggaggtcttcctctcggaccactatgatgtacaaagcgctgacacgattgaggggaagtgcaatgtgcacagcttccggacttatacaaagcttgattctgtcaatgctgaggacttcttctgccgctttgagtataaatcagcgacaggcagcttcgtgcccgaccggattgctgtgttttgcaagtgtgagatgccatacaaccctgatgatcttatgatccaatgcgaagaatgttctgattggtgagtatattgatgaagatcaaagagaaactgatttctcaaaagtttggtaaaagttttgttgatacaacgtgataatacttatattttct

SEQ ID NO: 47773 - protein, 164 aa, Panicum virgatum
  misc_feature: Ceres CLONE 2038735
  misc_feature (21)..(138): Pfam Name: BAH Pfam Description: BAH domain
MAKSRPPKRILESYTIKGSDKVIKPGDCVLMRAFDASKPPYVARVEAIEAAGSRGTNVRVRVRWYYRPEESIGGRRPFHGSKEVFLSDHYDVQSADTIEGKCNVHSFRTYTKLDSVNAEDFFCRFEYKSATGSFVPDRIAVFCKCEMPYNPDDLMIQCEECSDW

SEQ ID NO: 47774 - DNA, 709 bp, Panicum virgatum
  misc_feature: Ceres CLONE 2038744
  misc_feature: Encodes the peptide sequence at SEQ ID NO. 47775
aagccgccgccactcctctcagactccgaaaccctaccctcacacccgccgccgccgccacccgcgccccagcaagcagccgccatgccgcccaagttggacccctcacaggtggtggaggtgttcgtccgcgtgacgggcggggaggtcggcgcggcgtcgtcgctggcccccaagatcggcccgctcgggctctccccgaagaagatcggagaggacatcgccaaggagaccgccaaggactggaagggcctccgcgtcaccgtcaagctcaccgtccagaaccgccaggccaaggtctccgtcgtgccctccgccgcggcgctcgtcatcaaggccctgaaggagcccgagagggacaggaagaaggtcaagaacatcaagcacagcggcaacatcagcctcgacgacgtcatcgagatcgccaggaccatgaggcccaggtccatggccaaggagatggccgggaccgtcaaggagatcctcgggacctgcgtcagcgtcggctgcaccgtcgacggcaaggaccccaaggatctgcagcaggagatcgacgaaggggacgtcgaaatcccctccgcgtaaaggctagacatctaaggagattatcatcagatgctactgaagtgttctgttccatctgctgtttatgtaccttaccaaacaatgtggctgcatagtgcatgattgcattcatccgccatggatt

SEQ ID NO: 47775 - protein, 166 aa, Panicum virgatum; identical to SEQ ID NO: 13969
  misc_feature: Ceres CLONE 2038744
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain

SEQ ID NO: 47776 - DNA, 659 bp, Panicum virgatum
  misc_feature: Ceres CLONE 2038745
  misc_feature: Encodes the peptide sequence at SEQ ID NO. 47777
tccgccgccctctcacttccttccttccccacctggcggctgcgctccccgacccgaagagatggcggtgccgctgctgacgaagaagatcgtgaagaagcgggtcaagcagttcaagaggccccacctcgaccgctacaagtgcctcaagccaagctggcgcaggccaaagggtattgactcccgtgtcaggaggaagttcaagggatgcaccttgatgcctaacattgggtacggctctgacaagtcaaccaggcactaccttcccaacaagttcaagaagtttgtggtgcacaatgtctctgagctggaggtgctcatgatgcacaacaggacatactgcgccgagatcgcccacaacgtctcaacaaagaagcgcaaggagattgttgagcgtgctgctcagctcgatattgtggtcaccaacaagctcgccaggctccgcagccaggaggatgagtaggctgggttgctcgtcaggacaactgttgggtcttgtctttcttgtctgtaggaaaactactctgtttggcgtcgtattgtattgctaccgaggataccttctatgcccgacctttttgctatcaatagcgactctaatatgtcaaaagctgctgttaccgtacgcctatctgaattatctgcatgttgttgccatg

SEQ ID NO: 47777 - protein, 133 aa, Panicum virgatum
  misc_feature: Ceres CLONE 2038745
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPNKFKKFVVHNVSELEVLMMHNRTYCAEIAHNVSTKKRKEIVERAAQLDIVVTNKLARLRSQEDE

SEQ ID NO: 47778 - DNA, 716 bp, Panicum virgatum
  misc_feature: Ceres CLONE 2038759
  misc_feature: Encodes the peptide sequence at SEQ ID NO. 47779
gccgaaaactcccaaaccctcgcacctttggtcctgctgccccttccggctcggctctccctgcggcgaagcaaccatgctcgccgcctctcgatccctccgccgcctctcctcttcctcctccgtccgctccctccgtcgcgtcctccagcaccctccaacatccccgcccgcggctccgcctcctctcccgcctctccggacccttacccgcgccctcctcccgcacctcgccgcctcccaccggttctccaccgccgcctcctcttcctccgccccttcccgcctaggagaatgcggcggcgcgcggggagccccggagattcccgaggaggtggaggtggaggatgaatcgggggcgctggtgcggcatgacacggacgcttacgctgcggtggagctggctctggactcggtggtgaaggtgttcacggtgtccagcagccccaactactttttgccgtggcagaataaggcgcagcgggagagcatgggctccggatttgtaattcctggaagaaggatcgtgacgaatgctcatgtcattgctgatcatacttttgttcttgtgaggaagcatggttcacctactaaatataaggcagaagtcctggcagttggtcacgaatgtgacttggctctgttgactgttgagagcgaggagttttgggatggggtgaatagtttggagcttggagacattccctttttgcaag

SEQ ID NO: 47779 - protein, 213 aa, Panicum virgatum
  misc_feature: Ceres CLONE 2038759
  misc_feature: SWISSPROT Homolog: EC 3.4.21.108 HtrA2 peptidase
MLAASRSLRRLSSSSSVRSLRRVLQHPPTSPPAAPPPLPPLRTLTRALLPHLAASHRFSTAASSSSAPSRLGECGGARGAPEIPEEVEVEDESGALVRHDTDAYAAVELALDSVVKVFTVSSSPNYFLPWQNKAQRESMGSGFVIPGRRIVTNAHVIADHTFVLVRKHGSPTKYKAEVLAVGHECDLALLTVESEEFWDGVNSLELGDIPFLQ

SEQ ID NO: 47780 - DNA, 655 bp, Panicum virgatum
  misc_feature: Ceres CLONE 2038767
  misc_feature: Encodes the peptide sequence at SEQ ID NO. 47781
accggggggccttggaccgatctcttcttccccccgcggtaaggaatccgttggcttgtggaatcccattgcttatcagtgtcccgctagatctcttccctccgccgcgggcacccgattccaagcgattccaagtggttgctgctactcttctaggtcgtcgctggcagtatgggcgtgcccaaggatggcgccgagttggaggagggaaccttggagatcggcatggagtataggactgtctctggtgtggcagggcccctggttattttggacaaagtaaagggacctaagtatcaggagattgtgaacatccgattgggagatggcaccactcgtcgtggtcaagtcctggaggtcgatggtgaaaaggctgttgtgcaggtctttgaaggtacctcaggaatagacaacaagtataccactgtgcagtttaccggtgaggtcttgaaaactcctgtctcacttgatatgcttggacgcatctttaatggttctgggaaacctatcgataatggccctccaatattgcctgaggcttacttggatatttctggaagttctatcaaccccagtgagagaacctatccagaagagatgattcaaacaggaatatccaccattgatgtgatgaactcaattgcgcggggggcaa

SEQ ID NO: 47781 - protein, 161 aa, Panicum virgatum
  misc_feature: Ceres CLONE 2038767
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGVPKDGAELEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGA

SEQ ID NO: 47782 - DNA, 726 bp, Panicum virgatum
  misc_feature: Ceres CLONE 2038772
  misc_feature: Encodes the peptide sequence at SEQ ID NO. 47783
cttgctcttcattccctggcggcgacgactgggcgagcggcggcgccatttctcacgtctcgcctcgctcagcgctttgccggcgacgagcatccaccaggaattttcatacatctgagatgtacagggcctcaaatttcatacctgatccttatcaggagctcctagatgccaagccattaaggtctttagctcccatgttcccagcacccatgggagtcaatgttaatcagtcaagtacaccaccattggtctgtgtcactccggttggccaattcccaacagggtttggcgcggggaaccttcctgcctttggatcgtttgctactttcagtgccactgcaaatggagtttcctatgccggcaccagtgccaacggccccattgatgccacccctatctctgcatacaagacaagatcaggcatgccagttgatggtgacgatccttactcgggtaaccaaactttgtcatctgaacggaagaggagaggccgtcctcctggttctggtgcatctcgtgcagatggctcaaatggtaagttcaagcgccctaagccaacgtacaagaatttcgtcgctggcaaggagcttgcctttctgccatcgacatctgataacagggagattgtggaagcagttcacatgacctttgaggcactcaggcgaagacatctgcagatggatgaaacacaggatgctagcagacgtgcagacctgaaggctg

SEQ ID NO: 47783 - protein, 202 aa, Panicum virgatum
  misc_feature: Ceres CLONE 2038772
  misc_feature: SWISSPROT Homolog: EC 2.1.1.43 Histone-lysine N-methyltransferase
MYRASNFIPDPYQELLDAKPLRSLAPMFPAPMGVNVNQSSTPPLVCVTPVGQFPTGFGAGNLPAFGSFATFSATANGVSYAGTSANGPIDATPISAYKTRSGMPVDGDDPYSGNQTLSSERKRRGRPPGSGASRADGSNGKFKRPKPTYKNFVAGKELAFLPSTSDNREIVEAVHMTFEALRRRHLQMDETQDASRRADLKA

SEQ ID NO: 47784 - DNA, 730 bp, Panicum virgatum
  misc_feature: Ceres CLONE 2038783
  misc_feature: Encodes the peptide sequence at SEQ ID NO. 47785
ctttaaagtccccgagaaaagatgagcacattgttgcttgttcacatagaagatggcaggctttcaggttaagccgccgcaaaagccgcatgcactcaatagattggactctattttcatctgctcataatgatccaatggcatctgatgtgatcgcaccttctccatggtcaatatttggctgtaaaaatggtttacgtttgtttaccgaggcaaatgatggtggctctcgcgagaagtattgggatgatcatccggctataatggcagttggtgttgttgatgtgaattctgagggtgtcttccagactctaatgtcccttgggcaatcaagatctgagtgggacttctgtttgcatgaaggaaacgttgttgagcatctagatggacacacagacataatccacaagaaattaagagccgactggttaccatggggaatgagaaagagggatctattacttagaagatattggaggcgagaagatgatggaacttacgtaattctataccactctgttttccactacaaatgtcatcctgagagaggctatatccgtgcatgtctcaaaagtggaggttatgtaatatcaccaatcaatcaaggaagacaatcagttgttaagcacatgcttgccatcgactggaaattctggaagtcttatctgtttacatcatctgctaaatatatcactatccgtatgttaggcagaatagcagcactgcgaga

SEQ ID NO: 47785 - protein, 242 aa, Panicum virgatum
  misc_feature: Ceres CLONE 2038783
  misc_feature (37)..(241): Pfam Name: START Pfam Description: START domain
LKSPRKDEHIVACSHRRWQAFRLSRRKSRMHSIDWTLFSSAHNDPMASDVIAPSPWSIFGCKNGLRLFTEANDGGSREKYWDDHPAIMAVGVVDVNSEGVFQTLMSLGQSRSEWDFCLHEGNVVEHLDGHTDIIHKKLRADWLPWGMRKRDLLLRRYWRREDDGTYVILYHSVFHYKCHPERGYIRACLKSGGYVISPINQGRQSVVKHMLAIDWKFWKSYLFTSSAKYITIRMLGRIAALR

SEQ ID NO: 47786 - DNA, 677 bp, Panicum virgatum
  misc_feature: Ceres CLONE 2038786
  misc_feature: Encodes the peptide sequence at SEQ ID NO. 47787
aaaaaaaaaaaaagcgcaagtcctcatccgactcccccctccatccgccacctcacctccgctagctccgagcgccccccatttcgccgtcgaggtgtcaggagtagcagattgcatgttcgtgatcgtggcgccttaattggactttgatatgggttctgctgcaactgaaagcaatgacaccttgctgggcaatggagttgttgggattcttgccgagacttgtaatatgtgggaaaggagggcaccgttaactccttcccactgtgctcgccttctgctcggaggagggaacagaactcgagtaaaccggataattgtgcagccaagcacaaagaggatccatcatgatgctcagtatgaggatgctggatgcaagatttcagaagacctgtcagagtgtggccttattataggcatcaaacaaccaaagttggagatgattcttccagatagagcgtatgcgttcttttcacacacccacaaggcccagaaagagaatatgccactgttagataagatcctggaagagagggtgtccttgttcgattatgagctaattgttggagatgatgggaaaagatcgcttgcatttgggaagtttgctggtagagctgggctgatagatttcttacatggtctcggacagcgtaagtacaatgaccaatatttctcgg

SEQ ID NO: 47787 - protein, 175 aa, Panicum virgatum
  misc_feature: Ceres CLONE 2038786
  misc_feature (19)..(155): Pfam Name: AlaDh_PNT_N Pfam Description: Alanine dehydrogenase/PNT, N-terminal domain
  misc_feature: SWISSPROT Homolog: EC 1.5.1.7 Saccharopine dehydrogenase (NAD(+), L-lysine-forming)
MGSAATESNDTLLGNGVVGILAETCNMWERRAPLTPSHCARLLLGGGNRTRVNRIIVQPSTKRIHHDAQYEDAGCKISEDLSECGLIIGIKQPKLEMILPDRAYAFFSHTHKAQKENMPLLDKILEERVSLFDYELIVGDDGKRSLAFGKFAGRAGLIDFLHGLGQRKYNDQYFS

SEQ ID NO: 47788 - DNA, 590 bp, Panicum virgatum
  misc_feature: Ceres CLONE 2038796
  misc_feature: Encodes the peptide sequence at SEQ ID NO. 47789
acagagctagctgatcagcagcagcagcaagcagacacaccgcgtgcttgagctcgctctcgctcttggtctgagcaagcttgcattggtgcgtgaggatggcgaaggacatcgaggccgcggcggcgggcggggagtacacggccaaggactactccgacccgccgccggcgccgctgatcgacgcggaggagctgaccaagtggtcgctgtaccgcgcggtgatcgccgagttcgtggcgacgctgctcttcctctacatcacggtggccacggtgatcgggtacaagcaccagacggacgccgagatcatcggcaccttcgtgctcgtctacaccgtcttctccgccaccgaccccaagcgcaacgcccgcgactcacacgtcccagtgcttgctcctcttcccatcgggttcgccgtgttcatggtccacctggccacgatccccatcaccggcaccggcatcaacccggccaggagcttcggcgccgccgtgatctacaacaaggacaaggcctgggatgaccaatggatcttctgggtgggcccattcatcggcgccgccatcgccgacgcgtaccaccagtac

SEQ ID NO: 47789 - protein, 163 aa, Panicum virgatum
  misc_feature: Ceres CLONE 2038796
  misc_feature (32)..(162): Pfam Name: MIP Pfam Description: Major intrinsic protein
MAKDIEAAAAGGEYTAKDYSDPPPAPLIDAEELTKWSLYRAVIAEFVATLLFLYITVATVIGYKHQTDAEIIGTFVLVYTVFSATDPKRNARDSHVPVLAPLPIGFAVFMVHLATIPITGTGINPARSFGAAVIYNKDKAWDDQWIFWVGPFIGAAIADAYHQ

SEQ ID NO: 47790 - DNA, 662 bp, Panicum virgatum
  misc_feature: Ceres CLONE 2038800
  misc_feature: Encodes the peptide sequence at SEQ ID NO. 47791
aaggcatcatcagcagccatggcgccgccctcggtgtccacctcccacctcctcatcaccgcctccctcccaaagcccaagccttcctccctccgcccgccgcgcctcccaaagcccaagccccggccccgtcccccgcgcccgcccccgagctccaggccgaggcccccaccccgaccgccaaccccttcgccaactccctcctcacggcccccaagccctccgccgccgcggacctccccgagggcgcgcagtggcgctacagcgagtttctctccgccgtcaagcgcggcaaggtcgagcgcgtccgcttctccaaggacggcggcctgctccagctcaccgccgtcgacggccgccgcgccaccgtcgtcgtccccaacgaccccgacctcatcgacatcctcgccaccaacggcgtcgacatctccgtctccgagggcgaagccgccgggcccgggggcttccttgccttcgtcggcaacctcctcttccccttcatcgccttcgcgggcctcttcttcctcttccgccgcgcgcagggcggcccgggcgcgggccccggcggcctcggcgggcccatggactttggacgatccaagagcaagttccaggaggtccctgagaccggcgtcaccttcctcgacgtcgccgggcgccga

SEQ ID NO: 47791 - protein, 219 aa, Panicum virgatum
  misc_feature: Ceres CLONE 2038800
  misc_feature (83)..(218): Pfam Name: FtsH_ext Pfam Description: FtsH Extracellular
GIISSHGAALGVHLPPPHHRLPPKAQAFLPPPAAPPKAQAPAPSPAPAPELQAEAPTPTANPFANSLLTAPKPSAAADLPEGAQWRYSEFLSAVKRGKVERVRFSKDGGLLQLTAVDGRRATVVVPNDPDLIDILATNGVDISVSEGEAAGPGGFLAFVGNLLFPFIAFAGLFFLFRRAQGGPGAGPGGLGGPMDFGRSKSKFQEVPETGVTFLDVAGR

SEQ ID NO: 47792 - DNA, 650 bp, Panicum virgatum
  misc_feature: Ceres CLONE 2038803
  misc_feature: Encodes the peptide sequence at SEQ ID NO. 47793
aagctcaaatcagagctcacgcggcgagaaccaaccacttgcagcagatcgacctcgaccagttcggagatcccgctgctcagttgcaggcagctcctagctagtagctagtagctactgcctcttgctaattagctaggacccatcgatcgagctgtgtagggccggccggggccgaggcagccagcatgatgcacctgaacctgaagcacccactggtgctgccggggcaccagggcaatggcggcgtcggctcgtcgccggcgccggcggcgggtgccaggagggtcgggccgtcgtcctccgcctcccggcggcacgtcatgccgaggataagctgcagcgcgacgaaggagatcggcggcgccgtgtcggcggccaccgtggagaagatgctgaccgtgaaggccacggtggaggcgtcgccggccatcgggcagatgtacgccgcccgcggcctcgacgacatcggcgacctcctcggcaagacgctgctcctcgagctcgtcagctccgagctcgacccaaagacgggcctggagaaggagcgggtgacggcgttcgcgcacaggacgctggtggagggccggtacgaggcggagttccaggtgccggcgtccttcgggccggtgggcgccgtgctggtggag

SEQ ID NO: 47793 - protein, 153 aa, Panicum virgatum
  misc_feature: Ceres CLONE 2038803
  misc_feature: SWISSPROT Homolog: EC 1.13.11.12 Lipoxygenase
MMHLNLKHPLVLPGHQGNGGVGSSPAPAAGARRVGPSSSASRRHVMPRISCSATKEIGGAVSAATVEKMLTVKATVEASPAIGQMYAARGLDDIGDLLGKTLLLELVSSELDPKTGLEKERVTAFAHRTLVEGRYEAEFQVPASFGPVGAVLV

SEQ ID NO: 47794 - DNA, 625 bp, Panicum virgatum
  misc_feature: Ceres CLONE 2038812
  misc_feature: Encodes the peptide sequence at SEQ ID NO. 47795
aagaagagagagaaaaatccaacgccgcgccacaccacaccgcaccacaccaccagggttcaccagagatggacttcttcagtgaatatggtgatgctaacagatacaaaatccaagaggtcattggcaaaggaagttatggtgttgtttgctcagctgttgaccagcatacaggcgacaaggtggcaatcaagaaaatacataatatctttgagcacttatccgatgctgcccggatcctccgtgagatcaaactacttcggctattgcgacatcctgatatagttgagatcaagcatataatgctgcctccatcaaggagggacttcaaagatatctatgttgtgtttgagctgatggattcagacctgcaccaagtcatcaaggcaaatgatgacttaaccaaagagcatcatcagttctttctatatcagatgctccgtgcactcaaatacattcatactgctaatgtttatcatcgtgatttgaagccaaagaatatattggctaatgctaactgtaaacttaaaatatgtgattttggattggcaagagtggcattcaatgatactcctacaacagtattctggacggattatgttgctacaagatggtataggggctc

SEQ ID NO: 47795 - protein, 185 aa, Panicum virgatum
  misc_feature: Ceres CLONE 2038812
  misc_feature (13)..(185): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDSDLHQVIKANDDLTKEHHQFFLYQMLRALKYIHTANVYHRDLKPKNILANANCKLKICDFGLARVAFNDTPTTVFWTDYVATRWYRG

SEQ ID NO: 47796 - DNA, 703 bp, Panicum virgatum
  misc_feature: Ceres CLONE 2038825
  misc_feature: Encodes the peptide sequence at SEQ ID NO. 47797
atatactcaagcagctcaaaacctctatccagctaccaagaaatggctctgcttgcttcagccctgatgagtcgcactacccatccaggccttattagaagccacataggacccaatggtgacaatttgtcatggcgcctaccttcaaaagagaagagtaagagaaggtgtgacccgagccttagatcacaagcagaaaggatgagcagcgagcttggacaagaacatctcatgccatcagaaaggatgggaagcgagcttggacaagaacatctcatgccacgggaaatccctaggagggactggttccaccccggattcgtctttggcgccgccactgcagcgtaccaagtattgtttctagcatggatgatgtatacgtctttgctaatcggaaggaaaatagtgctacgttttacttaatactaataactaagagaaaaaaatatggatgcccaaaactctaaatgcaagttaagtgatatggtttgttttatatgcacaagaaattatttttatgttccatctatgtagattgaaggtgcttggaatgagcatggcaaggggccaagcacttgggaccacttctgccacaatcatcctgagatgatagctggctggagcaatggggatgttgcagtgaactcgtaccatctgtatgaagaggatgtcaaaatgctcaaggaaatgggcatggatgcct

SEQ ID NO: 47797 - protein, 126 aa, Panicum virgatum
  misc_feature: Ceres CLONE 2038825
  misc_feature: SWISSPROT Homolog: EC 3.2.1.21 Beta-glucosidase
MALLASALMSRTTHPGLIRSHIGPNGDNLSWRLPSKEKSKRRCDPSLRSQAERMSSELGQEHLMPSERMGSELGQEHLMPREIPRRDWFHPGFVFGAATAAYQVLFLAWMMYTSLLIGRKIVLRFT

SEQ ID NO: 47798 - DNA, 724 bp, Panicum virgatum
  misc_feature: Ceres CLONE 2038859
  misc_feature: Encodes the peptide sequence at SEQ ID NO. 47799
gagctcgtctcggtttctttcttgctctgttccgctgctgctgctgcttcttcttcatcatctccggtgggctgcgcgatggagatggcgttagcgctggcggccgccgtgctcctcttgtcctccacgctcgctgcttcagagttctgcgtgtgccggtccgaccagccgacggcggcgctgcagaaggtgatcgacttctcgtgcggcaacgacgcggactgctcgtccatcctgcagggcggcgggtgctacaaccccaacaacgtcgccgcgcactgctcctgggccgccaacagctactaccagaacaacaaggccaagggcgccacctgcgacttcggcggcgccgccaccatctccaccgccgaccccagtttctccgggtgcactttcccttcgactgccaggtacgacattgccctctgctcctccagcgccagagctccatagcacttgctctttttttttgttctttggagattcttgtaatagaataagctgtgctcattatgccctccctggcctgccaccccggcaatatggtcaaattcagattctcagagacaaccctagtcaatctgcagtgtgcccagcacctaacacgtttcagccgccctgttaatcacgcatggtccaccgacactagtaatctactgattaataggagcaagacgcagcaatcttaagccgaatggtttgcttcgcattctctagataaagg

SEQ ID NO: 47799 - protein, 124 aa, Panicum virgatum
  misc_feature: Ceres CLONE 2038859
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature: Functional homolog of the protein sequence given in SEQ ID NO 50404
  misc_feature: Useful for making plants with altered carbohydrate content
  misc_feature: Functional homolog of the protein sequence given in SEQ ID NO 50405
  misc_feature: Useful for making plants with altered alkaloid content
MEMALALAAAVLLLSSTLAASEFCVCRSDQPTAALQKVIDFSCGNDADCSSILQGGGCYNPNNVAAHCSWAANSYYQNNKAKGATCDFGGAATISTADPSFSGCTFPSTARYDIALCSSSARAP

SEQ ID NO: 47800 - DNA, 667 bp, Panicum virgatum
  misc_feature: Ceres CLONE 2038869
  misc_feature: Encodes the peptide sequence at SEQ ID NO. 47801
ctcgccctccctcaccttccccatcctcctcgtcccgcctccgcggaacccgagccccccgcgtcctgccccgccgattgagcccaaccgccgtgccctaggttgcgagatctcggggagcggagccccgcggcatccgggaaacagggaccgcggcgcgatggtggagacgggcggcgggaggctccaccagcgccggggcgcggccgccttcgtcgcggccaacaagacgctgctcgctgccgcgtgggtcgtcgggttcgcgctggtgttcctgtggcagagcgccgcgatatccctgaggagcggcggcgcccgcgggggccgcggcagcgggggcgtgttcctcgggctcctgtcggggcctctcccgccgccgcgccccgcgccgcggctgcgccccgcggcctacaacctcacggacttcggcggcgtcggggacgggcgggcgctcaacaccggggcgttcgagcgcgccgtcgaggccatcgcggcgctcgcggagcgcggcggcgggcagctcaatgtgcccccaggccggtggctcacggcgccgttcaacctgaccagccacatgacgctgtttctctccgagggcgctgagatccttggcattccggacgagaagtactggccgttgatgccagcattgccatcctatgggtat

SEQ ID NO: 47801 - protein, 168 aa, Panicum virgatum
  misc_feature: Ceres CLONE 2038869
  misc_feature: SWISSPROT Homolog: EC 3.2.1.82 Exo-poly-alpha-galacturonosidase
  misc_feature: Functional homolog of the protein sequence given in SEQ ID NO 50666
  misc_feature: Useful for making plants with altered carbohydrate content
  misc_feature: Functional homolog of the protein sequence given in SEQ ID NO 50667
  misc_feature: Useful for making plants with altered cell wall content and/or composition
MVETGGGRLHQRRGAAAFVAANKTLLAAAWVVGFALVFLWQSAAISLRSGGARGGRGSGGVFLGLLSGPLPPPRPAPRLRPAAYNLTDFGGVGDGRALNTGAFERAVEAIAALAERGGGQLNVPPGRWLTAPFNLTSHMTLFLSEGAEILGIPDEKYWPLMPALPSYG

SEQ ID NO: 47802 - DNA, 746 bp, Panicum virgatum
  misc_feature: Ceres CLONE 2038870
  misc_feature: Encodes the peptide sequence at SEQ ID NO. 47803
aaggagcagccgccctggacacagacatggagaggaaggtggcagcggagaaggagatgagagagtggtgcgtcgcgctccccaaggtggagctccacgcccacctcaacggctccgtccgcaatttcaccctcctggaacttgcaaaacagctaggagacaaaggagtcattgtcttcgaagatgttaaggatgtgatcatgaaggatggtagatctctcccagagtgtttcaagctttttgatttgtttcatatacttacaacggaccatgatacagtaacaaggatcgctaaggaggttgtggaagattttgctgcagagaatgttgtgtatttggaaataagaacaacacctaagaacaatgaagccaaagggatgaccaagcgatcttacatgaatgctgttattaaaggtttaaaagcagttgatgttgttttatttgattctaagtcaagaacaaatgacacattaacttgcacacctacaattgggttggatggtgacataaagaaaaggaggatatatgtcaggctccttcttagtattgatcgctgtgaaacaacttcggctgcattggataccgttaatttgaccctggaaatgaaagaccaaggtgttattggtatcgatatcgatctttctggcaatccagttgtgggggaatgggaaacatacttgcctgccctacaacatgctaaagagcttggaatccccattacaattcactgtggaaaggtaagcaaa

SEQ ID NO: 47803 - protein, 239 aa, Panicum virgatum
  misc_feature: Ceres CLONE 2038870
  misc_feature: SWISSPROT Homolog: EC 3.5.4.4 Adenosine deaminase
MERKVAAEKEMREWCVALPKVELHAHLNGSVRNFTLLELAKQLGDKGVIVFEDVKDVIMKDGRSLPECFKLFDLFHILTTDHDTVTRIAKEVVEDFAAENVVYLEIRTTPKNNEAKGMTKRSYMNAVIKGLKAVDVVLFDSKSRTNDTLTCTPTIGLDGDIKKRRIYVRLLLSIDRCETTSAALDTVNLTLEMKDQGVIGIDIDLSGNPVVGEWETYLPALQHAKELGIPITIHCGKVS

SEQ ID NO: 47804 - DNA, 691 bp, Panicum virgatum
  misc_feature: Ceres CLONE 2038889
  misc_feature: Encodes the peptide sequence at SEQ ID NO. 47805
tgcccagccgggattgtgccagattgcagtcatcgacaatgcttcagttcctttgaaatttgatagcccttcagatgatagcagtgcagggatgatgatgatgatgaggggtatgactgcaaagaattttgatcctgttcgttactctggtagatggttcgaggtagcctcatttaaaggtggatttgctggtcaaggacaagaagattgtcattgtactcagggagtgtattcatttgatgagaaggcacgctcaatccaggtggacacattctgcgtacatggtggacctgatggatatatcaccggaattcgggggagggtgcaatgtttgtccgaagaggacacggcaagtgctcagacagatcttgaaaggcaggaaatgatccgtggaaaatgctatctccggttcccgacgctgccgttcatacccaaggaaccctatgatgtccttgcaactgactatgacaattatgcaattgtgtctggagctaaggatacaagctttattcagatatactcaagaacaccaaaccccggcccagaattcatcgagaagtacaagtcctacgtcgccaacttcggctacgacccgagcaagatcaaggacactccacaggactgcgagtacatgtcctccgaccagcttgcgctgatgatgtcgatgcccgggatgaacgaggccctgacg

SEQ ID NO: 47805 - protein, 229 aa, Panicum virgatum
  misc_feature: Ceres CLONE 2038889
  misc_feature (43)..(206): Pfam Name: Lipocalin_2 Pfam Description: Lipocalin-like domain
  misc_feature: SWISSPROT Homolog: EC 5.3.99.2 Prostaglandin-D synthase
AQPGLCQIAVIDNASVPLKFDSPSDDSSAGMMMMMRGMTAKNFDPVRYSGRWFEVASFKGGFAGQGQEDCHCTQGVYSFDEKARSIQVDTFCVHGGPDGYITGIRGRVQCLSEEDTASAQTDLERQEMIRGKCYLRFPTLPFIPKEPYDVLATDYDNYAIVSGAKDTSFIQIYSRTPNPGPEFIEKYKSYVANFGYDPSKIKDTPQDCEYMSSDQLALMMSMPGMNEAL

SEQ ID NO: 47806 - DNA, 655 bp, Panicum virgatum
  misc_feature: Ceres CLONE 2038914
  misc_feature: Encodes the peptide sequence at SEQ ID NO. 47807
acctcatactcttccctgatcagaccattggtactttgtctagaaaaggacgctgctcaagcatgagctggtttccatgctagtttcaatagacaggaagccatgaaatcaatccatttctcatgcaagaagcacagcatcagaccgcacataccttccattggccttgcccttgttctgctcatctccttggtgtcctgtgccagttcctgcacagagctggagagaacctccctcctccagttcctcacagagctctcgcaggatgccgacctcaccaagttttggcaaggtaatgactgctgcaaatgggaaggaattgcctgcaaccaaaatgggacagtcaccactgtctcgctgaattacaagggccttgagggccgtatctcgcagtcccttgggaacctcaccggcctgcagcacctgaacttgtcctacaattcactgtccggtggcctgccgccgggattggtgacatccagcagcatcattgtccttgacgtcagcttcaaccagctcaatggagacctgcatgagctgccatcttcagcccatggccactctctacaggtacttaacatttccagcaacttgtttacaggggagtttacttccacaacattgaaagggatggagaatttgatcgcactcaatg

SEQ ID NO: 47807 - protein, 184 aa, Panicum virgatum
  misc_feature: Ceres CLONE 2038914
  misc_feature (38)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MKSIHFSCKKHSIRPHIPSIGLALVLLISLVSCASSCTELERTSLLQFLTELSQDADLTKFWQGNDCCKWEGIACNQNGTVTTVSLNYKGLEGRISQSLGNLTGLQHLNLSYNSLSGGLPPGLVTSSSIIVLDVSFNQLNGDLHELPSSAHGHSLQVLNISSNLFTGEFTSTTLKGMENLIALN

SEQ ID NO: 47808 - DNA, 679 bp, Panicum virgatum
  misc_feature: Ceres CLONE 2038918
  misc_feature: Encodes the peptide sequence at SEQ ID NO. 47809
aaaaaaaaaaaagccgcagagcagagcagaggagcacaagtgaagtgaacgagagctagcgagctctgatctagtcgcctagctagctgcctcaagctgcatagctagtggtggtataattagcaggcaggcatccgccatgggtgtgggcaaggtcctgaacgaggtgaagccgtacctgtacatggtgctgctgcaggtggggttctccgggatgtacatcgtctccgtcgcctccctccgcctcggcatgagccacttcgtcctcgtcgtctaccgcaacctcgtcgccaccctcctcctggcccccttcgccctcctcctcgagaggggagtgaggcccaagatgacgccgctcatcttcctcaaggtcatggggctcgtcctgctcgagcctgtgctggaccagaacatgtactacctgggggcgaagctgacatcggcggggttcgcctccgcgctcgtcaacatcctcccggccgtcaccttcatcatggcgctgctcctcaggatggagaggctgaggctgcggagcctccacagccaggccaagatcttcggcacggtctgcaccgtcgccggcgccgtgctcatggtcctctaccacggccccgtcgtggagttcccgtggaccaggggccaccaccacgccgccgccgagggcgccgcggcgacccaa

SEQ ID NO: 47809 - protein, 179 aa, Panicum virgatum
  misc_feature: Ceres CLONE 2038918
  misc_feature: Functional homolog of the protein sequence given in SEQ ID NO 50933
  misc_feature: Useful for making plants with modulated biomass
  misc_feature: Useful for making plants with modulated flowering time
MGVGKVLNEVKPYLYMVLLQVGFSGMYIVSVASLRLGMSHFVLVVYRNLVATLLLAPFALLLERGVRPKMTPLIFLKVMGLVLLEPVLDQNMYYLGAKLTSAGFASALVNILPAVTFIMALLLRMERLRLRSLHSQAKIFGTVCTVAGAVLMVLYHGPVVEFPWTRGHHHAAAEGAAAT

SEQ ID NO: 47810 - DNA, 517 bp, Panicum virgatum
  misc_feature: Ceres CLONE 2038920
  misc_feature: Encodes the peptide sequence at SEQ ID NO. 47811
aagccgagcaacgcagagaaaggcgtcttcgtactcgcctctctccgcgactcgaagctttccccccaacccccattccccaccgccgccgccccacccttccgtcgacaccatgagggagtgcatctcgatccacatcggtcaggccggtatccaggtcggaaacgcgtgctgggagctctactgcctcgagcatggcattcaggtaccaatccgtccatttcgccttcgttttcgctccgtggtggtagatctgtggtcgatataggtgtttctccggtcgattgtgctgggtttagtggatctgagtggtgggtggaaatggcattagaattaggtgaaactgtgcggatctggctgtctacgatggtggctgttcagatctgcggttgctaggcctaggctgtagatctggtgagattatggccattcacagccgctattgctatagatctgggtatgtagatgtataatttgaatgggaattagccagaatagcacattattttatttggtc

SEQ ID NO: 47811 - protein, 51 aa, Panicum virgatum
  misc_feature: Ceres CLONE 2038920
  misc_feature: Functional homolog of the protein sequence given in SEQ ID NO 50141
  misc_feature: Useful for making plants with altered cell wall content and/or composition
  misc_feature: Functional homolog of the protein sequence given in SEQ ID NO 50258
  misc_feature: Useful for making plants with modulated flowering time
MRECISIHIGQAGIQVGNACWELYCLEHGIQVPIRPFRLRFRSVVVDLWSI

SEQ ID NO: 47812 - DNA, 702 bp, Panicum virgatum
  misc_feature: Ceres CLONE 2038964
  misc_feature: Encodes the peptide sequence at SEQ ID NO. 47813
aaatattggatgtgacattttttttatttacgggatttacgcgttgtgattcgcctcagcagccatctcctccctttcgcatctccgccaccagccatcctccccctccacgccgccggtgacgactccgtcgagccactccgcagcaggcgccggcgaccatgcaccgcgccgtatcgggcctcagcgccctcaagcggcatagggcagatgctcaaatgatgaatattgcaattaggtctgccagcacaagtgttgcacagagctcatcaggcggcttctggacttggttgactggtgcacggtcaaatgcattacctcctccggatttcgcgcttccaggagtgactattcctcctcctctacctgacctcgtggagcctggcaagacaaaaatcacaacactttcgaatggtgtaaaaatagcctctgagaaatctgcaggatcatcttgttctgttggagtttatattgattgtggttctgtatatgaggcacctgagacaacaggtgtcagtcagctgttgaagacaatggcctttgcaaccactaccaacaggagtgaattgcgcgttgtgcgtgaaattgaggcgataggtggcagtgccaaagcatctgcaagccgtgagatgatgagctacacttatggattgctgaaaacatacatgcctgaaatggttgaggtgcttgttgactgtgtac

SEQ ID NO: 47813 - protein, 180 aa, Panicum virgatum
  misc_feature: Ceres CLONE 2038964
  misc_feature (87)..(180): Pfam Name: Peptidase_M16 Pfam Description: Insulinase (Peptidase family M16)
  misc_feature: SWISSPROT Homolog: EC 3.4.24.64 Mitochondrial processing peptidase
MHRAVSGLSALKRHRADAQMMNIAIRSASTSVAQSSSGGFWTWLTGARSNALPPPDFALPGVTIPPPLPDLVEPGKTKITTLSNGVKIASEKSAGSSCSVGVYIDCGSVYEAPETTGVSQLLKTMAFATTTNRSELRVVREIEAIGGSAKASASREMMSYTYGLLKTYMPEMVEVLVDCV

SEQ ID NO: 47814 - DNA, 707 bp, Panicum virgatum
  misc_feature: Ceres CLONE 2038977
  misc_feature: Encodes the peptide sequence at SEQ ID NO. 47815
tccatcccgggagacagctgaaagaaagttctcagaagcttggagcaccactcgcttgacacttctccggttcttcgcctgcttcctgtcaagcaccgatcttgcatcaagagggcatcaattttgagtcaaacaacagcagtgtcccagttcctgaaaacataacaagctgacaatattttcagaaagcatgaagttgctagcttttgtgctagttttattggtatgtctacgatcttctgctgctgctgagttccaagttgaagcactctatgaaatgaggcaacacctcatcgataacagtggtgtccttaatgactggaaggataatcaaatgagcgcctgctattgggaccatatcacttgtcaagacaacaaatttgttacaaaaataagtttgtcctcatctggattgacaggggtcttgtcacccagcatagcaaagctaacaaatttacaacagctgttattgaatggcaacagcataactggaggaattccacaggagtttgggaacctatcaaatttaacaactctaaaccttggacgaaataatttaaatggctcaataccggattccctaggccatcttcctaaacttgaaattctggatctaagccaaaacaatttaagcgggagtattccaagctctttcttaaatcttccatcattgaatgatatcaaccttgcgtataataatcttagcg

SEQ ID NO: 47815 - protein, 172 aa, Panicum virgatum
  misc_feature: Ceres CLONE 2038977
  misc_feature (20)..(60): Pfam Name: LRRNT_2 Pfam Description: Leucine rich repeat N-terminal domain
  misc_feature: SWISSPROT Homolog: EC 2.7.11.1 Non-specific serine/threonine protein kinase
MKLLAFVLVLLVCLRSSAAAEFQVEALYEMRQHLIDNSGVLNDWKDNQMSACYWDHITCQDNKFVTKISLSSSGLTGVLSPSIAKLTNLQQLLLNGNSITGGIPQEFGNLSNLTTLNLGRNNLNGSIPDSLGHLPKLEILDLSQNNLSGSIPSSFLNLPSLNDINLAYNNLS

SEQ ID NO: 47816 - DNA, 736 bp, Panicum virgatum
  misc_feature: Ceres CLONE 2038991
  misc_feature: Encodes the peptide sequence at SEQ ID NO. 47817
cccaccccaccgatctcctcctcctcctcttccgccgccgccgcctccttcctcctcctctgtcccagagggaggcaagctcaaaccctagaccattgcccgatcgccatgtccgccgctcaacttctacgccactcccgcaagctgcggactttgcagaatgctatagattgtgaccgtactactcttgttcggcacttttccagtgcttccggctcctttcgcgtcaacgaaaatggtgctgcaaaaagaactggcggtaccaattttcgccaacatggccagcctgcgaaaggatttgagacattcaaggtgtcactaggcgtaaacagaagctacatctcgagaagggcatctaccaacagtatcccgagtggcctcaatggttcattctcaagacaggtggcttcagcacggtctttctcaagtaatgcagatcttccgcctcatcaggaaattgggatgccttctctctccccaaccatgactgagggaaacattgccaagtggctgaagaaggaaggagacaaggtttcccctggtgaggttctctgcgaggtggaaactgataaagccaccgtggagatggagtgcatggaagagggctatcttgctaagattattcatggagatggtgccaaggagattaaagttggagagataattgctgttactgtgggaagaagagggtgatattgagaagtttaaggactataagccttcatcttcagctgaa

SEQ ID NO: 47817 - protein, 194 aa, Panicum virgatum
  misc_feature: Ceres CLONE 2038991
  misc_feature (115)..(189): Pfam Name: Biotin_lipoyl Pfam Description: Biotin-requiring enzyme
  misc_feature: SWISSPROT Homolog: EC 2.3.1.12 Dihydrolipoyllysine-residue acetyltransferase
MSAAQLLRHSRKLRTLQNAIDCDRTTLVRHFSSASGSFRVNENGAAKRTGGTNFRQHGQPAKGFETFKVSLGVNRSYISRRASTNSIPSGLNGSFSRQVASARSFSSNADLPPHQEIGMPSLSPTMTEGNIAKWLKKEGDKVSPGEVLCEVETDKATVEMECMEEGYLAKIIHGDGAKEIKVGEIIAVTVGRRG

SEQ ID NO: 47818 - DNA, 664 bp, Panicum virgatum
  misc_feature: Ceres CLONE 2039015
  misc_feature: Encodes the peptide sequence at SEQ ID NO. 47819
acacctagatttcctctcctctcctctccactcctctcctcgccgagctagggacggccgccctcactcgccgctgcgccctgctgcttctcttcgtcctcgcccgtccggatctgaactggcctttcaataacaaggaaacaccttaaggaatgcagaaagatgtgcttgcatgttaaagagctacctagtgagggacttggcagggtagccgcccatatttcttctttgccgcctcttgatgacattggggctcatcaacacgcacagctcctgctccttgtgcttctgcacaatggggttcgacgtggcagctcaaccatcttcttagagaaccaccttgggggagacggttgaagtcttcaataaacacttgcaggcttcttgttagtccgtttcaagtcttggatcagtgcggccttttgtgtacatatagtatacattcagcttgatggcagagcataaaggaaatgttttgatgcagaaatatgagatgggaaagatgcttggacaagggacctttgcaaaggtctaccatgcccgtaacatgaagactttagaaagtgtggcgataaaggtgattgacaaggagaaggttatgaaggttggcctcatcgatcagatcaagcgggaaatctctgtcatgaagctagtgaggcatccc

SEQ ID NO: 47819 - protein, 70 aa, Panicum virgatum
  misc_feature: Ceres CLONE 2039015
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MAEHKGNVLMQKYEMGKMLGQGTFAKVYHARNMKTLESVAIKVIDKEKVMKVGLIDQIKREISVMKLVRH

SEQ ID NO: 47820 - DNA, 719 bp, Panicum virgatum
  misc_feature: Ceres CLONE 2039029
  misc_feature: Encodes the peptide sequence at SEQ ID NO. 47821
aaaaaaaccctcccacctgggctcccccgcctccacgccgctccgctacgcgcgagccactgacccgcctcgcctagtccgcctccgctgcctctcttctcctccggagctcgcctctgcacattagtggaagccgagctgacaacaatctatcaagagttgcttcaacatggatactggctgtttatcatctatgaacattactggagtgagccaagcaagatcttttgcggggcaatttcctacccggagatgctttgcaagtagtcaccttgcaagctttgctgtgaaatctcttgtcttgaggaataaaggaagaagctcacaccgtagacattctgctttgcagattgtctgcaaggattttccaagacctccgctagaaagcacaataaactatttggaagctggacagctctcttcattttttaggaacagcgaacgccccagtaaaccattacaggtcgtgattgctggtgcaggattagctggtctgtcaacagcaaaatatctggcagatgcaggccataaacccatattgcttgaggcaagagatgttttgggcggaaaggtctgatagatacttgcatgattgtttaccactctcggaactgctcgtgtttactgtttccaccatttgttccttttatgttttttttgtgtgtttatgcattgaacagatagctgcttggaaggatgaagatggagattggtacgag

SEQ ID NO: 47821 - protein, 135 aa, Panicum virgatum
  misc_feature: Ceres CLONE 2039029
  misc_feature: SWISSPROT Homolog: EC 1.4.3.2 L-amino-acid oxidase
MDTGCLSSMNITGVSQARSFAGQFPTRRCFASSHLASFAVKSLVLRNKGRSSHRRHSALQIVCKDFPRPPLESTINYLEAGQLSSFFRNSERPSKPLQVVIAGAGLAGLSTAKYLADAGHKPILLEARDVLGGKV

SEQ ID NO: 47822 - DNA, 695 bp, Panicum virgatum
  misc_feature: Ceres CLONE 2039033
  misc_feature: Encodes the peptide sequence at SEQ ID NO. 47823
aacgactctcggcaacggatatctcggctctcgcatcgatgaagaacgtagcaaaatgcgatacctggtgtgaattgcagaatcccgcgaaccatcgagtttttgaacgcaagttgcgcccgaggccttctggttgagggcacgtctgcctgggcgtcacgcaagcaaaactgcaaagtaatacaaattcgacaagctagctacaccccccatcatggagctaagtgcagcaacgctcctcttcttcttcctcctttccttgccaattcttgtgaccttgctaagccgcaaatcaactccaacctccaagaagaggcggcctcctggcccgtggaacctccccttgattggaagcctcctccacttcatcaaatcgcatccgccgatcgttctccgggacctggccaacaagtatggccctgtgatgttcctccggatgggccaggttgacactctcgtgatatcctcgccggcggcagcgcaggaggttctccgcgacaaggatgtcatcttcgcgtcgaggccgaccatcgtggcttcggaggtcttctgctacggaaacctcgatatcggcttctcgccatatggcgcctattggcggacgctgcgcaagctctgcacggtggagctcctcagtgcaaagatggtgcggcagttcgcacccatcagggataacgagacgttgtccctcatca

SEQ ID NO: 47823 - protein, 160 aa, Panicum virgatum
  misc_feature: Ceres CLONE 2039033
  misc_feature: SWISSPROT Homolog: EC 1.14.13.68 4-hydroxyphenylacetaldehyde oxime monooxygenase
MELSAATLLFFFLLSLPILVTLLSRKSTPTSKKRRPPGPWNLPLIGSLLHFIKSHPPIVLRDLANKYGPVMFLRMGQVDTLVISSPAAAQEVLRDKDVIFASRPTIVASEVFCYGNLDIGFSPYGAYWRTLRKLCTVELLSAKMVRQFAPIRDNETLSLI

SEQ ID NO: 47824 - DNA, 686 bp, Panicum virgatum
  misc_feature: Ceres CLONE 2039038
  misc_feature: Encodes the peptide sequence at SEQ ID NO. 47825
cttcgcgccgccgctccgatacacctagctccagccctctcctcctccccttcgggccaccaccaagcccttgcatccccatacaccatggcggcggcggcaggcggaggcgcgccgcgggcgctgtcccagaaggagcaggacgtccagatgatgctcgccgccgacgtccacctgggcaccaagaactgcgacttccagatggagcgctacgtcttcaagcgccgcaccgacggcatctacatcatcaaccttgggaagacatgggagaagctccagctggcggcgagggtaatcgttgccatcgagaaccctcaggacatcattgtccagtccgcccgcccctacggccagcgcgccgtcctcaagttcgcgcagtacactggtgcccatgctattgctgggaggcacacccctggaaccttcaccaatcagctgcagacgtccttcagtgagccccgactgctcatccttaccgacccaaggactgaccaccagccgatcaaggagtctgctctggggaacatccccaccattgccttctgtgatactgactctcccatgcggtatgtcgatatcggcatcccagccaacaacaagggaaggaacagcattggatgcctgttctggctcttggcaaggatggttctccagatgaggggcactatcctccctggtcacaagtg

SEQ ID NO: 47825 - protein, 199 aa, Panicum virgatum
  misc_feature: Ceres CLONE 2039038
  misc_feature (23)..(191): Pfam Name: Ribosomal_S2 Pfam Description: Ribosomal protein S2
MAAAAGGGAPRALSQKEQDVQMMLAADVHLGTKNCDFQMERYVFKRRTDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGRNSIGCLFWLLARMVLQMRGTILPGHK

SEQ ID NO: 47826 - DNA, 511 bp, Panicum virgatum
  misc_feature: Ceres CLONE 2039039
  misc_feature: Encodes the peptide sequence at SEQ ID NO. 47827
aaaaaaaaaaacaccaccaccacccaacccccgttcctcgcagttgcagcacgctcttctgctccaagccaggagagcaaggccgggcccaacgcgcggcggatggcggagacggagcccaccaccaacggcggcagcgctggcggcggcatcggggccatcctcgccgccggcgaccgggacttcctcgtccgcaactccggcgagcaggtgaagatcagcagcatagaggcgagccctgtggccctctacttctcagcctcatggtgcccgccatgcaggcggttcacacccaagctgatcgaattatacaaagaactggcctctcagggcaagagctttgaggttgtatttgtttcaggtgatcaggatgaggaagcattcaattcatactttggaaagatgccatggttggctgtccctttctctgactctgaaggccgtgaaggccttgatggccgggttaaggtatctgggatcccacaccttgtcattcttgatgcaaaaaact

SEQ ID NO: 47827 - protein, 136 aa, Panicum virgatum
  misc_feature: Ceres CLONE 2039039
  misc_feature: SWISSPROT Homolog: EC 1.8.1.8 Protein-disulfide reductase
MAETEPTTNGGSAGGGIGAILAAGDRDFLVRNSGEQVKISSIEASPVALYFSASWCPPCRRFTPKLIELYKELASQGKSFEVVFVSGDQDEEAFNSYFGKMPWLAVPFSDSEGREGLDGRVKVSGIPHLVILDAKN

SEQ ID NO: 47828 - DNA, 539 bp, Panicum virgatum
  misc_feature: Ceres CLONE 2039046
  misc_feature: Encodes the peptide sequence at SEQ ID NO. 47829
actagctttccccttctgtgcagtcacggaagcacacggcggaagcaagggattaaagggaccatggggcagaagcatcttctgttgctcacttgtttttgggtcctgtcatgtgccgctactgcttcatgcttcctccgatggactgcaaagaatcaacgtcaacaagaagagactggaccagggagctttgactgctgcgaaattgcctaggcatgagactcgccttcggagaaggcgtgatggttctcgccagtctcttggtgactcaagcgatgacataattgctttggacaactaccaggacactcgatactttggagagattgacatcggaacaccaccacagaacttcactatgatattctacaccggaagctgcagctgatggattccctcctcaaaatgctatttctcgatagcatgctacttacaccgcagatacaggtcagtcaagtcgaggacttaaaaaaaaacgggggaaactggctcaataacatatggttctgggcaaattgctggcttcttcaatgaaaaca

SEQ ID NO: 47829 - protein, 128 aa, Panicum virgatum
  misc_feature: Ceres CLONE 2039046
  misc_feature (44)..(126): SWISSPROT Homolog: EC 3.4.23.40 Phytepsin
  misc_feature (97)..(126): SWISSPROT Homolog: EC 3.4.23.34 Cathepsin E
  misc_feature (97)..(126): SWISSPROT Homolog: EC 3.4.23.5 Cathepsin D
  misc_feature (96)..(126): SWISSPROT Homolog: EC 3.4.23.1 Pepsin A
  misc_feature (99)..(126): SWISSPROT Homolog: EC 3.4.23.2 Pepsin B
  misc_feature (97)..(126): SWISSPROT Homolog: EC 3.4.23.3 Gastricsin
LAFPFCAVTEAHGGSKGLKGPWGRSIFCCSLVFGSCHVPLLLHASSDGLQRINVNKKRLDQGALTAAKLPRHETRLRRRRDGSRQSLGDSSDDIIALDNYQDTRYFGEIDIGTPPQNFTMIFYTGSCS

SEQ ID NO: 47830 - DNA, 725 bp, Panicum virgatum
  misc_feature: Ceres CLONE 2039051
  misc_feature: Encodes the peptide sequence at SEQ ID NO. 47831
agccgaaaccctcgcctcgccctgcccctcgccgccgccgccgcagcgcccctcgtcccggccgtcctccgccccccaagcgcagccggaggcaacagatccggtcggatccgatgtcgggcgggactggctcgtccgggcgcgcggccccgcggtacgcgccggacgacccgtcgctgcccaagccgtggcgcggcctcgtcgacggcaccaccggctacctctactactggaacccggagaccaacgtcacgcagtacgagaagcccacgcgccccgaggaccagctcccgccgcccccgcccccgctgcctcccccgcctccccggagccgcgaccgccgcgagaggtccagatcccgctcccgcaccccgccccggcgcgaccacagggaccgcgacaggcgccacgacgagcacgcgtcgtccaagtcggcggcttcccaccgccatcccgctccggccgccgccgccgtacccgatgatccgtccaccgaggcgtaccgccgccgccacgagatcaccgtcacggggggtaacgtgccgcctcccataacttcatttgaggctggtggctttccgtcagaaattctcaaggaggtatggaatactttggtgaaacccttgacccatgatctaactctaaccctaacagagtcgcatgcgaaggatcaagatgttccaatgtgccaagcgatggaccgcggatgtgttttccagctcttg

SEQ ID NO: 47831 - protein, 203 aa, Panicum virgatum
  misc_feature: Ceres CLONE 2039051
  misc_feature (22)..(52): Pfam Name: WW Pfam Description: WW domain
MSGGTGSSGRAAPRYAPDDPSLPKPWRGLVDGTTGYLYYWNPETNVTQYEKPTRPEDQLPPPPPPLPPPPPRSRDRRERSRSRSRTPPRRDHRDRDRRHDEHASSKSAASHRHPAPAAAAVPDDPSTEAYRRRHEITVTGGNVPPPITSFEAGGFPSEILKEVWNTLVKPLTHDLTLTLTESHAKDQDVPMCQAMDRGCVFQL

SEQ ID NO: 47832 - DNA, 712 bp, Panicum virgatum
  misc_feature: Ceres CLONE 2039078
  misc_feature: Encodes the peptide sequence at SEQ ID NO. 47833
aagctctagttgcatagcagagcaagcgatccaaaagtccctgagattttcctagatctcgagttcgcctgctagtttcgattccttcttcttctcccgttcgagcaagcgattccggtggcaatggccaagggcgagggaccggcgatcgggatcgatctcggcaccacctactcgtgcgtcggcgtgtggcagcacgaccgggtggagatcatcgccaacgaccaggggaaccgcaccacgccgtcgtatgtcgccttcaccgacaccgagcgtctcatcggcgacgccgccaagaaccaggtcgccatgaaccccaccaacaccgtcttcggtacgtgctcgctgctccggctcctaccacctttaatttgttggtgctgcgcttctgtgaatgcttacggcctctagcatgcgtgactagtttatttagttcgatctagtttagcctctgaaattggattcgtattacctatgtgctgattataccgtgctttatagataccacataggcacatgacagtaggaatcaacgtagaaccttcacagaattattgttgtggctatcgaattaagtaatctaggtgcaatggactgctgaattttgagatacactgctcagatattatttgctgcttaatagtatgttctgcatctgttaaattcggattcaaaaattttctgctaaacttagccgtaggaattcatactc

SEQ ID NO: 47833 - protein, 95 aa, Panicum virgatum
  misc_feature: Ceres CLONE 2039078
  misc_feature: Functional homolog of the protein sequence given in SEQ ID NO 50336
  misc_feature: Useful for making plants with modulated heat sensitivity
MAKGEGPAIGIDLGTTYSCVGVWQHDRVEIIANDQGNRTTPSYVAFTDTERLIGDAAKNQVAMNPTNTVFGTCSLLRLLPPLICWCCASVNAYGL

SEQ ID NO: 47834 - DNA, 658 bp, Panicum virgatum
  misc_feature: Ceres CLONE 2039084
  misc_feature: Encodes the peptide sequence at SEQ ID NO. 47835
aatcttattgagcatctcaaagctgagtctactgcagaaatgacagaaaaatcaaaggagcgtcaggaagttgcaaataagctgaaatcgttggaggaaagaaaagaaatgttagaagagcagctgggagtgctaaagtatagaacaacagatctgtctaattttgttcttcaagagagggctgatttagttgatgagctgactggactcaccaataccattggggaggtaatttatggaggtgaaaacctgatgtcagattttagaaggatcacgcataaagttaatgaagaggaaccatccgatgacaagtctagcttagataaaactaaagctagaacttctgcatctttgatcaggaacaaatcagggcatgttctggagagaagatcacctctgaaggagcacaactactagtctttgtacctggtagataggtcagatcatgtattagatttataccttttcttttccttccctaatgccacgcaatggctgtggcctgtgggttatccaacattttttttaatggactggatttgaattacatagtttccccagtgttgaatggaatcaagtctattctggatttgctgctacttactgtggagcactgttggatactctgattaataaacttcattggttacatcctgat

SEQ ID NO: 47835 - protein, 138 aa, Panicum virgatum
  misc_feature: Ceres CLONE 2039084
  misc_feature: SWISSPROT Homolog: EC 6.1.1.11 Serine--tRNA ligase
NLIEHLKAESTAEMTEKSKERQEVANKLKSLEERKEMLEEQLGVLKYRTTDLSNFVLQERADLVDELTGLTNTIGEVIYGGENLMSDFRRITHKVNEEEPSDDKSSLDKTKARTSASLIRNKSGHVLERRSPLKEHNY

SEQ ID NO: 47836 - DNA, 603 bp, Panicum virgatum
  misc_feature: Ceres CLONE 2039086
  misc_feature: Encodes the peptide sequence at SEQ ID NO. 47837
agagagcatcgctcgcccacacttgccccgcccggcgtcgccccctgcctccgccgccgtcgggcctctgctgctcgccatggaggcgagcgccgggctggtggccggctcgcacaaccggaacgagctggtgctcatccgggggcacgaggagcccaagccgctgcgcgcgctgagcgggcaggtctgcgagatatgcggcgacgaggtcgggctcacggtggacggcgacctcttcgtcgcctgcaacgagtgcggcttccccgtgtgccgcccctgctacgagtacgagcgccgggagggcacgcagaactgcccccagtgcaagacccgctacaagcgcctcaaggggagcccgagggtggccggggacgacgacgaggaggacatcgacgacctggagcacgagttcaacatcgacgacgagaagcagcagcagctgcagctgcaggcgggcggcatgcagaacagccagatcaccgaggcgatgctgcacggcaagatgagctacgggagggggcccgacgacggcgagggcaacaacaccccgcagatcccgcagatcatcaccggctcccgctccgtgccggtgagcggtgagtt

SEQ ID NO: 47837 - protein, 174 aa, Panicum virgatum
  misc_feature: Ceres CLONE 2039086
  misc_feature: SWISSPROT Homolog: EC 2.4.1.12 Cellulose synthase (UDP-forming)
  misc_feature: Functional homolog of the protein sequence given in SEQ ID NO 51500
  misc_feature: Useful for making plants with altered cell wall content and/or composition
  misc_feature: Useful for making plants with modulated biomass
  misc_feature: The sequence is a functional homolog of SEQ ID NO 26 in US patent 7312377
MEASAGLVAGSHNRNELVLIRGHEEPKPLRALSGQVCEICGDEVGLTVDGDLFVACNECGFPVCRPCYEYERREGTQNCPQCKTRYKRLKGSPRVAGDDDEEDIDDLEHEFNIDDEKQQQLQLQAGGMQNSQITEAMLHGKMSYGRGPDDGEGNNTPQIPQIITGSRSVPVSGE

SEQ ID NO: 47838 - DNA, 689 bp, Panicum virgatum
  misc_feature: Ceres CLONE 2039088
  misc_feature: Encodes the peptide sequence at SEQ ID NO. 47839
aagctctagttgcatagcagagcaagcgatccaaaagtccctgagattttcctagatctcgagttcgcctgctagtttcgattccttcttcttctcccgttcgagcaagcgattccggtggcaatggccaagggcgagggaccggcgatcgggatcgatctcggcaccacctactcgtgcgtcggcgtgtggcagcacgaccgggtggagatcatcgccaacgaccaggggaaccgcaccacgccgtcctacgtcgccttcaccgacaccgagcggctcatcggcgacgccgccaagaaccaggtcgccatgaaccccaccaacaccgtcttcggtacgtgccaggcgcccccccccccttcgccaattagtgctgtttgattcctcaagcttgcgcgcgtactcaatttatctagttgtatgcgtcggaggtttctaagatatttgtagatctgctagcatttgttttactgcgagcgttagctgctctgttttgtgggagacacgagtagcgtagcagtaaccattgggaagtgatttgtttagtgtgagtagtagttgctttgtttgtgttctctacaacatgagtagcattaaccattagcaaggcggacctatctgtgaaatctgtaggtctgaattacatgctggcatgttgccgttttcgtgcaatcctctgttttcgcaac

SEQ ID NO: 47839 - protein, 85 aa, Panicum virgatum
  misc_feature: Ceres CLONE 2039088
  misc_feature: Functional homolog of the protein sequence given in SEQ ID NO 50336
  misc_feature: Useful for making plants with modulated heat sensitivity
MAKGEGPAIGIDLGTTYSCVGVWQHDRVEIIANDQGNRTTPSYVAFTDTERLIGDAAKNQVAMNPTNTVFGTCQAPPPPSPISAV

SEQ ID NO: 47840 - DNA, 689 bp, Panicum virgatum
  misc_feature: Ceres CLONE 2039094
  misc_feature: Encodes the peptide sequence at SEQ ID NO. 47841
gatgaccccgcgccggcgtcgccccgcactcacacgccaccgctaacggccggccgccatggcctcatcctccgagtccgagtccagcaagcccgcgcgccctccgtcccgcgacttcctcgcccacctcgaggcctacctcgcccgccgcgacggcgtcgacaagctcctcaagatctcccgctactccgcgcgcctcgcgctcgccgcgggcccgccgctaccgcccgccgccgccgcccgcctcaagtccttcgagtccagcgtcgggctcagccgcaaggccttccgcctcggcaagttcgtgcagtccctcaacgccctccgcgcccacccgcacccgcccccggtcctcgccatcctcgcgtgcggcggcgagggcgtctcctacttcctcgagcagttcgtctggctcgctaaggcggggctcctgccagcgcacctcctcccgcgcctccagcgcctcagcgcctgggccgagctgctgggctccgtcggctccatcgcgattaagctggaagaggtggcgaggatcgaatcgtccatcaagaagtgccttgcggagggcagcggggaggagagcgaggccgtgaggacgatgcgtggtaagctgctgctgaagcggatgtcggtggtgcaggacgtggcggacgcggtcatggcgctcggagacgtcactaacgggaagg

SEQ ID NO: 47841 - protein, 210 aa, Panicum virgatum
  misc_feature: Ceres CLONE 2039094
  misc_feature (21)..(207): Pfam Name: PEX11 Pfam Description: Peroxisomal biogenesis factor 11 (PEX11)
MASSSESESSKPARPPSRDFLAHLEAYLARRDGVDKLLKISRYSARLALAAGPPLPPAAAARLKSFESSVGLSRKAFRLGKFVQSLNALRAHPHPPPVLAILACGGEGVSYFLEQFVWLAKAGLLPAHLLPRLQRLSAWAELLGSVGSIAIKLEEVARIESSIKKCLAEGSGEESEAVRTMRGKLLLKRMSVVQDVADAVMALGDVTNGK

SEQ ID NO: 47842 - DNA, 682 bp, Panicum virgatum
  misc_feature: Ceres CLONE 2039097
  misc_feature: Encodes the peptide sequence at SEQ ID NO. 47843
gcgcccgagcagcacgaagtcgacgccgtcccacccacatcccagtcctacgaggcgccccgctctcgggatttccagcgggccgcgtcgcgttacctgcggggtcgagccgccgtgccgggtacaaatggtggcggaggaggcccgtcactgcagcagccgccgccgccgcagctgaatcccccccgggagactgttcgcgggcgtttagttgactcatcaatttattgagatattcaacttgcatgagctgattaaaaagcccccttccctggttcacgatggagccatcttgcttgggataccatgttcgtggttttggttctcgcatgatatggctatgcttttttctagtactcattcttcagagttgcagcccggcactttcagactcaccatatttggttggtatgggaagctacgacataactggtcctgctgcagacgttaacatgatgggatatgcaaatgccgaacagatcgcatcaggaattcatttcaggctaaaggctcgtgcattcattgtttctgagcctaatgggaagcgtgttgtgtttgtgaatcttgatgcttgcatggcatcacagcttgttactataaaggtgcttgaaaggcttaaagcaaggtatggagacctttataatgagaacaatgtggctatcagtggaatccatacacatgc

SEQ ID NO: 47843 - protein, 133 aa, Panicum virgatum
  misc_feature: Ceres CLONE 2039097
  misc_feature: SWISSPROT Homolog: EC 3.5.1.23 Ceramidase
MEPSCLGYHVRGFGSRMIWLCFFLVLILQSCSPALSDSPYLVGMGSYDITGPAADVNMMGYANAEQIASGIHFRLKARAFIVSEPNGKRVVFVNLDACMASQLVTIKVLERLKARYGDLYNENNVAISGIHTH

SEQ ID NO: 47844 - DNA, 713 bp, Panicum virgatum
  misc_feature: Ceres CLONE 2039114
  misc_feature: Encodes the peptide sequence at SEQ ID NO. 47845
agcagcaccacagagctcactggagcaatggaagggagcctctgccatgagttcccgactgacctcccagccatcgacgtgtgggaggtctatggcagcctcactctagcgcaattggttccccaattgcttcctcatgtgctatcaaaggttgagcttgtagagggagatggtggcgtcggaacaatactgcttgtcactttcccaccctcaggaacttccggactagcaagttacaaggagaagttcaccgtggtcgacaatgaaaagtacatcaaggaggcagaaaagattgaaggaggctttctagatcttggctttgagaaatatttagtgcgatttgagattgtaggacaagaagatggcccgaccattataagatcaaccatcaagtataaagttgatgccgagcatgaaagcaatgcctcccttgtcagtacaggagctgtggcagccattgctgatgccatcaccaagtacatcaaagagcataagagtcccaagcaagccagcgaacaaacttcggaagaacaagcgaccagacaaaagtcaggagaacaaggcgtctgaagtgattggcaaacaagtttgagcaaattcccttatactattttgttatatatttttctcatgtctctgggatctcctactgccatgtacaaatttatagaaaattatatatatggatattctagagagagagagagagagca

SEQ ID NO: 47845 - protein, 180 aa, Panicum virgatum
  misc_feature: Ceres CLONE 2039114
  misc_feature (1)..(155): Pfam Name: Bet_v_I Pfam Description: Pathogenesis-related protein Bet v I family
MEGSLCHEFPTDLPAIDVWEVYGSLTLAQLVPQLLPHVLSKVELVEGDGGVGTILLVTFPPSGTSGLASYKEKFTVVDNEKYIKEAEKIEGGFLDLGFEKYLVRFEIVGQEDGPTIIRSTIKYKVDAEHESNASLVSTGAVAAIADAITKYIKEHKSPKQASEQTSEEQATRQKSGEQGV

SEQ ID NO: 47846 - DNA, 693 bp, Panicum virgatum
  misc_feature: Ceres CLONE 2039144
  misc_feature: Encodes the peptide sequence at SEQ ID NO. 47847
aaagaggaacgcacaacacacagagataacaaagccttcttcctacagcgcacttgcaatccacagacagagctcagctcatccaagcacacagagcaccagccatgtcgctcgtcaggcgcagcaacgtgttcgaccccttctccatggacctctgggaccccttcgacagcatgttccgctccgtcgtcccgtcgtcgtcctcctccgactccgacaccgccgccttcgccaacgcccgcatcgactggaaggagacccccgaggcgcacgtcttcaaggccgacctccccggcgtcaagaaggaggaggtcaaggtggaggtagaggacggcaacgtgctggtcatcagcggccagcgcagcaaggagaaggaggacaagaacgacatgtggcaccgcgtggagcgcagcagcggccagttcatgaggcgcttccgcctgcctgaggacgccaaggtggagcaggtcaaggccgggctggagaacggcgtgctcaccgtcaccgtgcccaaggccgaggacaagaagcctgaggtgaagtcaatccagatctccggctagagatcatcgtgctcgtgcctgcgctgcgtaacgaagaatgctgctgcccttgagtccgcctgggtcgttctggcgaaataaaaatcgggttcggcgctgtggtctcgtgtagtgtcaagagtccgcgtga

SEQ ID NO: 47847 - protein, 152 aa, Panicum virgatum
  misc_feature: Ceres CLONE 2039144
  misc_feature (48)..(151): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRSNVFDPFSMDLWDPFDSMFRSVVPSSSSSDSDTAAFANARIDWKETPEAHVFKADLPGVKKEEVKVEVEDGNVLVISGQRSKEKEDKNDMWHRVERSSGQFMRRFRLPEDAKVEQVKAGLENGVLTVTVPKAEDKKPEVKSIQISG

SEQ ID NO: 47848 - DNA, 719 bp, Panicum virgatum
  misc_feature: Ceres CLONE 2039155
  misc_feature: Encodes the peptide sequence at SEQ ID NO. 47849
agccttgacccgttcgccgtccgctgggggcgtcgctggagacgcgcccgcctcgggttcttcgccgttgtgtcctccccgccggcgtcctggtggtgctggtcggggccgatcggccgcggagcctccggggctccggagagatatattgtaaaatggaagcactgcgtaatatgaaactccccccaggatttggattctatccttcggatactgaacttattggtcactatctgaagaggaaaatacttgaccagaaaattgaacacgatcttataccagtggtggatatatacaagcatgaaccatgggatttacctgcaaagtgcaattttccaatcgaggacaacaagtggcatttcttcgcctctcgtgataggaagtaccctactggttctaggtcaaacagggcaacagttgctggttactggaaatcaactgggaaggaccgagccataaagctgaacaagcgaactctaggaactaagaagactttagtttttcatgaaggccggcctccctctggtagacgcactgaatggattatgcacgagtactacatagatgagaaggaatgtcaagtcagccctgatatgaaggatgcctttgttctctgtcgtgttactaaaagaagtgactgggcattggagaatgataatgaggcaggcgataggaaccctcatcatcaacaacaaattgatgcttctatatcagttgtg

SEQ ID NO: 47849 - protein, 187 aa, Panicum virgatum
  misc_feature: Ceres CLONE 2039155
  misc_feature (9)..(137): Pfam Name: NAM Pfam Description: No apical meristem (NAM) protein
  misc_feature: The sequence is a functional homolog of SEQ ID NO 612 in the 11/435,388 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: Functional homolog of the protein sequence given in SEQ ID NO 51018
  misc_feature: Useful for biocontainment applications
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 854 in the 11/435,388 US patent application
  misc_feature: Functional homolog of the protein sequence given in SEQ ID NO 51290
  misc_feature: Useful for making plants with altered lignin content
  misc_feature: The sequence is a functional homolog of SEQ ID NO 344 in the 10/666,642 US patent application
  misc_feature: The sequence is a functional homolog of SEQ ID NO 1365 in the 11/479,226 US patent application
  misc_feature: The sequence is a functional homolog of SEQ ID NO 2474 in the 10/374,780 US patent application
  misc_feature: The sequence is a functional homolog of SEQ ID NO 744 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Functional homolog of the protein sequence given in SEQ ID NO 50639
  misc_feature: Useful for making plants with altered terpenoid content
  misc_feature: The sequence is a functional homolog of SEQ ID NO 476 in the 10/666,642 US patent application
  misc_feature: The sequence is a functional homolog of SEQ ID NO 142 in the 10/286,264 US patent application
  misc_feature: The sequence is a functional homolog of SEQ ID NO 324 in the 10/412,699 US patent application
  misc_feature: The sequence is a functional homolog of SEQ ID NO 756 in the 11/479,226 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
MEALRNMKLPPGFGFYPSDTELIGHYLKRKILDQKIEHDLIPVVDIYKHEPWDLPAKCNFPIEDNKWHFFASRDRKYPTGSRSNRATVAGYWKSTGKDRAIKLNKRTLGTKKTLVFHEGRPPSGRRTEWIMHEYYIDEKECQVSPDMKDAFVLCRVTKRSDWALENDNEAGDRNPHHQQQIDASISV

SEQ ID NO: 47850 - DNA, 697 bp, Panicum virgatum
  misc_feature: Ceres CLONE 2039170
  misc_feature: Encodes the peptide sequence at SEQ ID NO. 47851
atgctgtgtcgtcgtttaccacgccacactgcctccacataacatcccatgccgtcgtctcgccgtggcctcctcctcctcctccttgccatggtggcgagcctctccaccgtcgtaataagatccagggacagcccgttcacgaccatggaggcatacccgccgccgattgtagcgctagctgctctcgtcggagaacggctgacggctccacgagcatggttgctgctcctcctccctgtccccatcttggtcgcacgctactcgttcggtgccaagagagccaggaagatgaggccgcagcaagcagacgaccgcctaccgccatcgcctccggcgctgcccgtcctcgggcacctccacctcgtgggctcactcccgcacgtctccctccgtaacctcgcaaggaagcacggccacgacctcatgctgctccgcctcggcgccatgccggtcgtcatcgtgtcgtcgccggccgccgcgcaggcggtgctgcgcacgcacgaccacgtgttcgcgtcccggccgcactccctggtcgccgagatcgtcctctacggcccgtccgacgtcggcttcgcgccacacggcgagtactggcgccaggcgaggaagctcgtcaccacgcacctgctcaccgtcaagaaggtgcaatcgctacgccacgctcgcgaggaagaagtaagggacaccttcg

SEQ ID NO: 47851 - protein, 202 aa, Panicum virgatum
  misc_feature: Ceres CLONE 2039170
  misc_feature: SWISSPROT Homolog: EC 1.14.13.68 4-hydroxyphenylacetaldehyde oxime monooxygenase
MVASLSTVVIRSRDSPFTTMEAYPPPIVALAALVGERLTAPRAWLLLLLPVPILVARYSFGAKRARKMRPQQADDRLPPSPPALPVLGHLHLVGSLPHVSLRNLARKHGHDLMLLRLGAMPVVIVSSPAAAQAVLRTHDHVFASRPHSLVAEIVLYGPSDVGFAPHGEYWRQARKLVTTHLLTVKKVQSLRHAREEEVRDTF

SEQ ID NO: 47852 - DNA, 707 bp, Panicum virgatum
  misc_feature: Ceres CLONE 2039181
  misc_feature: Encodes the peptide sequence at SEQ ID NO. 47853
gccgtcgccgctccctcaccccgacgaatcactgcgccgcaccaccctcccgcggcacgcgacgccgcgctcatcctcccggcgcgctcgacgccgcaccctcctcccgacgggactccctcctcccggcacctcaccctctccttcctcccgacggggcttcgtcctcctgtgcagctcgacgctgctcgtgcttctcgcgacctcctccagcgtcggtggcaaatccagtaattgagtaccattgagccatggctgccaagctgactcgcctccacagtcttcgcgaacgacttggtgccaccttctcctctcatcccaatgagctgattgcactcttttccaggtatgttaaccagggcaagggaatgcttcagcgccatcaactgcttgctgagtttgatgcgctgtttgatagtgacaaggagaagtatgcaccctttgaagacattcttcgtgctgctcaggaagcgattgtgcttcccccctgggttgcacttgctatcaggccaaggcctggtgtctgggactacattcgggtgaatgtaagtgagttggctgttgaggagctgagtgtttctgagtacttggcattcaaggaacagctggtggatggaaacaacaacagcaactttgtgcttgagcttgactttgagcccttcaatgcctcgttccctcgtccttccatgtcaaagtccattggaaag

SEQ ID NO: 47853 - protein, 151 aa, Panicum virgatum
  misc_feature: Ceres CLONE 2039181
  misc_feature: SWISSPROT Homolog: EC 2.4.1.13 Sucrose synthase
  misc_feature: Functional homolog of the protein sequence given in SEQ ID NO 51467
  misc_feature: Useful for making plants with altered carbohydrate content
  misc_feature: Functional homolog of the protein sequence given in SEQ ID NO 51468
  misc_feature: Useful for making plants with altered cell wall content and/or composition
  misc_feature: The sequence is a functional homolog of SEQ ID NO 12 in US patent 7091398
  misc_feature: The sequence is a functional homolog of SEQ ID NO 2 in US patent 7091398
MAAKLTRLHSLRERLGATFSSHPNELIALFSRYVNQGKGMLQRHQLLAEFDALFDSDKEKYAPFEDILRAAQEAIVLPPWVALAIRPRPGVWDYIRVNVSELAVEELSVSEYLAFKEQLVDGNNNSNFVLELDFEPFNASFPRPSMSKSIG

SEQ ID NO: 47854 - DNA, 588 bp, Panicum virgatum
  misc_feature: Ceres CLONE 2039190
  misc_feature: Encodes the peptide sequence at SEQ ID NO. 47855
aaaaccgctcccggcccgcgagctcgctccccgtcggatcaaacagctagggtttcgaaggaagagacgtgtgcggcgacgagatgttcgggcgcgcgccgaagaagagcgacaacacgaggtactacgagatcctcggcgtgcccaaggacgcgtcccaggatgacctcaagaaggcctaccgcaaggccgccatcaagaaccaccccgacaagggcggggaccctgagaaggtgagcgcgcgcggtccgggtctggtctcctcgcttggctccgatctgtctgcggcgggggagtaggcggcaggttggtttgatttggcgggcttgggacggtgtggctaggtcgatttgaggcggcgcggtggatctgaggcggcctggggttcgatgggtttaagggttgggttggccgatgcgttttcagcggtggagggattgggatggggaagcagatacggctctgaattattactattattacctgctacctatctaaagctgttcatgtgatcctgaaattagttactctatgtgattttgattcatcgtatggttgttgattatgctgattatgcctcccgcgttg

SEQ ID NO: 47855 - protein, 71 aa, Panicum virgatum
  misc_feature: Ceres CLONE 2039190
  misc_feature (13)..(71): Pfam Name: DnaJ Pfam Description: DnaJ domain
  misc_feature: Functional homolog of the protein sequence given in SEQ ID NO 50447
  misc_feature: Useful for making plants with altered lignin content
MFGRAPKKSDNTRYYEILGVPKDASQDDLKKAYRKAAIKNHPDKGGDPEKVSARGPGLVSSLGSDLSAAGE

SEQ ID NO: 47856 - DNA, 614 bp, Panicum virgatum
  misc_feature: Ceres CLONE 2039198
  misc_feature: Encodes the peptide sequence at SEQ ID NO. 47857
atcgcgttcctccttcttcggttcggcggcctagggcagtttctcccttcgctttccaatcccatccccaaatttgctgggggcagctccggatctctctgagtttccttggaactttgagctttggaagatgtcaaggaggacagaaattgctgcttccaccaaatccgttgaattggtcaaacaagaagaccatttggagtttgatgatcctgacgaggaagatgaagaggaagaagttgagtatgaagaaattgaggaggaggttgagtatgaagaggtagaagaggaggaagaggaggaggaggaggaaaaatctgaagttgcgtgtgaaggtgatgctaaacatgatagtaaaatggcggatgtttatcagaaggatgaggacgaaaaagagaagcatgctgagcttcttgctcttcctcctcatggatccgaagtgtacgttgggggcatctcctcagatatatcttctgaagatctaaaaaatctatttgagtcggttggagaagtcgtggaggtgcggatacgaggaaagggggataacaagctgtatgcttttgttaatttcagagataaagaactggctttaaaggccatccaaaagttgaaca

SEQ ID NO: 47857 - protein, 161 aa, Panicum virgatum
  misc_feature: Ceres CLONE 2039198
  misc_feature (104)..(160): Pfam Name: RRM_1 Pfam Description: RNA recognition motif. (a.k.a. RRM, RBD, or RNP domain)
MSRRTEIAASTKSVELVKQEDHLEFDDPDEEDEEEEVEYEEIEEEVEYEEVEEEEEEEEEEKSEVACEGDAKHDSKMADVYQKDEDEKEKHAELLALPPHGSEVYVGGISSDISSEDLKNLFESVGEVVEVRIRGKGDNKLYAFVNFRDKELALKAIQKLN

SEQ ID NO: 47858 - DNA, 649 bp, Panicum virgatum
  misc_feature: Ceres CLONE 2039211
  misc_feature: Encodes the peptide sequence at SEQ ID NO. 47859
aacagcaagataaatcttttgattcttctcagtcgcatcaatcttgctgacctcgtcaaactgatgtcgaaaaaaaaatctctttttgtcaaccgaaaattagcagtttcacagttcgattcatcgtgctcaattcagattctgaaggatccatgctacgcgagttgttggacatgtctagagtttcgttcgaaacttggacgttctcgtcgaatctgatccgaccatggccgccctgtgctgagtgctgacatggctttcgcttgactctccttccagcggcaggccagcatggggagctcgaccctcaccgatatgacgctcctgcccggcgtcgagacgatcgtggcggggctggccgccggctcctcctccccgggtccggatggcaaggtcaagaagaagcccatgaagtccctctacctcaagttcttcgacacggcgcccgacggcaagtcccgcatctgcaggctctgcaggaagagctactgcatgaccactgccacggggaatttgggaaagcatcttaataaccgccaccctggttatcaccaacttcctgaaggccccagcttcactgctcagagtaccgtacagactaccatggttactagaagcaagaaacctcatgttccggtgcgagctcggg

SEQ ID NO: 47859 - protein, 119 aa, Panicum virgatum
  misc_feature: Ceres CLONE 2039211
  misc_feature (42)..(84): Pfam Name: zf-BED Pfam Description: BED zinc finger
MGSSTLTDMTLLPGVETIVAGLAAGSSSPGPDGKVKKKPMKSLYLKFFDTAPDGKSRICRLCRKSYCMTTATGNLGKHLNNRHPGYHQLPEGPSFTAQSTVQTTMVTRSKKPHVPVRAR

SEQ ID NO: 47860 - DNA, 693 bp, Panicum virgatum
  misc_feature: Ceres CLONE 2039221
  misc_feature: Encodes the peptide sequence at SEQ ID NO. 47861
aattttcgattcgcttctcttctctcgagcgctgtggtttctccccatcgcggattcgcgagctctctcttctctctcccccccccacccccctcccttcctcgagcgcggtttcggccatggcggcggcggcgcaggcggtcgcgaaggggagcgtggtgtcgccgagcggcaaccgggccgcgccggggctcctgggccggcggatggcgccatcggcggtgcggatcggggcgccctggaggaagaccgcgttcctcggcggcgggaggctggcggtcgggcccatgagatccagatccgcgtcccggactctcgtcgcgtcgccggtgcagatgaacatgaaccttgcgattgggaaatccatgaggtggtgggagaaggggctgcagcccaacatgcgggaggtcgagtccgctcaggacctcgccgattcattggccaacgccggcgacaggctcgtcatcgtagacttattctcccctggctgcggaggttgccgtgctcttcacccaaagatttgccagtttgcggagcagaatccggatgtgctgttcttgcaagtgaactatgaggagcacaagtctatgtgctacagcctccatgtccatgtcctacctttcttcaggttctacaggggagctcagggacgtctctgcagcttcagctgcaccaacgcaactatcaagaagt

SEQ ID NO: 47861 - protein, 191 aa, Panicum virgatum
  misc_feature: Ceres CLONE 2039221
  misc_feature: SWISSPROT Homolog: EC 3.5.1.52 Peptide-N(4)-(N-acetyl-beta-glucosaminyl)asparagine amidase
MAAAAQAVAKGSVVSPSGNRAAPGLLGRRMAPSAVRIGAPWRKTAFLGGGRLAVGPMRSRSASRTLVASPVQMNMNLAIGKSMRWWEKGLQPNMREVESAQDLADSLANAGDRLVIVDLFSPGCGGCRALHPKICQFAEQNPDVLFLQVNYEEHKSMCYSLHVHVLPFFRFYRGAQGRLCSFSCTNATIKK

SEQ ID NO: 47862 - DNA, 497 bp, Panicum virgatum
  misc_feature: Ceres CLONE 2039247
  misc_feature: Encodes the peptide sequence at SEQ ID NO. 47863
gaggagacgccggccgcgccgaaccgaaccgctgacgccgagcgagagaagggagctgccgcgtcgaggaggagtccaagcggctcgccttcatcaggcaggagctggaaggcatggcggatccaacgcggaaggaggtggagtcgatacggaagaggattgacacggtgaaccgtcagctcaagcctctcggcaagagctgcgtcaagaaggagaaggagtacaaggaggtcctggaggcgtacaacgagaagagcaaagagaaagcgctgctagtcaacaggctaatcgagctggtgagcgagagcgagaggatgcggatgaagaagctagaggagctcaacaagacagtcgactcactctactagacgcccagctgatgctcacctccaccgagagctcgcttgacgcctctgtaatctcagtgtgccataaggattcgggacttgttcaaggtgttgcttgtaactgatgtttctcatcgagtgattcttcag

SEQ ID NO: 47863 - protein, 84 aa, Panicum virgatum
  misc_feature: Ceres CLONE 2039247
  misc_feature: Functional homolog of the protein sequence given in SEQ ID NO 50446
  misc_feature: Useful for making plants with modulated biomass
MADPTRKEVESIRKRIDTVNRQLKPLGKSCVKKEKEYKEVLEAYNEKSKEKALLVNRLIELVSESERMRMKKLEELNKTVDSLY

SEQ ID NO: 47864 - DNA, 740 bp, Panicum virgatum
  misc_feature: Ceres CLONE 2039256
  misc_feature: Encodes the peptide sequence at SEQ ID NO. 47865
atcagagagaggtataacgaatttgcacgatgattatgcacagaaccctccgggtcctcttcctccacatctactatttctccatccagtccgctgccaatggcgccactactgccagatgcgttctatctcagtcttcttcccttctccagctgaagcactccttcggcgaaggaatcctcccgtcatggcagccaaacaccaactgctgtcattgggagggtgtcacctgcgacatggcttctgggcacgtcgtaggtctcgacctcggtgatgagtacttccttcagagcaacggcctggaccctgcccttttcaacctcaccttgctcagaaatcttagcctcagtggcaacgatttcgggggagccgagctcccagcttctgggtttgagcggctatcgaagctcgtcaaccttgatctatcttctacaaactttgttggtcagatccccattggtattgcaaatctgaacaagctgcttgctcttgacttgtctgggaatcccaatctgtacctcattgagcccggttttgaaaccttcatagcaaacctaagcaatctgagagagctctaccttgatgagatggacctttctagcagcagggctacttggtcaagcaccgtagcggtctctgttccacgtattcaaataattagcttaatgtcctgtggcttatctggtttcattgacccctccttctcgcaactccgttctcttacgatgattaacctcaga

SEQ ID NO: 47865 - protein, 167 aa, Panicum virgatum
  misc_feature: Ceres CLONE 2039256
  misc_feature: SWISSPROT Homolog: EC 2.7.11.1 Non-specific serine/threonine protein kinase
MASGHVVGLDLGDEYFLQSNGLDPALFNLTLLRNLSLSGNDFGGAELPASGFERLSKLVNLDLSSTNFVGQIPIGIANLNKLLALDLSGNPNLYLIEPGFETFIANLSNLRELYLDEMDLSSSRATWSSTVAVSVPRIQIISLMSCGLSGFIDPSFSQLRSLTMINL

SEQ ID NO: 47866 - DNA, 646 bp, Panicum virgatum
  misc_feature: Ceres CLONE 2039257
  misc_feature: Encodes the peptide sequence at SEQ ID NO. 47867
agcgacaaatcggccaccaccatcctctcccttgctatgccattcctcctcaccaccgctaccgccaccagcccccgccctctcttcccctcctcccctcgccgccaaaaccctaccaacccccacctccgccccccgcctccagcccgccgcctccccggcttcactgccgccgcgccgggcgcccccttcctcccccgcccgccgaggcgaggcatggcgtcgctggcggcgacggcggccgcggccgccgccgcggaggtgacgcacctcacgcagcgcgacgcggcggagatcgacgagcagctcatgggcccgctcgggttcagcgtcgaccagctcatggagctcgctgggttgagcgtcgcggcggccgttgcggaggtttacaagttgagtgaagaacatacaagggtccttattatctgtggtccagggaataatggcggtgatggtctggtagctgctcgtcatctttatcactttggatataggccctctgtttgctacccgaagcgtacgcccaagcctctgtattctggccttgttactcagcttgaatcactgtcgatcccattcatacctgctgaagacctacctcatgacttgtcaagggaatttgatattattcttgatgcaatgtttg

SEQ ID NO: 47867 - protein, 215 aa, Panicum virgatum
  misc_feature: Ceres CLONE 2039257
  misc_feature (107)..(215): Pfam Name: YjeF_N Pfam Description: YjeF-related protein N-terminus
SDKSATTILSLAMPFLLTTATATSPRPLFPSSPRRQNPTNPHLRPPPPARRLPGFTAAAPGAPFLPRPPRRGMASLAATAAAAAAAEVTHLTQRDAAEIDEQLMGPLGFSVDQLMELAGLSVAAAVAEVYKLSEEHTRVLIICGPGNNGGDGLVAARHLYHFGYRPSVCYPKRTPKPLYSGLVTQLESLSIPFIPAEDLPHDLSREFDIILDAMF

SEQ ID NO: 47868 - DNA, 679 bp, Panicum virgatum
  misc_feature: Ceres CLONE 2039267
  misc_feature: Encodes the peptide sequence at SEQ ID NO. 47869
tcttctcacagataagctctcgcgctcccactctttctcctacctccgccgtccgtctttgcgcccaaaccaacccgccgttacaatggagacctcgttcctccccaccacgcttcccactgcgaagcccctccctgcgttccgaaccctttccaccgccgcctcgctccgcccacacccgcgcccccgcacctcgaccatccgcgcggccatcacccggggccgcaaggaggagactgtggccaccgtccgcgagcagctggaggggtgctacctcctggcgggcatcaagtacgagggcctaacggtgaagcagctgcagggcatccgcgacgcgctccccgagacctgcagcctgctggtggcgaagaacacgctggtggggaaggccatcgagggcaccccctgggaggcgctcaagccgtgcatgaagggcatgaacgcctggctcttcgtccacaccgaggaggtccccaccgcgctgaagccctaccgcgccttccagaaggaggagcgcgtcgaggagaccaacgacttcgtcggtgccgtcttcgagggcaagttctacgggccgggcgacttcaaggcgctcgagaccatgcccagtcgtgccgaggtgtacgccaagctgctcggtgcgctgcagggccccgctacgtccctcgtcaccacactgcag

SEQ ID NO: 47869 - protein, 197 aa, Panicum virgatum
  misc_feature: Ceres CLONE 2039267
  misc_feature (43)..(141): Pfam Name: Ribosomal_L10 Pfam Description: Ribosomal protein L10
METSFLPTTLPTAKPLPAFRTLSTAASLRPHPRPRTSTIRAAITRGRKEETVATVREQLEGCYLLAGIKYEGLTVKQLQGIRDALPETCSLLVAKNTLVGKAIEGTPWEALKPCMKGMNAWLFVHTEEVPTALKPYRAFQKEERVEETNDFVGAVFEGKFYGPGDFKALETMPSRAEVYAKLLGALQGPATSLVTTL

SEQ ID NO: 47870 - DNA, 641 bp, Panicum virgatum
  misc_feature: Ceres CLONE 2039280
  misc_feature: Encodes the peptide sequence at SEQ ID NO. 47871
agttcctcggcttccccctcctccaggctccggctccggtccacacgcacagcagctgttattttctcttgttgacgtggtgtccgtccatttttcagtgagcaaagatggtgccgccatctatgagccttgcttcaaaggcggtgcttcccttctcagtacttacttcaagcggcgttacgcaaaggccggtgtcagtaactgcttccttggagaacaagacgagtgatggcagaaggaagttccttaaacttgcgcttgggaaccttggagttgggctgcccaccctgttgggtgctaagaaagctcttgctgatgagcagggtgtctcttcctcaaggatgtcttactcgaggttccttgagtatcttgacaaggacagagtgaagaaggttgatttgtttgagaatggaacaattgctatcgtggaggccatctctcctgagctcggcaatcgtgtgcagagagtccgtgtgcagcttccaggtctaagccaggagcttcttcagaagttgagggaaaagaacattgacttcgccgcacacagcaaccaggaggactctggttcccttctgttcaaccttatcggaaatttggcattcccccttatcctcattggtggtctatttttgctgtcaaga

SEQ ID NO: 47871 - protein, 177 aa, Panicum virgatum
  misc_feature: Ceres CLONE 2039280
  misc_feature (77)..(175): Pfam Name: FtsH_ext Pfam Description: FtsH Extracellular
MVPPSMSLASKAVLPFSVLTSSGVTQRPVSVTASLENKTSDGRRKFLKLALGNLGVGLPTLLGAKKALADEQGVSSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLS

SEQ ID NO: 47872 - DNA, 730 bp, Panicum virgatum
  misc_feature: Ceres CLONE 2039293
  misc_feature: Encodes the peptide sequence at SEQ ID NO. 47873
agatcgacatccgatccctcctcatgtttttgtcataagggtgttcagtgatcactcgatcggcaagcaagcagtagtaagtagtacataattttgagcaagggtgtgcgtgtgggcgccgtcgatcggtctctgccatcaatcggacttcgatcatcaagcgcaaaccaccgagaggaaaacgagccatgaagcttactgcaatgggacagttttcctttgtgttcctggcgtgctgcatgcaagctgtcatctgctcctccattggaaactacacagacatgttcactctactggattttaagaagcaaataattcttgacccacaacaagctctgatgtcctggaatgacagcacccatttctgcagttggaaaggtgtcaggtgttcggtaaagaaaccaagtcgtgtcgcttctcttaatcttacaaatcaaggtctagtagggcaaatctctccttcgcttggaaacctaacattcctgaaagtcctagtcctgtcggctaattcattccttggagagatccctatgtcccttggtcacctacatcaccttcaaatcctctatctgaataacaacacgctacagggaaaaatacctgcccttgcaaactgctcaaagctcacgtggctatccgtgggatggaaccaattaactggagagattcctctagatttgcctactaaccgcctttgaaacacttcgacttggcgcaaacaaccttgctg

SEQ ID NO: 47873 - protein, 169 aa, Panicum virgatum
  misc_feature: Ceres CLONE 2039293
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MKLTAMGQFSFVFLACCMQAVICSSIGNYTDMFTLLDFKKQIILDPQQALMSWNDSTHFCSWKGVRCSVKKPSRVASLNLTNQGLVGQISPSLGNLTFLKVLVLSANSFLGEIPMSLGHLHHLQILYLNNNTLQGKIPALANCSKLTWLSVGWNQLTGEIPLDLPTNRL

SEQ ID NO: 47874 - DNA, 707 bp, Panicum virgatum
  misc_feature: Ceres CLONE 2039295
  misc_feature: Encodes the peptide sequence at SEQ ID NO. 47875
aaaaaaaagagttgctggcggggaggaagaccagtgtgtgaagaccacggtctcacacacacttgcgcactctcagtgtgtgcggtcttcttctttgaccgccggctcggagtggggaaccagccatggggaggtggtggccggctgccctgctgggctgcgcggtggccgtggcggtgctggcggccgccgtcgaatgcgcggtgacctacgacaagaaggcggtgatgattgacgggcagaggcggattctcttctctggatccatacactaccccaggagcacccctgatatgtgggaagggctgattcagaaggctaaagatggaggcttggatgtgattcagacctatgtcttttggaatggacatgagcctactcctggaaattactatttcgaagagaggtacgatttggtcaggttcataaagactgtccagaaggccgggctgtttgtacatctccgcatcgggccctacatttgtggcgagtggaatttcggtggcttcccagtttggttgaagtatgtaccaggcatcagcttcaggacagataacgaacctttcaagacggcaatgcagggtttcactgagaaaatcgtgggaatgatgaagagcgaaaaactctttgcttcccaaggtggccctattatcctctctcagattgaaaatgagtatggtccagaaggcaaagagtttggtgctgct

SEQ ID NO: 47875 - protein, 193 aa, Panicum virgatum
  misc_feature: Ceres CLONE 2039295
  misc_feature (33)..(193): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51324
  misc_feature: Useful for making plants with altered cell wall content and/or composition
  misc_feature: Functional homolog of the protein sequence given in SEQ ID NO 51152
  misc_feature: Useful for making plants with altered carbohydrate content
MGRWWPAALLGCAVAVAVLAAAVECAVTYDKKAVMIDGQRRILFSGSIHYPRSTPDMWEGLIQKAKDGGLDVIQTYVFWNGHEPTPGNYYFEERYDLVRFIKTVQKAGLFVHLRIGPYICGEWNFGGFPVWLKYVPGISFRTDNEPFKTAMQGFTEKIVGMMKSEKLFASQGGPIILSQIENEYGPEGKEFGA

SEQ ID NO: 47876 - DNA, 707 bp, Panicum virgatum
  misc_feature: Ceres CLONE 2039298
  misc_feature: Encodes the peptide sequence at SEQ ID NO. 47877
agtgcgatcgatccatcgtatatcccccctctctccaccttccattgcgaagtaaaatctcaccagtggttgtctactctgccccgcgccgcgccggtagcccgtagccagagcggccactgggatccttcttggttgatcgcctgaggtttcctgaagcgaggtttttatctgaaggaagaaggcaacagtgcagttatcatgtcaggagggtcgtctgaatcttccccattatctgggcaaaatagctttagttctctatcaagtttcaaggaccttgaactatcttcagagtccggttgcttgtccattgttgtactaggtgcttctggagaccttgctaagaagaaaactttcccggcactctttcacctttttcagcagggatttctgcaagctggagaagtccatatatttgggtatgcaagatcaaatctttctgatgatggattaagagaacgcatccgtggatacctcaaaggagcttcagatgaacatctttctcaatttttgcagctaattaaatatgttagtggttcctatgatagtggggaaggatttgagttattaaacaacacaatctctgagtatgaaacatcaaaaaacaatgaatcgggaagctatcgcagactattttatttggcattgcctccatcagtctacccatcagtatgcaaaatgataagatcatattgcatgaatccatc

SEQ ID NO: 47877 - protein, 168 aa, Panicum virgatum
  misc_feature: Ceres CLONE 2039298
  misc_feature (38)..(168): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSSESSPLSGQNSFSSLSSFKDLELSSESGCLSIVVLGASGDLAKKKTFPALFHLFQQGFLQAGEVHIFGYARSNLSDDGLRERIRGYLKGASDEHLSQFLQLIKYVSGSYDSGEGFELLNNTISEYETSKNNESGSYRRLFYLALPPSVYPSVCKMIRSYCMNP

SEQ ID NO: 47878 - DNA, 741 bp, Panicum virgatum
  misc_feature: Ceres CLONE 2039301
  misc_feature: Encodes the peptide sequence at SEQ ID NO. 47879
cttaatttaaatgctcgcatgtcaaggtggatattgagcttctgtaaactagagaacaggataatctctgttgagcgcatttatcaatactgtaagattcctagtgaagcaccactggttattgagaatttccgtccaccatcatcatggcctgagaatggaaacattgaactgattgatctcaaggtacgctacaaggatgatctaccgttagttcttcatggtgtaagctgtgtgtttcctggtgggaaaaagattgggattgtagggcggactggaagtggtaaatctactcttattcaggcccttttccgcctaattgaacccaccggagggaagattataattgataacattgacatttctgccatcggtcttcatgatttgcggtcacggttgagcatcatcccccaagaccctacattgtttgagggcactatcagaatgaatcttgatccacttgaagagcgtcctgatcaagaaatttgggaggcgctagaaaagtgtcagctaggagaggtcattcgttccaaggaagaaaaacttgacagtccagtgctagaaaatggggataactggagtgtgggacagcgccaactcatcgcactgggtagggcgttgctcaagcaggcaaaaattctggtgcttgatgaggcaacggcatctgttgacacagcaacagataatcttatcccaaagatcattcgcagtgaattcaaggactgcacagtctgtaccatt

SEQ ID NO: 47879 - protein, 246 aa, Panicum virgatum
  misc_feature: Ceres CLONE 2039301
  misc_feature (83)..(243): Pfam Name: ABC_tran Pfam Description: ABC transporter
  misc_feature: SWISSPROT Homolog: EC 3.6.3.44 Xenobiotic-transporting ATPase
LNLNARMSRWILSFCKLENRIISVERIYQYCKIPSEAPLVIENFRPPSSWPENGNIELIDLKVRYKDDLPLVLHGVSCVFPGGKKIGIVGRTGSGKSTLIQALFRLIEPTGGKIIIDNIDISAIGLHDLRSRLSIIPQDPTLFEGTIRMNLDPLEERPDQEIWEALEKCQLGEVIRSKEEKLDSPVLENGDNWSVGQRQLIALGRALLKQAKILVLDEATASVDTATDNLIPKIIRSEFKDCTVCT

SEQ ID NO: 47880 - DNA, 577 bp, Panicum virgatum
  misc_feature: Ceres CLONE 2039323
  misc_feature: Encodes the peptide sequence at SEQ ID NO. 47881
agttaataagtaatcacgcataggcaggcattccgatccgatcccattcactgattccctcatcctctccgatgcaacctcgccggcgccgtccccgtccccgtccctaacactaccaaggcacccatggtgttctggtggccgctcctggtgctcgccgccgcctacgcgctctgccgcctggtcctcttcctcatcccccccaccgtcccttcgatcggaatcgacgctgcctacatgttggcgaacgatgacagcttcatctacataccaggaaaaggcaaatgaactcaaaactacaatgtccaatgctaccaaccagcaaccatgaaatacttgggctatttccctgcattgactcctgatgaggtcaaagagcatgatgcacaagccaggaaagctcagaagatatgggcaaaaagcagtttcgagcaaaggcggcagttccttcgcatccttctcaagtatatacttgaacgtcacgatctcatatgctacgtatcatctagggacaccggaaagactatggttgaagcttcattagacgagataatgactacatgcgataagatgaact

SEQ ID NO: 47881 - protein, 83 aa, Panicum virgatum
  misc_feature: Ceres CLONE 2039323
  misc_feature: SWISSPROT Homolog: EC 1.2.1.3 Aldehyde dehydrogenase (NAD(+))
MKYLGYFPALTPDEVKEHDAQARKAQKIWAKSSFEQRRQFLRILLKYILERHDLICYVSSRDTGKTMVEASLDEIMTTCDKMN

SEQ ID NO: 47882 - DNA, 739 bp, Panicum virgatum
  misc_feature: Ceres CLONE 2039334
  misc_feature: Encodes the peptide sequence at SEQ ID NO. 47883
gagcatccagctcatactcccagttcatacatcgtttccaggcaaggcggagcagcaagccgattagaaaggctgccgttttgtgttctccggcacggcagaggtgacagttaagtacatcatgtatcgttcagagcagccggcgaaactcgccatgcccatgcttatactattgccattgctgctgctgtgctatggagttggaaacgtccgctgctcaacggttcatgacagcagcatcgatctgcaggcactgctcgacttcaggcagggcatcaccggcgatccgaatggagccttgagcaattggaccatgaggtcccacttctgtcactggaatggtgtcaagtgcaccttggagaaaccacggcgcgtcgtggggctccaactgacaagccaaagtttgtcaggccaaatcagctcctctcttggcaaccttactttccttaattaccttgacctctcctacaacaactttgttggtcccttacctcttcttggccgcctccaacaactgcaatatctttatttgtacaacaacaatttgtctgggataattcctgatgcacttacaaactgctccaacttgaccgccatagatttatcttcaaacttactagtgggttcaattcctccgaaattaggcctgctatccaaactaggatatctcagtttggagtcaaatcaactgaatggaaagcattcctggtgagcttgggcaattaaagttaaatacctt

SEQ ID NO: 47883 - protein, 185 aa, Panicum virgatum
  misc_feature: Ceres CLONE 2039334
  misc_feature (27)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MPMLILLPLLLLCYGVGNVRCSTVHDSSIDLQALLDFRQGITGDPNGALSNWTMRSHFCHWNGVKCTLEKPRRVVGLQLTSQSLSGQISSSLGNLTFLNYLDLSYNNFVGPLPLLGRLQQLQYLYLYNNNLSGIIPDALTNCSNLTAIDLSSNLLVGSIPPKLGLLSKLGYLSLESNQLNGKHSW

SEQ ID NO: 47884 - DNA, 658 bp, Panicum virgatum
  misc_feature: Ceres CLONE 2039338
  misc_feature: Encodes the peptide sequence at SEQ ID NO. 47885
ccgcgctcgcgcgctcccgccccccacacacacaccccgaccttccacgcttctccagcctcactcttcctggtcaggtgggagcgcaggagacagggctgggaggatggcgtcggtttccagggctgtctgcggcctgcagatgccgtgcttgaacggcagggaggcgcccgccggccgccgatcggtcgcggcgccgagggcccggaacgccaaacggggtgtcatccgcgccgtgtccgcctccgcctccgcctccgcctccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggccgggcggtcgctgcccgcggggctgtgggccgagatcctcgacggcctggcgtgggtggaggagtacatgggcgcgcgcctcggcaacccgcagcgcccgctcctgctctccgtccgctccggcgccgcggtgtcgatgcccggcatgatggacacggtgctcaac

SEQ ID NO: 47885 - protein, 183 aa, Panicum virgatum
  misc_feature: Ceres CLONE 2039338
  misc_feature: SWISSPROT Homolog: EC 2.7.9.1 Pyruvate, phosphate dikinase
MASVSRAVCGLQMPCLNGREAPAGRRSVAAPRARNAKRGVIRAVSASASASASGRGQHCAPANAVADAAPITATKRVFPFGKGKSEGNRGMKDLLGGKGANLAEMSSIGLSVPPGFTVSTEACQQYQEAGRSLPAGLWAEILDGLAWVEEYMGARLGNPQRPLLLSVRSGAAVSMPGMMDTVL

SEQ ID NO: 47886 - DNA, 718 bp, Panicum virgatum
  misc_feature: Ceres CLONE 2039349
  misc_feature: Encodes the peptide sequence at SEQ ID NO. 47887
gttgtaattggtctcgaatatctccattgccttggaattatataccgtgatctaaaaccagaaaatattttgcttcaagaggatggacacattgttctgactgattttgacctctcattttttacttcttcaaaaccccatgtgataaagcattcgacttcaagatggagaagatctaaagaatttctccccccaagttttgtttcagaccctgccactccatcgaattcttttgttggaactgaagagtacatagctccagaggtcatcacgggtgcaccacacacaagtgccattgattggtgggctcttggtaagcaatgataccttaagaaatagtgtactttcaactttgtcatctcaagtactaagccagtggaccattctgtaagtttgttcatgggttaaaagtgaatttgtttttgcccgagtaggaacaagagcagtcacctgaaaggtgcaggcaagtgaatcattgaacgatcaacccagtgtctgaaattaatcatgataacctgcaaatggtttgaaatgagacctgaaacatgaattttcaccaggagatttggctaaccagtttggttaacttgactgtttagtaattcactgctctgctgtgtttgtaaacaagtatttcatattatacacataagggcagtattgtgctaagatgttcactttgattgccagcaaatggttatcatcaccagtccaatgc

SEQ ID NO: 47887 - protein, 107 aa, Panicum virgatum
  misc_feature: Ceres CLONE 2039349
  misc_feature: SWISSPROT Homolog: EC 2.7.11.1 Non-specific serine/threonine protein kinase
  misc_feature: Functional homolog of the protein sequence given in SEQ ID NO 51310
  misc_feature: Useful for making plants with modulated light quality sensitivity
VVIGLEYLHCLGIIYRDLKPENILLQEDGHIVLTDFDLSFFTSSKPHVIKHSTSRWRRSKEFLPPSFVSDPATPSNSFVGTEEYIAPEVITGAPHTSAIDWWALGKQ

SEQ ID NO: 47888 - DNA, 704 bp, Panicum virgatum
  misc_feature: Ceres CLONE 2039361
  misc_feature: Encodes the peptide sequence at SEQ ID NO. 47889
cacttctgaagtaaagcagcaaggttgtacatgtggtgttaaaacagaaaaaaagaagaggaaatcttccatgggaaaggttctgaaagatgaaaaaaatatactaaaagatgtggtgaagactgaggtttctgctgaagaagggaagacatcttctaataaagagacaactacacaaggtgaaatgactccgcaagctgacttgacctcaaaggttaaaagccgtcgtaaattaggcattcaaaaatcgctaagtcaagaatgtaaacctactgagggtgctggtgattccggaagtgagaaattgtcttattcattgagtaatattattgatgtcaaggacaaactctctcactgcttgtcatcacgcttgctccgtagatggtgcatgtttgagtggttctatagtgcaattgattatccgtggtttgcaaagagtgaatttgttgagtatttgaatcatgtcaagctgggtcatgttccaagactgactcgtgttgagtggggtgtcatacggagttctcttgggaagccccgtcggttgtcaaaacagtttttgcgtgaggagagagagaagctttcccagtatcgtgattcagtcagacagcactatgctgaacttcgatctggcattagagaaggtctaccaacggatcttgcacgacctctagcagttgggcagcgtgttatagcctgccatccta

SEQ ID NO: 47889 - protein, 234 aa, Panicum virgatum
  misc_feature: Ceres CLONE 2039361
  misc_feature (134)..(234): Pfam Name: DIRP Pfam Description: DIRP
TSEVKQQGCTCGVKTEKKKRKSSMGKVLKDEKNILKDVVKTEVSAEEGKTSSNKETTTQGEMTPQADLTSKVKSRRKLGIQKSLSQECKPTEGAGDSGSEKLSYSLSNIIDVKDKLSHCLSSRLLRRWCMFEWFYSAIDYPWFAKSEFVEYLNHVKLGHVPRLTRVEWGVIRSSLGKPRRLSKQFLREEREKLSQYRDSVRQHYAELRSGIREGLPTDLARPLAVGQRVIACHP

SEQ ID NO: 47890 - DNA, 608 bp, Panicum virgatum
  misc_feature: Ceres CLONE 2039364
  misc_feature: Encodes the peptide sequence at SEQ ID NO. 47891
aaaaaccctatcgtctctcgcggcgcagtcaccaccaccgaacccggcggcgcacgcggaggagcccagcgagaggcggaggaagaaggcgatggcgcgcggcgtggcggcgggggcgaagggccgccgccgaagtcgaagccgaagcatggccggagtcggatcgaaggccctcgccgtggtcgccgtcctggcggccgccgccctctccgtggcctccgcggccgacgcgccggcgcccagccccgtctccgccgccggcgccgcggccccgcccctcgccgccgccctcgtcgcctccgccgccgccttcctcttcgccgccgtccgccactgagcccgcggatggggcagtaccgctaccgccccgcctagatctatttatttagtaatattattagagatggatttcttccttgttgctcgtgtcgtcgtcgcattttggtcggatctgggatgtgtttctaccgtgtcgtcgtgtcgggttgcgtgatccccctgtagatactctgctgctatctcgttcgtgagtgggatggttcggtctggttgctactgatattatcattgtttatctgtcccgtttgagatgatgatgccttgctgtt

SEQ ID NO: 47891 - protein, 62 aa, Panicum virgatum; identical to SEQ ID NO: 46086
  misc_feature: Ceres CLONE 2039364
  misc_feature: Functional homolog of the protein sequence given in SEQ ID NO 50452
  misc_feature: Useful for making plants with altered carbohydrate content

SEQ ID NO: 47892 - DNA, 716 bp, Panicum virgatum
  misc_feature: Ceres CLONE 2039381
  misc_feature: Encodes the peptide sequence at SEQ ID NO. 47893
aagcacatccggacttccttccagagcagccgcacaacgagcacagcagcttgagcgatccaactgtcgataatggcgcctgcagcaaccaacaagcagcaaggtggggagctgaggatcctctgcatcgacgggggtggcatccgcggccttatcccggccaagatcctcgacttcctcgaagccgaactccagaggattgatgggtcgaccgcgaggctagccgactacttcgactgcatcgtggggaccagcaccggcgccctcatcaccaccatgctggccgccccgaacaagccactctgcacggccaaggagatcatcgacctctacttggaagaggctgccacaatcttcaggaacgaccacaaggcgacgtgggttcaggtggtgctggaggccgtgctcctcttcatcaagtactacgatggcagcaacgagatcctgcggtccttgcacgacatgttggccctcgggtcggccctcgagcccttgctccgcccgatcatcgacgcgctgatccacgccaagggccctagcagtacacctgccgccgctgctgccaacgacaacggtggcggcttgctgcagatagcagtattagaagcaccgccacctcccgtgagccacggcgtcgagcccaatgaggaggcgccggcggcagtggaggactatatccaggaacacgctggagccatcctgcaggcgctgttgca

SEQ ID NO: 47893 - protein, 214 aa, Panicum virgatum
  misc_feature: Ceres CLONE 2039381
  misc_feature (17)..(186): Pfam Name: Patatin Pfam Description: Patatin-like phospholipase
  misc_feature: Functional homolog of the protein sequence given in SEQ ID NO 51529
  misc_feature: Useful for making plants with modulated heat sensitivity
MAPAATNKQQGGELRILCIDGGGIRGLIPAKILDFLEAELQRIDGSTARLADYFDCIVGTSTGALITTMLAAPNKPLCTAKEIIDLYLEEAATIFRNDHKATWVQVVLEAVLLFIKYYDGSNEILRSLHDMLALGSALEPLLRPIIDALIHAKGPSSTPAAAAANDNGGGLLQIAVLEAPPPPVSHGVEPNEEAPAAVEDYIQEHAGAILQALL

SEQ ID NO: 47894 - DNA, 734 bp, Panicum virgatum
  misc_feature: Ceres CLONE 2039424
  misc_feature: Encodes the peptide sequence at SEQ ID NO. 47895
aatatgaaaaactgcctgttgaacacttcgtcgacagaaatgtccctgaatgtgaaccagtgaagccagctgatatagaggatacaccatttacgctggttgaagatcacaaaggcttgatggaattagctaaaaagctgaagagtgtaactgaatttgctgtagatttggagcacaatcaatataggtcatttcagggtttgacctgcttgatgcagatttcaaccagaagagaagacttcattgtggacactcttaagcttcgcatatacatcggtctctacttgcaagaaccttttaaagatccaaccaagagaaaggtaatgcatggtgcggatcgtgatataatgtggctccaacgggatttccacatctatgtatgcaatctttttgacacaggacaggcttctagggtcttacagatggagagaaacagcctagagcacctattgcttcacttttgtggagtgacagcaaagaaggaatatcaaaatgcagactggaggtcgaggccacttcctgaagaaatgatcaagtatgctagagaagatacacactatctgctgtacatatatgacttaatgaaacagagactacaaagggagtcgacacctgaaaatgatcttcttctagaggttcataagcgcagtaatgaaatttgcttacagttctatgaaaaggagctgctgacagatacatcctatctccatatatatgggtttgcaagaacatga

SEQ ID NO: 47895 - protein, 243 aa, Panicum virgatum
  misc_feature: Ceres CLONE 2039424
  misc_feature (30)..(199): Pfam Name: 3_5_exonuc Pfam Description: 3'-5' exonuclease
  misc_feature: SWISSPROT Homolog: EC 2.7.7.7 DNA-directed DNA polymerase
YEKLPVEHFVDRNVPECEPVKPADIEDTPFTLVEDHKGLMELAKKLKSVTEFAVDLEHNQYRSFQGLTCLMQISTRREDFIVDTLKLRIYIGLYLQEPFKDPTKRKVMHGADRDIMWLQRDFHIYVCNLFDTGQASRVLQMERNSLEHLLLHFCGVTAKKEYQNADWRSRPLPEEMIKYAREDTHYLLYIYDLMKQRLQRESTPENDLLLEVHKRSNEICLQFYEKELLTDTSYLHIYGFART

SEQ ID NO: 47896 - DNA, 687 bp, Panicum virgatum
  misc_feature: Ceres CLONE 2039431
  misc_feature: Encodes the peptide sequence at SEQ ID NO. 47897
accggcgcggctcgccaccagacaagcggctgccgagaagttggagggggagtgtgcgcttcggtttggcgcgatggtgttcgcgtccggcgccggcgccggcggcccgcaggtgctgacggcgcggttcgtccgtcaggtggtgcttggccggtggttcatggtgttcgcgtgcctgctcatcctgtcggcgtcgggggcgacgtacatcttcagcatctactccaaggtgctcaagtcatcgctggggtacgaccagcgcacgctcaacacgctctccttcttcaaggacctgggcgccaacgtcggcgtcctctcggggctcatcaacgaggtcacgccgccgtgggtcgtgctcgccatgggcgccgccatgaacctcgcgggctacctcatgatctacctcgtcatcgacgggcgcaccgcgcggccccccgtgtggctcatgtgcatctacatctgcgtgggggccaactcgcagtccttcgccaacaccggggcgctcgtcacctgcgtcaagaacttcccggagagccgcggcatcgtgctgggcctgctcaagggcttcgtcggcctcagcggcgccatcttcacgcagctctacctcgccatctacggcgacgacgccaagtcgctcgtgctgctcatcgcctggctccccgccgccatctccatcctcctcgtcca

SEQ ID NO: 47897 - protein, 204 aa, Panicum virgatum
  misc_feature: Ceres CLONE 2039431
  misc_feature (27)..(204): Pfam Name: Nodulin-like Pfam Description: Nodulin-like
MVFASGAGAGGPQVLTARFVRQVVLGRWFMVFACLLILSASGATYIFSIYSKVLKSSLGYDQRTLNTLSFFKDLGANVGVLSGLINEVTPPWVVLAMGAAMNLAGYLMIYLVIDGRTARPPVWLMCIYICVGANSQSFANTGALVTCVKNFPESRGIVLGLLKGFVGLSGAIFTQLYLAIYGDDAKSLVLLIAWLPAAISILLV

SEQ ID NO: 47898 - DNA, 692 bp, Panicum virgatum
  misc_feature: Ceres CLONE 2039447
  misc_feature: Encodes the peptide sequence at SEQ ID NO. 47899
gctacagacttgagtaatcacactacagctccacgacgccctgagcctggcccggacacccggcggctaggtagctagcccagcagcaccgcgaccgcacaacgccacgggagcgccgcctcggggttcgggcaccatgggctcctcggcgcagctcaagcggctcaagcccctgtaccagttggtggtgaacaacatcctcgccatcgtcgcggtgccgctcgccgccgcggtggtcctcaaggcggcggagctgggccccgcggagatcctggcgcggctgcgcgcgctccggcccgcgcacatgttcctggccgcgttcctgccggcggcggctgcggtgctgtacctctggctccggccgcgcgcggtgtacctggtggactacgcgtgcttccgcaccaaccccaactgccgcgtcccgttcgcgacgttcctggagcactcccgcgtgtggcccggcttcgacgagcgaagcgtccggttcatgacgcggctgctggagcgctcggggctcggggaggagacctgcctgccgtacgcgcagcactacatcccgccgtcgcgggacctcgagtcctcccgcgccgaggccgagctcgtcatcttctccgccatcgacggcctgctcgccaagaccgggatgtcgccgcaggacatcgacatcctggtcgtcaactgcagcctcttcg

SEQ ID NO: 47899 - protein, 185 aa, Panicum virgatum
  misc_feature: Ceres CLONE 2039447
  misc_feature (71)..(185): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MGSSAQLKRLKPLYQLVVNNILAIVAVPLAAAVVLKAAELGPAEILARLRALRPAHMFLAAFLPAAAAVLYLWLRPRAVYLVDYACFRTNPNCRVPFATFLEHSRVWPGFDERSVRFMTRLLERSGLGEETCLPYAQHYIPPSRDLESSRAEAELVIFSAIDGLLAKTGMSPQDIDILVVNCSLF

SEQ ID NO: 47900 - DNA, 693 bp, Panicum virgatum
  misc_feature: Ceres CLONE 2039467
  misc_feature: Encodes the peptide sequence at SEQ ID NO. 47901
gttctcctcttcccctccctctccccgttctctgcttccgcctttaacccttgctctcgaactgctcctgctggatctgatggaggtggcagaccacgccttcgtggagggcacgatcctatggctagcgcaaaccatcaaggaacgcctcctaaccagcgagctcgccgatcggattcgcgaatttgagcttgctgaaagcatcgagaagctccaatcggagaccaagagcgttgaggcggtggttgctgctctgaaggggagggccacccggaacaagccgctggtccgagtgttcgctcggctcaaggagcttatgtatgacgccgacgatgcagtccatgagctcaaccacttgaagctccagcgccaggccgatggagttatctctgctttggttaacgagccggagggcaccgatggagatggatctggggaaaatcacgacataccgactagcaagccgcgcaaaaatcggagccctttatgggatcattttataccgataagaaatggtcgaaagatttgcagagcagaatgtaagcactgtggtgataaagttatatgcggcggcgaagccggaacaagcggtatgaaaaggcatatcaagaattggtcgtgcctgaccagaggccctacagttgaccgtccgtcatatcatacaagtgccagggatgatgcgccaaatgggac

SEQ ID NO: 47901 - protein, 204 aa, Panicum virgatum
  misc_feature: Ceres CLONE 2039467
  misc_feature (134)..(182): Pfam Name: zf-BED Pfam Description: BED zinc finger
MEVADHAFVEGTILWLAQTIKERLLTSELADRIREFELAESIEKLQSETKSVEAVVAALKGRATRNKPLVRVFARLKELMYDADDAVHELNHLKLQRQADGVISALVNEPEGTDGDGSGENHDIPTSKPRKNRSPLWDHFIPIRNGRKICRAECKHCGDKVICGGEAGTSGMKRHIKNWSCLTRGPTVDRPSYHTSARDDAPNG

SEQ ID NO: 47902 - DNA, 698 bp, Panicum virgatum
  misc_feature: Ceres CLONE 2039472
  misc_feature: Encodes the peptide sequence at SEQ ID NO. 47903
taatttttcgcccccgtctttgaacgccgcggcctccatctccacccctccctggcctcctcgcccccctccgatcccgcgcccgcctataaatcccgccaccgcagccgcagccgccgcagcggaccccgcaagcgcccgcacagctcgctgctgctccgcctccccgccgcgccctgtcgttctcccgtcggcccggggcggaagggggttctcgcgaggcggtcgggcgggcgggcaggcggggattgctcgggtcgggagccccccgcgcgatggcgaagctgtacgtgcaggcgttcccgcccgcggatctgaacaagaacaccgagtggttcatgtacccgggcgtctggacgagctacatcctcatcctcttcttctcctggctcctcgtcctctccgtcttcggctgcgcccccggcacggcgtggaccgtcgtcaacctcttccacttcgcgatcacataccactttttccattggaagaaaggaacaccttttgctgatgaccagggaatgtacaatgcattgacttggtgggaacaaatggacaatggcaaacagcttactcgtaacaggaagttcctcattgtcgttcctgtagtcctgtatctgatagttttgcacaccacagactaccaacaacctatgctctttctcaataccctcgcggttagcgtgcttgtggtcgccaaa

SEQ ID NO: 47903 - protein, 140 aa, Panicum virgatum
  misc_feature: Ceres CLONE 2039472
  misc_feature (14)..(140): Pfam Name: ORMDL Pfam Description: ORMDL family
MAKLYVQAFPPADLNKNTEWFMYPGVWTSYILILFFSWLLVLSVFGCAPGTAWTVVNLFHFAITYHFFHWKKGTPFADDQGMYNALTWWEQMDNGKQLTRNRKFLIVVPVVLYLIVLHTTDYQQPMLFLNTLAVSVLVVA

SEQ ID NO: 47904 - DNA, 669 bp, Panicum virgatum
  misc_feature: Ceres CLONE 2039481
  misc_feature: Encodes the peptide sequence at SEQ ID NO. 47905
agctcccaactgccaccgatttgtttgacaccgcatcgggtcttccctccacactcgccggccgctactcccgacctccgctgccgatctccgtcctgcttcgctgcgccggcgagagggatcatggcgggggaaggggaggaggtgtacgtggcggccatcgaccagggcaccaccagcacccggttcatcatctacgaccgccacgccaagcccgtcgcgtcgcaccagctcgagttcaagcagtactacccggaggcagggtgagtgtgggcgcctgtgcgggttttgtgttctctcggggtggtgatcggttgagtagcgtgtttgctcggtgtgtgatctcggtcaattctgtaccgttggttgactcgggaggaattagggggttgctagtttatagataaacagctttgcagttctattgctttgatttaattgcctgaaggttcttcagtcttaacttttaagacccgtatgagtcacatgtttgtccagttatatttacttaatgacttaataggcaacttagtggactattccatgtacaacatgtggttctcttatatgaacttatgagtagaaacttagatgatcattggaccgtatttactctaagaaaacatattaccacaagttcctaaaggatccatgtgaagttgaactctt

SEQ ID NO: 47905 - protein, 47 aa, Panicum virgatum
  misc_feature: Ceres CLONE 2039481
  misc_feature: SWISSPROT Homolog: EC 2.7.1.30 Glycerol kinase
MAGEGEEVYVAAIDQGTTSTRFIIYDRHAKPVASHQLEFKQYYPEAG

SEQ ID NO: 47906 - DNA, 676 bp, Panicum virgatum
  misc_feature: Ceres CLONE 2039483
  misc_feature: Encodes the peptide sequence at SEQ ID NO. 47907
atgtgcttctcgcgttatccatttgcgtctttcagttagggactactagggagggaaggacctgaccctaactcctgattcctgaagcgctgaaggcttcgagattctgaatgcgtgcgcgtagatctctgctggctttcgtcgagtcccagacacccaaacaaagatggcaacttcgacatctccagttctctgcaacttcatggccatcgcacagaacaacacgcttgtgctgaacaagagcacaaagcggcccctgctgcagctgagcttcccgaggggcacgccgacactgccggacttgagagcgaggcaggacgtccgcgtcgccgccgtctacaaggtgaagctcatcgggccggaggggaaggagagcgtggtcaaggtgccggaggacagctacatcctggacgcggccgaggaggccgggcccgacctgccctactcctgccgcgccggcgcctgctcctcgtgcgccggcaaggtcctgcagggctccgtcgaccagtcggaccagtcgtacctcgacgacgagcaggtcggcgccgggtacctgctcacctgcgtcgcgtacccgacctccgactgcgtcatccagacgcaccgggaggcggacctgtactagctagctagtagcccggtgccactcccgcagctccattcagactcgagctgc

SEQ ID NO: 47907 - protein, 152 aa, Panicum virgatum
  misc_feature: Ceres CLONE 2039483
  misc_feature (63)..(139): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MATSTSPVLCNFMAIAQNNTLVLNKSTKRPLLQLSFPRGTPTLPDLRARQDVRVAAVYKVKLIGPEGKESVVKVPEDSYILDAAEEAGPDLPYSCRAGACSSCAGKVLQGSVDQSDQSYLDDEQVGAGYLLTCVAYPTSDCVIQTHREADLY

SEQ ID NO: 47908 - DNA, 675 bp, Panicum virgatum
  misc_feature: Ceres CLONE 2039488
  misc_feature: Encodes the peptide sequence at SEQ ID NO. 47909
cttatcagctcgttgttccgtctcgttgatccggcaggtgggaggatacttattgacaagttggatatctgctccataggcctaaaggatctgagaactaaattgagtattatccctcaagaaccaacgcttttcagaggaactgtgcgcaacaatttggatccccttggcctgcattccgaccaagagatatgggaggccttagagaagtgtcaactgaaggcagcaattagcagcaccccagctcttcttgatacagtagtgagtgatgatggtgataactggagctctggacaacgtcagctcttctgtctcggcagagttctgctccgcaggaacaaaattctagttcttgatgaggcaacagcatccatcgactctgcaacagatgcaatccttcagaaagtaatcaggcagcagttctcaagttgcacggtgataacaatagctcatagggttccaaccgtgacagacagtgacagggtcctggtactttcctacggaaagcttctagaatatgaaacaccagcaaaactgttagaagacaagcaatcagcgtttgctaaactagtggctgagtattgggctaataccaagcggaattcaacatgaacctaccattgtggcaagacatgacaaaagatatgatcaatccaatgaagatactgaaatatc

SEQ ID NO: 47909 - protein, 203 aa, Panicum virgatum
  misc_feature: Ceres CLONE 2039488
  misc_feature (1)..(168): Pfam Name: ABC_tran Pfam Description: ABC transporter
  misc_feature: SWISSPROT Homolog: EC 3.6.3.44 Xenobiotic-transporting ATPase
LISSLFRLVDPAGGRILIDKLDICSIGLKDLRTKLSIIPQEPTLFRGTVRNNLDPLGLHSDQEIWEALEKCQLKAAISSTPALLDTVVSDDGDNWSSGQRQLFCLGRVLLRRNKILVLDEATASIDSATDAILQKVIRQQFSSCTVITIAHRVPTVTDSDRVLVLSYGKLLEYETPAKLLEDKQSAFAKLVAEYWANTKRNST

SEQ ID NO: 47910 - DNA, 679 bp, Panicum virgatum
  misc_feature: Ceres CLONE 2039499
  misc_feature: Encodes the peptide sequence at SEQ ID NO. 47911
agtgctagctgcagcgcccgcgcagcccagcgatggcgacgccgccgccccggccgccgctcctcggcatcgtgctcgcgctgtgcctctgctgctgcgcgcctcgcctgcgcgcggatgagggccggcgcagggcccccggcggcgggtaccgcgtccgggccgtcgcggtggacgagggagagacgcagctccgcgccgagctcgagctcgaggccgacgccgccgccgccaccggcgcgtccgcggcggcgtacggcgaggacgtgcggaagctcgacgtgtacgccaggcttgagacgagcagccggctccacgtccgcatcaccgacgccgaccacccgcggtgggaggtcccccaggacgtcatcccccgcgaggcgccccggcagcacgtccagctcgacgtgagcacggggggcgacgccttgccgcgcagccgcgtcctctcggcggcgacctccgacctcaccttcaccctccacgcctccccgttccgcttcaccgtgtcccgccgctccacgggggacgtcgtcttcgacaccgccccgggcctcgccttcaaggaccggtacctcgagctcaccacggcgctccccgccggcagggcgtcgctctacggcctcggcgagcacaccaagcgcaccttccggctgcagcgcaatgacaccttcacgct

SEQ ID NO: 47911 - protein, 215 aa, Panicum virgatum
  misc_feature: Ceres CLONE 2039499
  misc_feature: SWISSPROT Homolog: EC 3.2.1.20 Alpha-glucosidase
MATPPPRPPLLGIVLALCLCCCAPRLRADEGRRRAPGGGYRVRAVAVDEGETQLRAELELEADAAAATGASAAAYGEDVRKLDVYARLETSSRLHVRITDADHPRWEVPQDVIPREAPRQHVQLDVSTGGDALPRSRVLSAATSDLTFTLHASPFRFTVSRRSTGDVVFDTAPGLAFKDRYLELTTALPAGRASLYGLGEHTKRTFRLQRNDTFT

SEQ ID NO: 47912 - DNA, 719 bp, Panicum virgatum
  misc_feature: Ceres CLONE 2039521
  misc_feature: Encodes the peptide sequence at SEQ ID NO. 47913
aaaagctcgttgcaatctagtctccacagttccgcccaagctccaaccatggccggcaaaggtttggattgtccattagatttcatggctaagcagatggtagatgtcttctgaccttccacggatcttcatttgcagcggggtctcggttgcatcattggattgttcctttgtagaccgcttagaggtctacatgctgggagagcttaaaaatggggagatcgttgctgtaaagaagctgtctaactcaatttgtatggatgagaataaatacaatcaagaagttagctgtctaatgagggtgaagcacagaaatgtagtaagatttctaggatactgtgctgatacacaagggaaaatggtggactatgggggaaagtttgtcatggcagatttacgagagaggttactctgctttgaatatgttcctaatgggacactgaaagactatatcacagatgcatctaatggacttgaatggagaaagtgctatcagataataaagggaattagtgaaggtttgcattaccttcatgaactgcgcatagtccacttagatctcaaacctgccaacatattattggatgataacatggtgccaaaaattgccgattttggtatttcaaggtgctttgatcaagagcaaagctgggctattgcaacaaatctagttggaacaccgggatatttgggctcagaatcctatactcgaaagatca

SEQ ID NO: 47913 - protein, 205 aa, Panicum virgatum
  misc_feature: Ceres CLONE 2039521
  misc_feature (21)..(205): Pfam Name: Pkinase Pfam Description: Protein kinase domain
  misc_feature: SWISSPROT Homolog: EC 2.7.11.1 Non-specific serine/threonine protein kinase
MSSDLPRIFICSGVSVASLDCSFVDRLEVYMLGELKNGEIVAVKKLSNSICMDENKYNQEVSCLMRVKHRNVVRFLGYCADTQGKMVDYGGKFVMADLRERLLCFEYVPNGTLKDYITDASNGLEWRKCYQIIKGISEGLHYLHELRIVHLDLKPANILLDDNMVPKIADFGISRCFDQEQSWAIATNLVGTPGYLGSESYTRKI

SEQ ID NO: 47914 - DNA, 653 bp, Panicum virgatum
  misc_feature: Ceres CLONE 2039527
  misc_feature: Encodes the peptide sequence at SEQ ID NO. 47915
caagtgaaccaccagtctctctgccactggaattcttgaaagccatcacagataatttctccagcgaccatgaactcggcaggggtggctttggagtggtttacaagggaattctccggagcgggaaagtcattgcagtgaagaagatttatgataggtatccttttgagaaggacagcgctttagacgagatcagccgtgttatggggatcatgcacccaaatgtggtacagctcataggttactgtgccgagactaagatggatacgacacacgacggtgggaagctgattgtggcggaaatacgctcacggttgctctgcttcgagtatattagcaatggaggcctcgacatgtatatttccaaagaacatttggaccttggctgggacgaggtatacaagataattaaggggatttgtagtggcttagatgcccttcacgaggaaaacattattcatctggacctgaagccacagaatgtgttgatggatggtaatatgatgcctaaaatagtcgactttggtttggcaaggctcttgggcgaaaataaatctaaaatatacactcagaggcccacagggacagtcggatatatggcaccggaatactatagtgatggcaaaatatctcccaaggcagacatatttagt

SEQ ID NO: 47915 - protein, 216 aa, Panicum virgatum
  misc_feature: Ceres CLONE 2039527
  misc_feature (19)..(216): Pfam Name: Pkinase Pfam Description: Protein kinase domain
  misc_feature: SWISSPROT Homolog: EC 2.7.11.1 Non-specific serine/threonine protein kinase
SEPPVSLPLEFLKAITDNFSSDHELGRGGFGVVYKGILRSGKVIAVKKIYDRYPFEKDSALDEISRVMGIMHPNVVQLIGYCAETKMDTTHDGGKLIVAEIRSRLLCFEYISNGGLDMYISKEHLDLGWDEVYKIIKGICSGLDALHEENIIHLDLKPQNVLMDGNMMPKIVDFGLARLLGENKSKIYTQRPTGTVGYMAPEYYSDGKISPKADIF

SEQ ID NO: 47916 - DNA, 519 bp, Panicum virgatum
  misc_feature: Ceres CLONE 2039538
  misc_feature: Encodes the peptide sequence at SEQ ID NO. 47917
atcatccatcagcgaacacacaagaaaaaacatcaatcaaagtgcttacatctttgaggtatctctgaagaagatgagctcaacagctgacagcaaggggtgcaatgctactcccaagacggagtggcctgagctagtgggatgcacgatcaaggaggcgatggagaggatcaaggcggagcggccgcaactcaatgtcgtgcctgtccctgtagactcctttgtcacccaagaggttgaccctaatcgcgtccgtctctgggttgacatcgtcgccgaggttcctaaaattggctgaagcatcgaaacgccaagccaccaaataatggcatttgtatgtgttcctatggaccattcatgggggttaagtaaataaaagcatgtctgtgatgggctcttgtatatggttcgcctgtcataagttgtgaattgtgatgattgagttatgaataatacgttggcaacactatcggaatctgcagctttggggctttgctgatgagtgttgccgagtgccac

SEQ ID NO: 47917 - protein, 74 aa, Panicum virgatum
  misc_feature: Ceres CLONE 2039538
  misc_feature (15)..(74): Pfam Name: potato_inhibit Pfam Description: Potato inhibitor I family
MSSTADSKGCNATPKTEWPELVGCTIKEAMERIKAERPQLNVVPVPVDSFVTQEVDPNRVRLWVDIVAEVPKIG

SEQ ID NO: 47918 - DNA, 315 bp, Panicum virgatum
  misc_feature: Ceres CLONE 2039540
  misc_feature: Encodes the peptide sequence at SEQ ID NO. 47919
aggaagagcttcgcagtcctccacacaagcgcccgagctcttctttttaccactgccaccacagcccagctcctcctgaccgcctcctcagttctctcgaatcgaaatggcgagccccccggccatctgccatagcgacccactcgactggggaaaggcggcggaggaaatggtggggagccaacaccaccaggtgaagagcatggaggcgcagtaccgagagcccctcgtcatgatcgaaggctccaacctcggcgtcggccaggcggcgggtgtggatgcggtccatgacgagtccggcgcggccgtcgagct

SEQ ID NO: 47919 - protein, 69 aa, Panicum virgatum
  misc_feature: Ceres CLONE 2039540
  misc_feature: SWISSPROT Homolog: EC 4.3.1.5 Phenylalanine ammonia-lyase
MASPPAICHSDPLDWGKAAEEMVGSQHHQVKSMEAQYREPLVMIEGSNLGVGQAAGVDAVHDESGAAVE

SEQ ID NO: 47920 - DNA, 683 bp, Panicum virgatum
  misc_feature: Ceres CLONE 2039541
  misc_feature: Encodes the peptide sequence at SEQ ID NO. 47921
gtcttcgcccgccgccgcctcccccgtcctcctcgccgccgtagactaggttaggctagggtttcgacgagctcgcggaaatggtggccttcaggttccatcagtaccaggtggtggggcgtgcgcttccgactcctggcgatgagcaccccaagatctaccgcatgaagctctgggccaccaacgaggttcgcgccaagagcaagttctggtacttcctgaggaagctcaagaaggttaagaagagcaacggccagatcctcgccatcaacgaggtacgcctgcttctgcgatcggcatgccctttttagcacactagattgctccatctgaacctgccgtcccatcgctgcttgtttagtacttgcatcttaaacaatttgtgtatgtccgctatgttctggacgcccagccctgtttgtcccccgtcctgatgttattgtgacctatagcaagcgatatatacaggtgaaacttcgactgaggttgtagctcagcattgctgttgattcgatattatcctgatgcgtacttacattgcactgagctgtttgtgcatgccattatcgctgctactatctgattttttggggtctgttctcagcgccctcagctagttgtatactgatacgcgacatgtatttctaatcatttccttttatacaactagtagagaagcacgt

SEQ ID NO: 47921 - protein, 76 aa, Panicum virgatum
  misc_feature: Ceres CLONE 2039541
  misc_feature (5)..(76): Pfam Name: Ribosomal_L18ae Pfam Description: Ribosomal L18ae protein family
MVAFRFHQYQVVGRALPTPGDEHPKIYRMKLWATNEVRAKSKFWYFLRKLKKVKKSNGQILAINEVRLLLRSACPF

SEQ ID NO: 47922 - DNA, 698 bp, Panicum virgatum
  misc_feature: Ceres CLONE 2039566
  misc_feature: Encodes the peptide sequence at SEQ ID NO. 47923
aaaaccactcccccacctcttccccctccccctccccctcccccaccaccaccaccgcgacgccaccaatccgcgcgcacccgcccgccatgcctcctccccgcctcctgccgccgctcctcctcctcctcctcgccccgcccgccgcgccgcagcccgcgccggcgccgcaggaggacgacctgcgctgcctccggggcgtcaagtccggcctccgcgaccccgacgggcgcctcgcctcctggaacttcgccaacacctccggcggcgccgtctgcagctacgacggcatcctgtgctggaacatgcaggagtcccgcgtcaactcgctcacgctctccgggttcggcctccagggcgccctcccctcctccctccagtactgccgcgccgccaccacgctcgacctctccgccaacgagctcgacggccagataccccccgcgctctgcgactggctccccttcgtcgtcaccctcgacctctcctccaacaagctcaccggccccatccccgcggagctcgccaactgccgcttcctcaactcgctcaagctcgccgggaaccagctctccggccagatcccggcctccctcgcgcgcctcgaccgactcaagtcgctcgacctctcggagaacaggctcgacggccagatcccgacccagctgggcgccaacttccccaaggactccttctct

SEQ ID NO: 47923 - protein, 202 aa, Panicum virgatum
  misc_feature: Ceres CLONE 2039566
  misc_feature (28)..(71): Pfam Name: LRRNT_2 Pfam Description: Leucine rich repeat N-terminal domain
  misc_feature: SWISSPROT Homolog: EC 2.7.11.1 Non-specific serine/threonine protein kinase
MPPPRLLPPLLLLLLAPPAAPQPAPAPQEDDLRCLRGVKSGLRDPDGRLASWNFANTSGGAVCSYDGILCWNMQESRVNSLTLSGFGLQGALPSSLQYCRAATTLDLSANELDGQIPPALCDWLPFVVTLDLSSNKLTGPIPAELANCRFLNSLKLAGNQLSGQIPASLARLDRLKSLDLSENRLDGQIPTQLGANFPKDSF

SEQ ID NO: 47924 - DNA, 686 bp, Panicum virgatum
  misc_feature: Ceres CLONE 2039578
  misc_feature: Encodes the peptide sequence at SEQ ID NO. 47925
tcaccactctagcttttgcaaatttcagcgaggagatggtggtgctcacctctggtcctgctgatggagaagtggttcgtcttacggtagattacagcaagaagccattatctgttgatgcaacctttaggggtcagtttggccagcgactcgctgctattgggcagtatctggagcagaagttcgggagtgcccaagatgtggaaggctgcttggttggcaaagatatctttatagtgcagagcaggccacagccatagtaaataaagttttgctaagatgagtgtgattacttggtttggtgaataaaaatggatgcatggctgaagaaatttatgggttctgtagcacacatagcagttattcaagtccttttaaacatcttgcctgaagtaaaataatgagttgggccaggtccagccatgctcttggatgaattttgcgaacagcaaacttgagtataatgtaacgtcttgtagtgacctcgtttggatgtaataatcataatctacaggacatgtaatgtaatatctagctagagatgagaacatatccatcattatcgtagctgcttacagcgagcaaccgtagaaaaaagtacttcaatccagtgaaagcatgcttttgtatgtgattagattgcatgttttataagtcggtggaacgtagagtcaaaatttgaatct

SEQ ID NO: 47925 - protein, 85 aa, Panicum virgatum
  misc_feature: Ceres CLONE 2039578
  misc_feature: SWISSPROT Homolog: EC 2.7.9.5 Phosphoglucan, water dikinase
TTLAFANFSEEMVVLTSGPADGEVVRLTVDYSKKPLSVDATFRGQFGQRLAAIGQYLEQKFGSAQDVEGCLVGKDIFIVQSRPQP

SEQ ID NO: 47926 - DNA, 597 bp, Panicum virgatum
  misc_feature: Ceres CLONE 2039581-R
  misc_feature: Encodes the peptide sequence at SEQ ID NO. 47927
ctcacccaagtgcacatgtgcgagcactcagcatgtctgtcctccgcgacatcttgaacaacggatccattacccccagcaagatcatccaaggggaacaacaacggaatggtatccagagctcgtcctaccggtgcctggcagcatccatcaactggcaggcggacgtgcagaggtgcatagagtgggaagctcacagccgccgcgccactgggctgacgcttgccttcctcagtgcagcggctaaggagctcagctgccccctcccttgctgacaagacaaggccattccctgggactgacgtcggcagccagtgcaggcagtcgctgcagggtcagcgagtaggatgctaatctctccatcagggatgacttgctggcttgtttacacatgatgcgatttatactgatactaggtgttgtttccaaagcatatacggggctttgctcccaaggtgccatttgctttcaatctgatgttagatgttcaagcatatgcaactgcttgtgttgtacgtaacttgtactatgcatgtaatgtaagcctgtaacgtcgttcaatctggttactggagaagaacatatctttacctctag

SEQ ID NO: 47927 - protein, 90 aa, Panicum virgatum
  misc_feature: Ceres CLONE 2039581-R
  misc_feature: Functional homolog of the protein sequence given in SEQ ID NO 50888
  misc_feature: Useful for making plants with modulated flowering time
  misc_feature: Functional homolog of the protein sequence given in SEQ ID NO 50889
  misc_feature: Useful for making plants with modulated biomass
HPSAHVRALSMSVLRDILNNGSITPSKIIQGEQQRNGIQSSSYRCLAASINWQADVQRCIEWEAHSRRATGLTLAFLSAAAKELSCPLPC

SEQ ID NO: 47928 - DNA, 696 bp, Panicum virgatum
  misc_feature: Ceres CLONE 2039581
atcgcgaaaaaatctttttctcgcctctcctcgctcctcgccgtttctctctcctcccctccgcctcacccgccgctcgccgcgaaatccacccgcggacgccgcccgctcgccgtggagagcctcggattagagcgcgccccgtcgagagatttcgaagcaactatgtttgggattggttgatatgatacttgttcacgttgggggatgcagacccccccctctgtgggggttgattgaagaagttaacagcactcttagacgaacttgtgtcctactgatactgaaagtttcttggtttcgaggtgctcttatttctcactggagcagtttctgtagtttctttccttccctttgagagcctttctagtttcttgggcaggctcttgagctaccaagtatgtcagcttcaaatgagaagtggatcgatgggctccagttcacatcactgttctggcctccaccccaggatgtgcaacagaagcaggcacaaattttggcctatgttgagtactttggccagtttacagctgacagcgagcaattccctgaagatgtagcacagctcattcaaagttgctacccatcgaaagaaaaacgcttggtagatgaagtgttggcaacttttgktcttcatcatcccgagcatggkcatgcagttgtacatccmattctttcacgtatcatagatgggac

SEQ ID NO: 47929 - DNA, 638 bp, Panicum virgatum
  misc_feature: Ceres CLONE 2039584
  misc_feature: Encodes the peptide sequence at SEQ ID NO. 47930
taacgcagagccagccgataggatggcagacgctgacatcgccgccgtggccgccgccggcaccggcaccggcaccgaggccccagcccagccgctggcggggcgcgtggccatcgtgactggtgcgtcgcggggcatcgggcgcgccatcgcggcgcacctctcctccctgggtgcgagcctcgtgctgggctacgcgtcgcgcgccgacgaggccgacgcgctcgccgcgtcgctggcccgcgccgtggccgtgcgggcggacgtcgccgacgaggccggcgcgcagtcgctcttcgacgccgcccgttccgcgttcggcggcgcaggggcgcacatcctcgtggccaacgccggcgtgctcgacgacgcgtaccccaccgtggcgggcaccgccaccgagtccttcgaccgccttgtcgccgtgaacctgcgcggcgcgttcctgtgcctccgcgaggcggcgaaccgcctcccccgcggcggcggcgggcggatcgtggccgtgacgtcgtccgtggtggggagcctcccggaagggtacggggcgtacacggcgtccaaggcggccgtggaggcgctggtgcggacgatggccaaggagctcaagggcacgcgcatcaccgccaactgcgtgg

SEQ ID NO: 47930 - protein, 205 aa, Panicum virgatum
  misc_feature: Ceres CLONE 2039584
  misc_feature (28)..(196): Pfam Name: adh_short Pfam Description: short chain dehydrogenase
  misc_feature: SWISSPROT Homolog: EC 1.1.1.100 3-oxoacyl-[acyl-carrier-protein] reductase
MADADIAAVAAAGTGTGTEAPAQPLAGRVAIVTGASRGIGRAIAAHLSSLGASLVLGYASRADEADALAASLARAVAVRADVADEAGAQSLFDAARSAFGGAGAHILVANAGVLDDAYPTVAGTATESFDRLVAVNLRGAFLCLREAANRLPRGGGGRIVAVTSSVVGSLPEGYGAYTASKAAVEALVRTMAKELKGTRITANCV

SEQ ID NO: 47931 - DNA, 693 bp, Panicum virgatum
  misc_feature: Ceres CLONE 2039593
  misc_feature: Encodes the peptide sequence at SEQ ID NO. 47932
atgctcatagtgagactgtgagatcgggccattcacacatgtatctgtgcttactgagagaacaacaattgcaagaacttattccattttcaaggatggctgatgaagttgatcaggaagaagcaactgcatgcacacttttgaagcatatggcgttgaatttatatgagcatgttggggtcaggatgcatcgtctttctgtgtgccagtgggaagtgaagctctggttggtttgtgatgggcaagctagtggtgcttggagagttgttgttacgaatgttactggtcacacttgcactgttgatatttaccgagaagtggaggaccccagtacacatcagcttatctaccactctgccacagccacggctggccctctgcatggcgttgcattgaatgaaccgtacaagcctttggatgctattgaccttaaacgttatgctgctaggaaaaacgaaactacatactgctatgatttccccttggcatttgaaacagcgctgaagaggtcatggaaatcaagtaattatggtgttactgaatctaatgaccataatcaactttatgctgaagtgaaagagcttatatttgctgattcagatggagcgtggggtactccattgatttcagttgaacgccccccaggcatcaatgatattggcattgttgcttggaacatgaagctgtccacac

SEQ ID NO: 47932 - protein, 230 aa, Panicum virgatum
  misc_feature: Ceres CLONE 2039593
  misc_feature: Functional homolog of the protein sequence given in SEQ ID NO 51511
  misc_feature: Useful for making plants with altered oil content
  misc_feature: Useful for making plants with modulated herbicide sensitivity
AHSETVRSGHSHMYLCLLREQQLQELIPFSRMADEVDQEEATACTLLKHMALNLYEHVGVRMHRLSVCQWEVKLWLVCDGQASGAWRVVVTNVTGHTCTVDIYREVEDPSTHQLIYHSATATAGPLHGVALNEPYKPLDAIDLKRYAARKNETTYCYDFPLAFETALKRSWKSSNYGVTESNDHNQLYAEVKELIFADSDGAWGTPLISVERPPGINDIGIVAWNMKLST

SEQ ID NO: 47933 - DNA, 676 bp, Panicum virgatum
  misc_feature: Ceres CLONE 2039595
  misc_feature: Encodes the peptide sequence at SEQ ID NO. 47934
gccactctgcctccaaatccaccgcctcgtccccctcaatcttatcctctcggctcggccccagctcctccgtctcccaatggcctccgccaacgccatctccaccgcctctctcctccggcccctctctcagggcagggcgaggagggccaggaacggccggttcgtggtccgtgccgacgccaaggacatcgccttcgaccagaagtccagagcggcactccaggccggcgtcgagaagctcgctaacgccgtcggtgtcaccctcgggccccgaggaaggaatgtagttctggatgagtatggcagccccaaagttgtaaatgatggagtgactattgcccgggctattgagctgtatgatccaatggaaaatgctggtgcagcactaatccgtgaggttgctagcaagaccaatgattctgctggtgatggtactacaactgcttctgtccttgctcgtgaaatcatcaagctaggccttctgagtgtaacgtctggtgcaaaccctgtgtcacttaagaagggaattgacaaaactgtgcagggtctaattcaggagcttgagaataaggccagaccagtcaagggtggtggtgatatcaaagctgttgcgtctatctctgctggcaatgatgaattcattggatccatgattgccgaagcaattgataaa

SEQ ID NO: 47934 - protein, 198 aa, Panicum virgatum
  misc_feature: Ceres CLONE 2039595
  misc_feature: Functional homolog of the protein sequence given in SEQ ID NO 50704
  misc_feature: Useful for making plants with modulated nitrogen use efficiency
MASANAISTASLLRPLSQGRARRARNGRFVVRADAKDIAFDQKSRAALQAGVEKLANAVGVTLGPRGRNVVLDEYGSPKVVNDGVTIARAIELYDPMENAGAALIREVASKTNDSAGDGTTTASVLAREIIKLGLLSVTSGANPVSLKKGIDKTVQGLIQELENKARPVKGGGDIKAVASISAGNDEFIGSMIAEAID

SEQ ID NO: 47935 - DNA, 636 bp, Panicum virgatum
  misc_feature: Ceres CLONE 2039612
  misc_feature: Encodes the peptide sequence at SEQ ID NO. 47936
aggcgcgtgcggccagctaagcagttggtagcagcagcactccaccgcggtcacacgcgccccctccgcccccttcctccctctccatccagcacggggcagctccgaggcgggtccggaggagggcatggcgcggcgcgcggcggcggcggcgaggcttctacgccgcccgggaccgctcgccgcggagccgccggtgcgaggcatgcctcatactgaatatgaatttgcaagccgcactgtgaattcttgtagaagattccactggattcccagtctacagcgtccaccatgtggacctagaactaatgtggaaacatatgaagggcaacacagtgctaataaggcttctgaagttcagaagcgcacatttggttctgcggcaacacacaatcagaggaatccagcctattcagagctgaactctgatgatgtttgttacttcaagagcatcttgggtgacaatggtgtagttcaggatgaagacagaatcgcagttgcaaacgtagactggatgggtaaatacaagggtgcaagtcagctgctacttttaccaaaaagtactaaagaggtttctaagattctttcatattgcaacaccagacgattggctgtggttccacaaggtggcaatac

SEQ ID NO: 47936 - protein, 169 aa, Panicum virgatum
  misc_feature: Ceres CLONE 2039612
  misc_feature: SWISSPROT Homolog: EC 1.1.2.4 D-lactate dehydrogenase (cytochrome)
MARRAAAAARLLRRPGPLAAEPPVRGMPHTEYEFASRTVNSCRRFHWIPSLQRPPCGPRTNVETYEGQHSANKASEVQKRTFGSAATHNQRNPAYSELNSDDVCYFKSILGDNGVVQDEDRIAVANVDWMGKYKGASQLLLLPKSTKEVSKILSYCNTRRLAVVPQGGN

SEQ ID NO: 47937 - DNA, 705 bp, Panicum virgatum
  misc_feature: Ceres CLONE 2039643
  misc_feature: Encodes the peptide sequence at SEQ ID NO. 47938
tctctcaccaccctccatccctctcccgactcccaacctcaacccagaaaccgagcggaggggagccccgaaacaagcgccaacggaattgggatcgcaacacatcccaccccatctccattccgcgccaccgcccttgctccgtcccgcctgcccgtccggatccgctcggcctcggatcgatctcttctctcgtcggttaccaaaatggataaactcaatggttctgctcgtcttatgattgtttcagatcttgaccatacaatggttgatcaccatgatgaggagaacttgtccttgcttaggtttgctgccctgtgggagtccatttactgtcaggattctctacttgtcttttcaactggacgatcgcctactctctacaaggaattgaggaaagagaagcctatgctgaccccagacatcactatcatgtctgtgggcactgagataacatatggcgaggcaatggttcctgatgatggttgggaagaatatctgaataataagtgggacagaaatattgtggtacaggaaactgcaagcttttccgaactgaagcttcagccagagacagaacagcgtccacacaaggtcagctttttggttgacaagaagagtgcccaggaagtgataaaatctgttgcggagaagttggagaaacgtgagttagatgcaaaaattatatatagtggtggccaggac

SEQ ID NO: 47938 - protein, 165 aa, Panicum virgatum
  misc_feature: Ceres CLONE 2039643
  misc_feature (8)..(165): Pfam Name: S6PP Pfam Description: Sucrose-6F-phosphate phosphohydrolase
MDKLNGSARLMIVSDLDHTMVDHHDEENLSLLRFAALWESIYCQDSLLVFSTGRSPTLYKELRKEKPMLTPDITIMSVGTEITYGEAMVPDDGWEEYLNNKWDRNIVVQETASFSELKLQPETEQRPHKVSFLVDKKSAQEVIKSVAEKLEKRELDAKIIYSGGQ

SEQ ID NO: 47939 - DNA, 614 bp, Panicum virgatum
  misc_feature: Ceres CLONE 2039655
  misc_feature: Encodes the peptide sequence at SEQ ID NO. 47940
gaagagccaaatttcttcgatcgaatcatcccccagttccacctaacggctagaccccgcgatgctttacgctctcctctgcctcctcgccctcgccggcggcgcagcggcggcggcggcggcgccgaacgcgcgcccgtgcgcgtcggcggactcggcgagcgcctacccgttctgcgacgcctcgctctccatcccggcccgcgcgcgcgcgctcgtctcgctcctcaccctcgacgagaagatcgcgcagctgtccaacacggcgggcggggtcccgcgcctcggcgtcccgccctaccagtggtggtccgagtccctccacgggctcgccgacaacgggcccggggtcaacttctcctcgggccccgtccgcgccgccaccgccttcccgcaggtcatcctctccaccgccgccttcaaccgctcgctgtggcgcgccgtggccggggccgttgccacggaggccctcggcatgcacagcaccggccaggcagggctcacatactgggcgcccaacatcaacatcttccgcgacccgcgctggggccgcggccaggagacgtccggggaggaccccgccgtcgccgccgcgtactccctcgagtacgtca

SEQ ID NO: 47940 - protein, 184 aa, Panicum virgatum
  misc_feature: Ceres CLONE 2039655
  misc_feature: SWISSPROT Homolog: EC 3.2.1.21 Beta-glucosidase
MLYALLCLLALAGGAAAAAAAPNARPCASADSASAYPFCDASLSIPARARALVSLLTLDEKIAQLSNTAGGVPRLGVPPYQWWSESLHGLADNGPGVNFSSGPVRAATAFPQVILSTAAFNRSLWRAVAGAVATEALGMHSTGQAGLTYWAPNINIFRDPRWGRGQETSGEDPAVAAAYSLEYV

SEQ ID NO: 47941 - DNA, 680 bp, Panicum virgatum
  misc_feature: Ceres CLONE 2039688
  misc_feature: Encodes the peptide sequence at SEQ ID NO. 47942
aacagaaaaaaaaatcgaaatcccgttcgaatcaaacctccgctccgcctcctccggcctcgccgtggtgcgccacccaccacccgcccggcccccgccccgccgagattccctccggttcccgccaccccagcccgaatctccgtggccgcacccccagatttcctccgcggcgccgcctgtcgtcaattccggcggcctagcgggtccgtcgctattcctcgtagtacaggactcgtggtgggtcgggcctttttttttgtccccccggcctagcgggttgcggcggcggcgtcgcttggaggcgaaggcaagcgagggcggaatcgggtgcggctaggggggctgtgtcgggcggtggtggtaggcgattgctagggttgggggtgattggtggggctgcggcctgcggggagggaggcgggatggtggggctcgtagccgcggcgggggtggcgctgggcgatccgccggcggactacgcctccatcgcggcggtggggctgttcgtgtcgctcatgtgcgtctgcatcatcgtggggcacctcctcgaggagaaccgctgggtgaacgagtccatcaccgcgctcttcatcgggctcgggacgggagcggtcatcctcttcgcgtcgagcgggaagcactcgcgcgtgctggtgttcagcgaatatctcttcttc

SEQ ID NO: 47942 - protein, 84 aa, Panicum virgatum
  misc_feature: Ceres CLONE 2039688
  misc_feature: The sequence is a functional homolog of SEQ ID NO 2 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 4 in US patent 7250560
  misc_feature: The sequence is a functional homolog of SEQ ID NO 4 in US patent 7256326
MVGLVAAAGVALGDPPADYASIAAVGLFVSLMCVCIIVGHLLEENRWVNESITALFIGLGTGAVILFASSGKHSRVLVFSEYLF

SEQ ID NO: 47943 - DNA, 682 bp, Panicum virgatum
  misc_feature: Ceres CLONE 2039696
  misc_feature: Encodes the peptide sequence at SEQ ID NO. 47944
gagcgcgggctccgctccatggacgccccccacttgcccgtccgccgccatctgccaccgccgctccagctcccgcccttctcgtctccgattctctggtaccggcgccgcgtcgccagcgccgtggcatgctgctgctccgccgcggcgggggaccagcaccagcaccaggagcggccgtgggagtcctacgaccgcgacatccagtcccacgccggctccgacctgtcccgctccctcggcctcctcgccgacatgcaggcggccggggcgcgccccagcgccgcggcgtacgcgcgcctcatccgcgcgctgggccgcgcggggcgcacgctcgaggccgaggcgctcctgctcgagatgcgccgcctcggcccgcgcccggacgccgcgcactacaacgcgctcctcgaggggctgctcgccagggcgcacctccgcctcgccgaccgtctcctcctccagatggccgacgacggcgtcgcgcggaaccggcgcacctacatgctcctgctggacgcgtacgcgcgcgcgggccggctcgaggactcgtggtgggtcctgggcgagatgaggcgccggggcatccggctcgacaccgaagggtacagcatgctggtgcggctttaccgggacaatggcatgtggaagaaggccaccgacctcgttatggagatgcagg

SEQ ID NO: 47944 - protein, 221 aa, Panicum virgatum
  misc_feature: Ceres CLONE 2039696
  misc_feature (160)..(194): Pfam Name: PPR Pfam Description: PPR repeat
  misc_feature (90)..(124): Pfam Name: PPR Pfam Description: PPR repeat
MDAPHLPVRRHLPPPLQLPPFSSPILWYRRRVASAVACCCSAAAGDQHQHQERPWESYDRDIQSHAGSDLSRSLGLLADMQAAGARPSAAAYARLIRALGRAGRTLEAEALLLEMRRLGPRPDAAHYNALLEGLLARAHLRLADRLLLQMADDGVARNRRTYMLLLDAYARAGRLEDSWWVLGEMRRRGIRLDTEGYSMLVRLYRDNGMWKKATDLVMEMQ

SEQ ID NO: 47945 - DNA, 699 bp, Panicum virgatum
  misc_feature: Ceres CLONE 2039711
  misc_feature: Encodes the peptide sequence at SEQ ID NO. 47946
atacccagatagaagaatgcacaccttctacaccgctaatgagcagaaactaggacagcacagttaagaagcagcattcttaccacatggataagattgcagggtactttacggggcgtcctgtaaaaaaccaccgtccaaccctttgtgatgcgaggcgttatgaatatcgcgaactggagaaggctaccaaggcatttacaaatctcattagaccaggtgcacatggagatcttggaactgtctataagggaacacttcagggaggaaaagtgattgcagtgcagaccctacaaacagaacggaggcttcacaaacaacatgagagtttggtgaaggctgtctcacaactttgtcacacgaacctactgaagtttgatggttattgcattgataaacatgggagctttctttgctacgaatatcagcgctatcaaacacttgaggagtgcctcctaggaacatataaagtgctaacttggcaacagcgacgtgatatactcagcggtatctgtgaaggcctgaagtacctcgaggacttcaaaagcaaagtgaaaatgcacattgaattgaaagttgacaaaatagttcttcatgaggatgagaagactaggaatttgataccaaatatttcgtattgtgttttctggggtcaacgtgaagatgatgcacccacagggtattattatttcatgtcaa

SEQ ID NO: 47946 - protein, 204 aa, Panicum virgatum
  misc_feature: Ceres CLONE 2039711
  misc_feature: SWISSPROT Homolog: EC 2.7.11.1 Non-specific serine/threonine protein kinase
MDKIAGYFTGRPVKNHRPTLCDARRYEYRELEKATKAFTNLIRPGAHGDLGTVYKGTLQGGKVIAVQTLQTERRLHKQHESLVKAVSQLCHTNLLKFDGYCIDKHGSFLCYEYQRYQTLEECLLGTYKVLTWQQRRDILSGICEGLKYLEDFKSKVKMHIELKVDKIVLHEDEKTRNLIPNISYCVFWGQREDDAPTGYYYFMS

SEQ ID NO: 47947 - DNA, 697 bp, Panicum virgatum
  misc_feature: Ceres CLONE 2039716
  misc_feature: Encodes the peptide sequence at SEQ ID NO. 47948
gagcttattgattaatttctccatttttatattggttggtttggtagacttattttcttttatctggtagtaggtagaggaacttctacggcgaaaacgtgctaaagaggaagccgagaaggaactggaagagtttgtccacttagtcaagtctgccaaagcattgcctatggagtccaagcctcctaaaagttcatggttgttggatgagaaagtaaggcaaaaaatcgaggctcttcaagcatatgcagttgatgcatgtgacgatgaacaaagaagactagcaggaaatattctcaaagctatggggttcacaaggacgtcatcagctgctttaaagctccttataaatgtcggttacttccctgcgcatgtcaaccttgatctttttaagtacgatgttcgtaccatgtacactgaggaagttttgtctgctgcggaggagcttctggtgggcagacctgattcagacatgcatatcagaaaggatctttcaactttgaaggtgtacgcaattgatgtagatgaggctgatgaacttgatgatgcattgagcgcaattaggctccctgatggtaggataaaggtctggatacatgttgctgatccaacgtgcatgatcaaacctcggggcatcattgatagggaggcaatgcacagaggaacctcaatctttctaccaactgctacattttcg

SEQ ID NO: 47948 - protein, 175 aa, Panicum virgatum
  misc_feature: Ceres CLONE 2039716
  misc_feature: SWISSPROT Homolog: EC 3.1.13.1 Exoribonuclease II
MESKPPKSSWLLDEKVRQKIEALQAYAVDACDDEQRRLAGNILKAMGFTRTSSAALKLLINVGYFPAHVNLDLFKYDVRTMYTEEVLSAAEELLVGRPDSDMHIRKDLSTLKVYAIDVDEADELDDALSAIRLPDGRIKVWIHVADPTCMIKPRGIIDREAMHRGTSIFLPTATF

SEQ ID NO: 47949 - DNA, 725 bp, Panicum virgatum
  misc_feature: Ceres CLONE 2039720
  misc_feature: Encodes the peptide sequence at SEQ ID NO. 47950
cctgcagaagtcagcaagttgccgggctacaacagtggtgccgtctgcactttccctgagtttctcaaatctgagatcaatgcctcagtagagcaggcgaacaatgctctggttccgatttctgatgatggctggtaccgtcctaagagcattgacgagcttcacaggctgttcgagtctaattcctttgatgagaattctgtaaagatcgtggcttcaaacactgggtctggagtgtacaaggatcaagacctccatgacaagtacattgacatcaaagggatcccagagctttcagttatcaacagaagcagcaagggaatcgagcttggatcagtagtgtccatctctaaagcaatcgacgtgttgtcagatggaaacttggtcttcagaaagattgctgatcacctgaacaaagtggcttcaccatttgttcggaacactgcaaccataggtggaaacataatcatggcacagaggttgcagttcccatcagacattgcaacagtactactagctgcaggttcaaccgtcactatccaggtggcttccaaaaggctatgcctcactttggaagagttcttgcagcaacctccatgcgattctaggaccctgttgctgagcatattcatcccagatagggtgtcagatggcatcacctttgagacttttcgagccgcccctcgtccatgtggcaatgctgtctcatatgttaattccgcttt

SEQ ID NO: 47950 - protein, 241 aa, Panicum virgatum
  misc_feature: Ceres CLONE 2039720
  misc_feature (41)..(214): Pfam Name: FAD_binding_5 Pfam Description: FAD binding domain in molybdopterin dehydrogenase
  misc_feature: SWISSPROT Homolog: EC 1.2.3.1 Aldehyde oxidase
PAEVSKLPGYNSGAVCTFPEFLKSEINASVEQANNALVPISDDGWYRPKSIDELHRLFESNSFDENSVKIVASNTGSGVYKDQDLHDKYIDIKGIPELSVINRSSKGIELGSVVSISKAIDVLSDGNLVFRKIADHLNKVASPFVRNTATIGGNIIMAQRLQFPSDIATVLLAAGSTVTIQVASKRLCLTLEEFLQQPPCDSRTLLLSIFIPDRVSDGITFETFRAAPRPCGNAVSYVNSA

SEQ ID NO: 47951 - DNA, 701 bp, Panicum virgatum
  misc_feature: Ceres CLONE 2039724
  misc_feature: Encodes the peptide sequence at SEQ ID NO. 47952
acgcagccatcggatttctttcttcttccccacccaaacaaaccctcgctcgatcgcagccatggccaacccgcgcgtgttcttcgacatgaccatcggcggcgcccccgcggggcgcatcgtgatggagctgtacgcgaacgaggtgccccgcacggcggagaacttccgcgcgctgtgcacgggcgagaagggcgtgggcaagaaggggaagccgctccactacaagggctccgtcttccaccgcgtcatccccgacttcatgtgccagggcggcgacttcaccgacggcaacggcaccggcggcgagtccatctacggcgccaagttcgccgacgagaagttcgtgcgcaagcacacgggccccggggtgctctccatggccaacgccgggcccaacaccaacggctcccagttcttcgtctgcaccgtgccctgcccctggctcgacggcaagcacgtcgtcttcggccaggtcgtcgaggggctcgacgtcgtcaaggccatcgagaaggtcggctcccgcagcggctccaccgccaaggtggtcaagatcgccgactgcggccagatcccctagatggatctgctccctccctccatccgccgccgtccgtcgtccccttccgcgctgaataagatgacggtgatctgagaggtgcttcttcttctgaattgagtcgtgtcgtgtcgtgtcgtcc

SEQ ID NO: 47952 - protein, 172 aa, Panicum virgatum
  misc_feature: Ceres CLONE 2039724
  misc_feature (5)..(171): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MANPRVFFDMTIGGAPAGRIVMELYANEVPRTAENFRALCTGEKGVGKKGKPLHYKGSVFHRVIPDFMCQGGDFTDGNGTGGESIYGAKFADEKFVRKHTGPGVLSMANAGPNTNGSQFFVCTVPCPWLDGKHVVFGQVVEGLDVVKAIEKVGSRSGSTAKVVKIADCGQIP

SEQ ID NO: 47953 - DNA, 698 bp, Panicum virgatum
  misc_feature: Ceres CLONE 2039726
  misc_feature: Encodes the peptide sequence at SEQ ID NO. 47954
atctcatccctcgatccctcgcgctccccacaaaccctactcgcctcctccctcgcgccgccgcctcctcttctctcctcgcgttcgggaagggcctcgtcatggcctcggagacggagacggagacgttcgccttccaggcggagatcaaccagctgctctccctcatcatcaacaccttttactccaacaaggagatcttcctcagggagctcatctccaactcctccgatgcattggacaagatcaggttcgagagcttgacggacaagagcaagctggatgcccagccagagctgttcatccacattgttcctgacaaggcctccaacactctgacaatcattgacagtggtattggtatgaccaagtcagatcttgtgaacaaccttggtaccattgcgcggtcaggcacaaaggagttcatggaggctctggctgctggtgctgatgtttctatgattggccagtttggtgttggtttctactctgcctaccttgttgctgagagagttgttgtgaccactaagcacaacgatgatgagcagtacgtgtgggagtctcaggctggtggctccttcactgtcacacgtgatacctctggggagccccttggcaggggtaccaagatgactctctacctcaaggatgatcagttggagtaccttgaggagcgtcgcctcaaggatctgatcaag

SEQ ID NO: 47954 - protein, 198 aa, Panicum virgatum
  misc_feature: Ceres CLONE 2039726
  misc_feature (30)..(184): Pfam Name: HATPase_c Pfam Description: Histidine kinase-, DNA gyrase B-, and HSP90-like ATPase
MASETETETFAFQAEINQLLSLIINTFYSNKEIFLRELISNSSDALDKIRFESLTDKSKLDAQPELFIHIVPDKASNTLTIIDSGIGMTKSDLVNNLGTIARSGTKEFMEALAAGADVSMIGQFGVGFYSAYLVAERVVVTTKHNDDEQYVWESQAGGSFTVTRDTSGEPLGRGTKMTLYLKDDQLEYLEERRLKDLI

SEQ ID NO: 47955 - DNA, 664 bp, Panicum virgatum
  misc_feature: Ceres CLONE 2039733
  misc_feature: Encodes the peptide sequence at SEQ ID NO. 47956
cacgccttatccctccctctctctctctcggtcttctttcctagctagcgccgacgacagacagggcgagtggcgccgcccttgccagtccttcgtcgagcgcttcgccggccgacaagggttgcgaccagcacaatagattgcgattcacgggaggcgcattggccacaatggctctaaccctcctccgagggatgaggacgccgatctcatttagatcaagtacaggcttattctttactgttctaagacctcggttggcccgcttcacaaccagggtggagagtgcacaggcaactgaggccaaagcagcagccaaatcaattcaactggtgaccaaggaggcagcagagcagaagacacaaggttttgaagcgatcattggaattgagacccatgtccaactctcgaccgtcacaaaagcattttgttcttgcccgtacaactatggctcccagcccaataccactatctgccccacctgcatgggccacccagggacactgccagttctgaatgagaaggtcgttgagtgtgccgtgaagttgggccttgctctcaactgtgagatctcaatgacatccaagtttgatcggaagcagtatttctacccggacctccccaaggggtaccagatttctcagtttgacattcccattgccaa

SEQ ID NO: 47956 - protein, 164 aa, Panicum virgatum
  misc_feature: Ceres CLONE 2039733
  misc_feature (65)..(164): Pfam Name: GatB_N Pfam Description: PET112 family, N terminal region
MALTLLRGMRTPISFRSSTGLFFTVLRPRLARFTTRVESAQATEAKAAAKSIQLVTKEAAEQKTQGFEAIIGIETHVQLSTVTKAFCSCPYNYGSQPNTTICPTCMGHPGTLPVLNEKVVECAVKLGLALNCEISMTSKFDRKQYFYPDLPKGYQISQFDIPIA

SEQ ID NO: 47957 - DNA, 651 bp, Panicum virgatum
  misc_feature: Ceres CLONE 2039736
  misc_feature: Encodes the peptide sequence at SEQ ID NO. 47958
gtggaagctttcgcctcttcctcttcctcgccctccgtcgtcttccttcccaatagtcccctctctctccagtcgccaaagcttaacacacccgcgaacgcccccccccccccccccccgcctcgccgccctcgccccccgccgcgatccagggagccagcgagcggccggccatggccgcgggggcgatccgggtcaccatggaggtgggcgccgacggcgtcgcgctcatcaccatcgccaacccgcccgtcaacgcgctccaccccatcatcatcgccgggctcaaggacaagtacgcggaggccgcgcgccgcgacgacgtcaaggccatcgtgctcaccggtgctggaggcaagttctgcggaggatttgatatcaatgttttcacgaaggttcatcagactggggatgtgtcgcttatgccagatgtatctgttgagcttgtgtcaaacatgatggaagagggcaaaaaaccttctgttgcagctattcaaggccttgctctgggtggtggcctagaattggctatgggttgtcatgctcggatatctacccctgaagctcagcttggattaccagagctgacgctgggcatcatccctggatttggaggaacccagcgtctgccaaggcttgtaggtctgccca

SEQ ID NO: 47958 - protein, 159 aa, Panicum virgatum
  misc_feature: Ceres CLONE 2039736
  misc_feature (18)..(159): Pfam Name: ECH Pfam Description: Enoyl-CoA hydratase/isomerase family
  misc_feature: SWISSPROT Homolog: EC 4.2.1.55 3-hydroxybutyryl-CoA dehydratase
MAAGAIRVTMEVGADGVALITIANPPVNALHPIIIAGLKDKYAEAARRDDVKAIVLTGAGGKFCGGFDINVFTKVHQTGDVSLMPDVSVELVSNMMEEGKKPSVAAIQGLALGGGLELAMGCHARISTPEAQLGLPELTLGIIPGFGGTQRLPRLVGLP

SEQ ID NO: 47959 - DNA, 656 bp, Panicum virgatum
  misc_feature: Ceres CLONE 2039750
  misc_feature: Encodes the peptide sequence at SEQ ID NO. 47960
aaaaaaaaaaaaaaaaaataatttcgctccttgtttgcattccacctgcactgatttttgaagggcctcaattgatgcagcacggatttagcgacgctattgctaaagtaggtctgcaaaagtttgttactgaccttttcttggttggactgttctaccatctgtacaaccagcttgctacaaatactttggagcgagtggctcctctgacacacgctgttggcaatgtgttgaaacgtgtgtttgtcattggtttttcaatcattgtttttggcaacagaattacgacacaaactggaattggcacttgcattgccatagctggtgtggccatgtactcttacatcaaggctaggattgaagaggagaaaaggaaaaagagcgcatgatgaggtgactactgtgaatatgtgtcgggtggctgagttgtacttcctgagacaacatcgtcgacaatcatgacttccttctctgccttgttttttgttttcaccttgagtcatttggtcaattgtttgttcccaacctggtcatgaacagcagcacattgcagatggcaagtatattgttcttcataccatcagaacagataatcgttgcgtgtgcatgaatgtgtagaaaataaacgctcatacttgaaaggctttttggtttgt

SEQ ID NO: 47960 - protein, 128 aa, Panicum virgatum
  misc_feature: Ceres CLONE 2039750
  misc_feature (3)..(114): Pfam Name: TPT Pfam Description: Triose-phosphate Transporter family
KKKKKIISLLVCIPPALIFEGPQLMQHGFSDAIAKVGLQKFVTDLFLVGLFYHLYNQLATNTLERVAPLTHAVGNVLKRVFVIGFSIIVFGNRITTQTGIGTCIAIAGVAMYSYIKARIEEEKRKKSA

SEQ ID NO: 47961 - DNA, 528 bp, Panicum virgatum
  misc_feature: Ceres CLONE 2039756
  misc_feature: Encodes the peptide sequence at SEQ ID NO. 47962
catgaatgtgtgatggatggctttgagcgctttgctcaaggccacttgatcactcttttctctgctacaaattattgcggtactgcaaataatgctggtgcaatcttggttttgggtagagatcttgtggtcgttccaaaactaattcatcctttgccacctgcaattacatcacccgaggcatcaccagatcatattgaggacacatggatgcaggagctgaatgctaacagaccaccaactccgaccaggggccgtccccaagcagtagctaatgaccgaggttctcttgcctggatgtagtagatttgccttacattggttgggatccatatgaagcctcagtcagaaggatcttgccattttcatttgtgttcggcagagaggctggcccacagccaaatattgatgtacagggagcagagcggactaaaaagctattagaagggagctttgtttacgacagcgctccccaattaatttgactgaacacaaatagcagtgcatatagaactcatcagaagatcg

SEQ ID NO: 47962 - protein, 100 aa, Panicum virgatum
  misc_feature: Ceres CLONE 2039756
  misc_feature: SWISSPROT Homolog: EC 3.1.3.16 Phosphoprotein phosphatase
HECVMDGFERFAQGHLITLFSATNYCGTANNAGAILVLGRDLVVVPKLIHPLPPAITSPEASPDHIEDTWMQELNANRPPTPTRGRPQAVANDRGSLAWM

SEQ ID NO: 47963 - DNA, 539 bp, Panicum virgatum
  misc_feature: Ceres CLONE 2039780
  misc_feature: Encodes the peptide sequence at SEQ ID NO. 47964
aagcacggctgacgtcaaccccggcggtccgtttccccttccgccccaaagcaaaccctctgctcccatgtccgccgccgccgccgcccgcgccgcgcggctgctgctcccgtgtctcccccagaccactgccacgcgccttctccatgcgagtgtttcgcagggagcggcgcgggaagcgtccgggagcttcatccaccccgccgccgtcgtccaccccgatgcggtcatcggccagggtgtctcgatagggcccttttgcacggtagggccttcagccagggttggtgatgcctgtcaattacatgctgggagccatgtcgtgggaaacactgagctaggggagggatgcattgttcaaacgtgagatatcatcttttcacattttgtttctcctgatttccaccccttttgtaactatgttgatgcttgcattgacctccattggaactccatatttttaaatataattgaatcaaagaaagatgaagatgtattgaacatcttctgtggaataaaagtacaatcaaattaagctt

SEQ ID NO: 47964 - protein, 99 aa, Panicum virgatum
  misc_feature: Ceres CLONE 2039780
  misc_feature: SWISSPROT Homolog: EC 2.3.1.129 Acyl-[acyl-carrier-protein]--UDP-N-acetylglucosamine O-acyltransferase
MSAAAAARAARLLLPCLPQTTATRLLHASVSQGAAREASGSFIHPAAVVHPDAVIGQGVSIGPFCTVGPSARVGDACQLHAGSHVVGNTELGEGCIVQT

SEQ ID NO: 47965 - DNA, 706 bp, Panicum virgatum
  misc_feature: Ceres CLONE 2039783
  misc_feature: Encodes the peptide sequence at SEQ ID NO. 47966
aagagccaactccggcagaggctcccggctctgatcgttcgtcatgatatcacccaggtctctttctttttcggccttgctgctcagtgctgccgccaacgcgcaggtctacgaaactggcgggcggtctgaagatgcgttcacctggatccagccggaagatacgatcgtcttagatcagtacaaccactcggagcctgtgtatccctctcctcgcattggtaatgcaaatggctggcaggaggctcttggaaaagctcgagctttcgtcggcgagctcaccttagaagagaaggcagacatggtcaccggtcaacctggtccatgtgttggcaacatttacccaatccctcgcctcaacttcagcggtctctgcttgcaggatggaccggcatctctccgaaccaccgactttgtcagcgtctttcccggtggcgtcacgatcgcagcttcgtgggacaagaagttgatgtaccagaggtctgtcgccatgggccgtgagttcaaagccaagggtgctcagatcgctcttgctccctctgttggtcccatgggccgctccgcctactccggccgcaactgggaaggcttctcaccagacccttacctcagcggtgttgccatggaagagtcaatcctaggtattcaagacgctggtgtccaggctaccgccaagcactggcttctgaacgaacaggaggttctc

SEQ ID NO: 47966 - protein, 220 aa, Panicum virgatum
  misc_feature: Ceres CLONE 2039783
  misc_feature (99)..(220): Pfam Name: Glyco_hydro_3 Pfam Description: Glycosyl hydrolase family 3 N terminal domain
  misc_feature: SWISSPROT Homolog: EC 3.2.1.21 Beta-glucosidase
MISPRSLSFSALLLSAAANAQVYETGGRSEDAFTWIQPEDTIVLDQYNHSEPVYPSPRIGNANGWQEALGKARAFVGELTLEEKADMVTGQPGPCVGNIYPIPRLNFSGLCLQDGPASLRTTDFVSVFPGGVTIAASWDKKLMYQRSVAMGREFKAKGAQIALAPSVGPMGRSAYSGRNWEGFSPDPYLSGVAMEESILGIQDAGVQATAKHWLLNEQEV

SEQ ID NO: 47967 - DNA, 695 bp, Panicum virgatum
  misc_feature: Ceres CLONE 2039794
  misc_feature: Encodes the peptide sequence at SEQ ID NO. 47968
aagtcacccttcgacacctccagccagagtccaagtgcgcaggctagcactcgtgtcgcgtctcttctccctgagctcccgtcgatcgacggcgcaccgcggggtcgggaagcgagctagccgaagcgcgttccggccatggcgagatcgccgggcctggggctcgcctgcttcgcgctcgtggtcgcggcggccagcgcgacgcagttccgggttggcggccagaaaggctggagcgtgccggacgccggcttcgagccctacaacacctgggcggggaggctccgcttccagatcggcgaccagctcctgttcgtgtaccccaaggagacggactcggtgctcctggtggacccggcggcgtacaacgcgtgcaacgtctcctcgtacctccagaagttcgacgacggcaacacggtgttcacgctcgaccgctcgggccccttcttcttcatcagcggcaacgaggccagctgccgggccaacgagaagctcatcgtcgtcgtcctcgccgatcgcaccggcgcgcgcaccccgcccggggccggggccccgcccacgatgtccccgccgtcccccgcgcctctgccgagcccgtcctcgccgcctcctgtggccgcgcctgcgctgagcccgtcgtcgccaccaccctcaggcgccgcccctctgccggcgcccgcggccaccccagcctc

SEQ ID NO: 47968 - protein, 185 aa, Panicum virgatum
  misc_feature: Ceres CLONE 2039794
  misc_feature (32)..(117): Pfam Name: Cu_bind_like Pfam Description: Plastocyanin-like domain
MARSPGLGLACFALVVAAASATQFRVGGQKGWSVPDAGFEPYNTWAGRLRFQIGDQLLFVYPKETDSVLLVDPAAYNACNVSSYLQKFDDGNTVFTLDRSGPFFFISGNEASCRANEKLIVVVLADRTGARTPPGAGAPPTMSPPSPAPLPSPSSPPPVAAPALSPSSPPPSGAAPLPAPAATPA

SEQ ID NO: 47969 - DNA, 740 bp, Panicum virgatum
  misc_feature: Ceres CLONE 2039795
  misc_feature: Encodes the peptide sequence at SEQ ID NO. 47970
aacccatactcaagcagctcaaaacctctatccagctaccaagaaatggctctgcttgcttcagccctgatgagtcgcactacccatccaggccttattagaagccacataggacccaatggtgacaatttgtcatggcgcctaccttcaaaagagaagagtaagagaaggtgtgacccgagccttagatcacaagcagaaaggatgagcagcgagcttggacaagaacatctcatgccatcagaaaggatgggaagcgagcttggacaagaacatctcatgccacgggaaatccctaggagggactggttccaccccggattcgtctttggcgccgccactgcagcgtaccaaattgaaggtgcttggaatgagcatggcaaggggccaagcacttgggaccacttctgccacaatcatcctgagatgatagctggctggagcaatggggatgttgcagtgaactcgtaccatctgtatgaagaggatgtcaaaatgctcaaggaaatgggcatggatgcctataggttctccatctcctggtcaaggatactgccaaaggggacgcttgaaggtggcataaattataaaggcatcaattactacaaaaacctgatcaacaagttgaaagagaatggcatagagccatatgtaacaattttccactgggacactcctcaagcactggaagacaagtatggcggcttcttaaaccccaggattataaagattacacagac

SEQ ID NO: 47970 - protein, 231 aa, Panicum virgatum
  misc_feature: Ceres CLONE 2039795
  misc_feature (85)..(231): Pfam Name: Glyco_hydro_1 Pfam Description: Glycosyl hydrolase family 1
  misc_feature: SWISSPROT Homolog: EC 3.2.1.21 Beta-glucosidase
MALLASALMSRTTHPGLIRSHIGPNGDNLSWRLPSKEKSKRRCDPSLRSQAERMSSELGQEHLMPSERMGSELGQEHLMPREIPRRDWFHPGFVFGAATAAYQIEGAWNEHGKGPSTWDHFCHNHPEMIAGWSNGDVAVNSYHLYEEDVKMLKEMGMDAYRFSISWSRILPKGTLEGGINYKGINYYKNLINKLKENGIEPYVTIFHWDTPQALEDKYGGFLNPRIIKITQ

SEQ ID NO: 47971 - DNA, 699 bp, Panicum virgatum
  misc_feature: Ceres CLONE 2039798
  misc_feature: Encodes the peptide sequence at SEQ ID NO. 47972
acaccccaattacgtttgatttttgatcccgcatcgatttcaattcatccgtttctgagtttcttttggatctgggtgtcttgagctaatcttttcgatctgttgtttatcgattttactcatgcaagaaaatggctgatggtgaagacattcaacctcttgtttgcgacaatggaactggaatggttaaggctggttttgctggggatgatgcacctagagctgtgtttcctagtattgtgggtcgtcctcgtcacaccggtgtgatggttgggatggggcaaaaggatgcttatgttggcgatgaagctcaatccaaacgaggtattttaactctcaagtaccctattgagcatggaattgtcaacaattgggatgacatggagaagatttggcatcacactttctacaatgagctccgtgttgctcctgaggaacatcctattctacttaccgaggcaccgcttaacccgaaagctaatcgtgagaagatgactcaaatcatgtttgagactttcaatgcccctgctatgtatgtggctattcaggctgttctttctctttatgccagtggtcgtactaccggtattgtgctcgactctggagatggtgtgagccacactgttcctatctatgaggggtatgcacttccacatgctatcctacgtcttgatcttgctggtcgtgacctcacggatg

SEQ ID NO: 47972 - protein, 189 aa, Panicum virgatum
  misc_feature: Ceres CLONE 2039798
  misc_feature (4)..(189): Pfam Name: Actin Pfam Description: Actin
  misc_feature: SWISSPROT Homolog: EC 2.7.10.2 Non-specific protein-tyrosine kinase
  misc_feature: Functional homolog of the protein sequence given in SEQ ID NO 50712
  misc_feature: Useful for making plants with modulated biomass
  misc_feature: Functional homolog of the protein sequence given in SEQ ID NO 50711
  misc_feature: Useful for making plants with modulated flowering time
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTD

SEQ ID NO: 47973 - DNA, 701 bp, Panicum virgatum
  misc_feature: Ceres CLONE 2039806
  misc_feature: Encodes the peptide sequence at SEQ ID NO. 47974
aaaaagccctcacacacggctctctccccgccccgcgcgcgcacccgtggtcgcctcgccgcgcgctctgctcggacgcggacgggcgggcgggagcgtctcccgggagtccaccggccttccgctgccccggcgagcggcgtcctcggctcctcgccaccgccgcgaggaccagcttcccaccggcacgggggaaaggaaggaaccaccagaccggcggcggcgacgcgcgtccggatggattccgggtcggagcagcagcacggctgcgagcattacaggcgcgggtgtcgggtcgtggcgccctgctgcggcgaggtcttcggctgccgccattgccacaacgacgccaagaactcgctcgaggtcgacccgcgcgaccggcacgagatccctcgtcacgaaataaacaagatggatgtaatttttcgagacgaatctaatgagctaagttccaccatgattggctacagtggtgctacagtaaccgctcataatcatcttctaatcatgcggtcaaagatcttattagttacatcacatgctacagtatcataattatgaagattattttataattagattttatttaatacctttaattagtagttaaaagaggaaaaagtttttcacccctaaccaacaaggccagggaaccgctccttcttatatttccgttgaacgctccacttgtctctaaa

SEQ ID NO: 47974 - protein, 106 aa, Panicum virgatum
  misc_feature: Ceres CLONE 2039806
  misc_feature (11)..(78): Pfam Name: zf-CHY Pfam Description: CHY zinc finger
MDSGSEQQHGCEHYRRGCRVVAPCCGEVFGCRHCHNDAKNSLEVDPRDRHEIPRHEINKMDVIFRDESNELSSTMIGYSGATVTAHNHLLIMRSKILLVTSHATVS

SEQ ID NO: 47975 - DNA, 715 bp, Panicum virgatum
  misc_feature: Ceres CLONE 2039811
  misc_feature: Encodes the peptide sequence at SEQ ID NO. 47976
tttcctctcgcctgtccattcacatcagccctccacgcccccgccccgaatttcccaaatcctgcgctgcctcctccccaaccccgctcgtcaaatcctctccacccaacacgccggaggaatccctccgggactcgtcttcctgaccccctccgcagggctggcgtggagtggagatccacctgcacgtggattggtctctcctgctgctgagctagtaaataagtgaattctgtgaatcattcgataaaggaactctgcactgggggcaggtgaccacacttttttcttggtctgacccttcatattctcagtgtcatgcgttctctgatgttgcttcttgctttagagtgaaagctctgtcctttttgggagctaaagaggcaaaaagaacatagggctagaggagaggaataaacaatgggaaagggtgatgtggccacgaggtccaaatctcaaaaatcgtcagcaatacagaatgagcagagtacgcctactaatccccccacagcatatcctgactggtcccagttccgggcatactataatgctgctgggacagctccagtgacccctccggctttttttcattcatctgtagctccaagtccacagggacacccatacatgtggggtccacagatgatgcctccttatgggataccaccaccatatgcagctatgtatgcacaaagcacaccatatcagcagggca

SEQ ID NO: 47976 - protein, 98 aa, Panicum virgatum
  misc_feature: Ceres CLONE 2039811
  misc_feature (1)..(98): Pfam Name: MFMR Pfam Description: G-box binding protein MFMR
MGKGDVATRSKSQKSSAIQNEQSTPTNPPTAYPDWSQFRAYYNAAGTAPVTPPAFFHSSVAPSPQGHPYMWGPQMMPPYGIPPPYAAMYAQSTPYQQG

SEQ ID NO: 47977 - DNA, 636 bp, Panicum virgatum
  misc_feature: Ceres CLONE 2039820
  misc_feature: Encodes the peptide sequence at SEQ ID NO. 47978
acaacagccgacaaccagacgcgcgagggtttcccttccacaaccccccccccccaacccccccgcctccacccgcgagaagtcggctgcgctccgcctccgccgccggccctcgctcctcggttaactaatcatccacactcagtcaagatgtctgacagccatgagactgataggaacattgagatttggaagattaagaagctgatcaaggcattggagtccgccagaggcaatggcacaagcatgatctctcttatcatgcctccacgtgatcagattgctcgagtggctaagatgttaggtgatgaatatggtactgcttcaaacatcaagagtagagttaatcgtcaatctgtgttggctgctatcacctcagctcaacagaggttgaagctctacaacaaagtgcctccgaatggattggttctctacactggaaccattgttactgaagatggaaaggaaaagaaagttactattgattttgagcccttcaagcctattaatgtgtcgctatacctttgtgacaacaagttccacactgaggctctaaatgagctcttagaatctgatgacaagtttgggttcattgtcatggatggtaatggtactcttttcggcacactaagtggg

SEQ ID NO: 47978 - protein, 161 aa, Panicum virgatum
  misc_feature: Ceres CLONE 2039820
  misc_feature (6)..(140): Pfam Name: eRF1_1 Pfam Description: eRF1 domain 1
MSDSHETDRNIEIWKIKKLIKALESARGNGTSMISLIMPPRDQIARVAKMLGDEYGTASNIKSRVNRQSVLAAITSAQQRLKLYNKVPPNGLVLYTGTIVTEDGKEKKVTIDFEPFKPINVSLYLCDNKFHTEALNELLESDDKFGFIVMDGNGTLFGTLS

SEQ ID NO: 47979 - DNA, 674 bp, Panicum virgatum
  misc_feature: Ceres CLONE 2039823
  misc_feature: Encodes the peptide sequence at SEQ ID NO. 47980
cagaggcagccatggacgagatcaagatcttgaagcagattgctgatggtgatcctgatgactccaaatgtgttgttaagctccttgaccacttcaagcactcaggccctaatggcaaccatgtgtgcatggtctttgagtttcttggtgataacttgttgaccctgataaagtacacaaactatcgtggaattccccttccgatggtcaaggagatatgccgccatgtgctcatcagcctcgactacctccaccgcacactttctattattcacactgaccttaagcctgagaatatattgctcatgtctaccattgacccctcaaaggacccccgaaagtcaggtgtgcccttggttctgccttttgcaaagacagacgagccaactccaaaggtgcctgcaccatcagcaaatggtggcctctccaagaatcagaagaagaagatccggaagaaagccaaacgtgcagctgctgcaacttcagaacggagtagtgctgtggcatctgctgacacagatgggtcagacgacagaggagatctgggcacagcaactgagggcagtcctagccaggatggagctaagaagcgggcaaaaggagatagacagggtagcaaaggggctaagaagaagatggcaatggaggctgatctaaagtgcaagctggtggac

SEQ ID NO: 47980 - protein, 223 aa, Panicum virgatum
  misc_feature: Ceres CLONE 2039823
  misc_feature: SWISSPROT Homolog: EC 2.7.11.1 Non-specific serine/threonine protein kinase
EAAMDEIKILKQIADGDPDDSKCVVKLLDHFKHSGPNGNHVCMVFEFLGDNLLTLIKYTNYRGIPLPMVKEICRHVLISLDYLHRTLSIIHTDLKPENILLMSTIDPSKDPRKSGVPLVLPFAKTDEPTPKVPAPSANGGLSKNQKKKIRKKAKRAAAATSERSSAVASADTDGSDDRGDLGTATEGSPSQDGAKKRAKGDRQGSKGAKKKMAMEADLKCKLV

SEQ ID NO: 47981 - DNA, 543 bp, Panicum virgatum
  misc_feature: Ceres CLONE 2039829
  misc_feature: Encodes the peptide sequence at SEQ ID NO. 47982
gcacagcgaggttctccccctcccccctccaccctcactgcgtctccgggcggcaggatccggccaccggcgcgattcccgctgcgtctcagtgaaattactcaggttactcaatgctcctgatctaacagaaaaccatgggagaagttagtgaaaagaattcatacatgtctgttctacaaaaaattgctacgagtggtgtgccactgctgaaagactatggtctgagtggagttgtttgtgctgtgcttgtggctatagttattcctttattgcttacctcaatgtttggcaaaaagacaaagaaaaaggcagtgcaagctgatgtgggtggagaggcaggacttgccatgcgaaacagtacattttcatccttagttcaagtcccatgggagggtgccaccacactggctgcactattcgagatggccagcaaaaagtactctctacggaggagtcttggcacaagaaagctaattaatagggaatttgtcgagtctgctgatggtagacagtttgagaaattgcatcttggtgaatatc

SEQ ID NO: 47982 - protein, 135 aa, Panicum virgatum
  misc_feature: Ceres CLONE 2039829
  misc_feature: SWISSPROT Homolog: EC 6.2.1.3 Long-chain-fatty-acid--CoA ligase
MGEVSEKNSYMSVLQKIATSGVPLLKDYGLSGVVCAVLVAIVIPLLLTSMFGKKTKKKAVQADVGGEAGLAMRNSTFSSLVQVPWEGATTLAALFEMASKKYSLRRSLGTRKLINREFVESADGRQFEKLHLGEY

SEQ ID NO: 47983 - DNA, 647 bp, Panicum virgatum
  misc_feature: Ceres CLONE 2039838
  misc_feature: Encodes the peptide sequence at SEQ ID NO. 47984
acgtgacaccctcgcgcgcccaccacacctccggctgccccgccccgcctccctcgcgccgggaatggcctgctcccgcctcgccgcggcgccatccgcggggcccgccgcggcccgggcgcgctcgccggcgtcttcgacggcacccgccttcgcgcgcgtcccggcggcgcaccgttacgcgagcggcgggctgtcagtcaggggcgggaaggcggcgtcccccgtggccgtcggcgcggggctggccgcggcggcgccggtggcgggcctggacggccgcccgaccacggcgaagcagcccatcatcgtcatagataactacgacagctttacctacaacctgtgccagtatatgggggagcttggattaaacttcgaggtatatcgcaatgatgaactgaccatagaggatgtaaaaaggaagaacccaagaggaatacttatttctccagggcctggtgaaccgcaagattctggtatatcattgcagactgttcttgaattgggcccaaccatcccaatttttggagtttgtatgggtctgcagtgcattggggaggcatttggaggaaagattatccgtgctccttctggagtgatgcatggaaaaagctctccagtttattacgatgaggaattaggaa

SEQ ID NO: 47984 - protein, 194 aa, Panicum virgatum
  misc_feature: Ceres CLONE 2039838
  misc_feature (82)..(193): Pfam Name: GATase Pfam Description: Glutamine amidotransferase class-I
  misc_feature: SWISSPROT Homolog: EC 4.1.3.27 Anthranilate synthase
MACSRLAAAPSAGPAAARARSPASSTAPAFARVPAAHRYASGGLSVRGGKAASPVAVGAGLAAAAPVAGLDGRPTTAKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELG

SEQ ID NO: 47985 - DNA, 739 bp, Panicum virgatum
  misc_feature: Ceres CLONE 2039865
  misc_feature: Encodes the peptide sequence at SEQ ID NO. 47986
acacaagcaccgcaccgcgctcccctgtcgtctcgccctcgccccccgcggccgtttcacccgcttcccccgcctgcgcgcgcgctccccgtccgtctccggcggcgacgacgacgaagaaccgcggggacagagaaacagagagatgaggactaggagcggttccctgtattccaacaacggaggcgaggccgccgtggggcagaagaggaagaggacggcgtcgccgatggggcagaagaggaagaggctcgcgagagggccggactacctggacgtgctccccgacgacctcgacctctccatcctgtccaagctcgccgcctccgcctcggcgccctccgaccttgtctccgtgcacctcacatgcaagaggctcaacgagctcggcgggcatgacatggtgttcgccaaggcctcgccggcgtcgctggccgtgaaggcggcagcgtggtcggagccggcgcagaggttcctcaagcgctgtgccgacgccggcaacctcgaggcctgctacattctcggcatgattcgattctactgcctcgggagccggagcagcggcgccgcgctgctggcgagggcggcggtcggcgcgcacgccgcggcgctctactcactggcggtcatccagttcaacggcagcggcggcgccaagtccgaccgggacctccgcgcgggcgcggcgctgtgcgcgcgcgcggccgcgctgggccacgtcgacgcgctccgcgagctc

SEQ ID NO: 47986 - protein, 197 aa, Panicum virgatum
  misc_feature: Ceres CLONE 2039865
  misc_feature: Functional homolog of the protein sequence given in SEQ ID NO 50613
  misc_feature: Useful for making plants with altered lignin content
MRTRSGSLYSNNGGEAAVGQKRKRTASPMGQKRKRLARGPDYLDVLPDDLDLSILSKLAASASAPSDLVSVHLTCKRLNELGGHDMVFAKASPASLAVKAAAWSEPAQRFLKRCADAGNLEACYILGMIRFYCLGSRSSGAALLARAAVGAHAAALYSLAVIQFNGSGGAKSDRDLRAGAALCARAAALGHVDALRE

SEQ ID NO: 47987 - DNA, 705 bp, Panicum virgatum
  misc_feature: Ceres CLONE 2039912
  misc_feature: Encodes the peptide sequence at SEQ ID NO. 47988
cctcaccagcgcttgcaacaactcatccatccagcaccgtatcgtgccctcatcacattcacgcacaatggctcgcgctcagcaggtcgtggcgatcgccgtcgttgccgccgtcgtgctgctcgccgccgcggccatctccgaggccgccgtgacctgcgggcaggtcaactccgccatcggcccctgcatcgcctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatcgatcgtgatgagttggttggagcctgctgccaagcacatccaccgatatatctagctatcgtctatatatgatcgatcgagttcgctagctcgctgatgaataaaatctctccgccgtcgctcatcatgtgagagacacggccggatcggatgtgtcagtccctgctgctacgttttgtgtctgcatgtacacctccatttccgttcgagagtctgtaccttgtccactacattttaatatatacaccacttttttggtgtatatatatgc

SEQ ID NO: 47988 - protein, 120 aa, Panicum virgatum
  misc_feature: Ceres CLONE 2039912
  misc_feature (31)..(116): Pfam Name: Tryp_alpha_amyl Pfam Description: Protease inhibitor/seed storage/LTP family
MARAQQVVAIAVVAAVVLLAAAAISEAAVTCGQVNSAIGPCIAYARGSGSGPSSACCSGVRSLNSAARSTADRRAACNCLKSAAGRVSGLNAGNAASIPSKCGVSIPYTISPSVDCSKVA

SEQ ID NO: 47989 - DNA, 646 bp, Panicum virgatum
  misc_feature: Ceres CLONE 2039938
  misc_feature: Encodes the peptide sequence at SEQ ID NO. 47990
gctcggaagcagcagcgcaccagagatccaccctatcgcgccgcacctccgtccgcgcccatgtcatcgacgccgctgcggcgcgctgacctgtcgccctcgccctcttcctcgtcttcgctcctctcccgcatgcgctccgcggcgtccagtctcctgtcccggcagtacagcacggataagggaggtgacggcactgctcggcggaatggtggcggctcttcctccgcgcctaggacactcaggccaggattcgtggatccttcaaaatggagacattttgactcgagggcttttggcattaacctggatgctatacctaaagatgcattgtttgttctaaaaaagctcagacgaaaaggttttgaagcttatcttgttgggggatgtgtgagagatttgctactgaaaagggtacctaaagattttgatgtgattaccactgcaagtctcgaacagattaggaaaaatatattcaagcgatgtatgattataggcagacgctttccgatatgcctgcttaaaatgaaggactcagtaattgaggtctcaagctttcgaacagttgataaacatgcgaataaaagtaaagaggtagattgtttggaagagttgagtggctatgatgatggggatatccttcgct

SEQ ID NO: 47990 - protein, 195 aa, Panicum virgatum
  misc_feature: Ceres CLONE 2039938
  misc_feature (104)..(195): Pfam Name: PolyA_pol Pfam Description: Poly A polymerase head domain
  misc_feature: SWISSPROT Homolog: EC 2.7.7.19 Polynucleotide adenylyltransferase
MSSTPLRRADLSPSPSSSSSLLSRMRSAASSLLSRQYSTDKGGDGTARRNGGGSSSAPRTLRPGFVDPSKWRHFDSRAFGINLDAIPKDALFVLKKLRRKGFEAYLVGGCVRDLLLKRVPKDFDVITTASLEQIRKNIFKRCMIIGRRFPICLLKMKDSVIEVSSFRTVDKHANKSKEVDCLEELSGYDDGDILR

SEQ ID NO: 47991 - DNA, 683 bp, Panicum virgatum
  misc_feature: Ceres CLONE 2039957
  misc_feature: Encodes the peptide sequence at SEQ ID NO. 47992
aactgcagagtgctccttcggtccccttccccattccccattcgggcagaggccggcgctcgcaagatctgagccaaggcgatggagtcgccgttccgggcggacgtgctcaagggcaaggcggcgctggtcaccggcgggggatccggcatcggcttcgagatcgccgcccagctcgcgagccacggcgcgcaggtcgccatcatgggccgccgccgcgaggtcctcgacaaggccgtcgccgccctccgctcccagggcctccgggctgtcggttttgatggagatgtccgcaagcaggaggacgcggccagagtgctcgcggcgacagttgagcatttcggcaagcttgacattcttgttaacggcgcagctggcaacttccttgcttccccggaggatttgacgcccaagggattccgaacagttctcgacattgacactgtgggtacatacacaatgtgctttgaagccctcaagtatctgaaaaagggtgggccaggtaaaggcccgtccactggtggcctaatcattaacataagtgcaacactgcattacactgcaacttggtaccaaattcatgtctctgctgctaaggcaggtgttgatagcatcacaagatcactggctctggaatgggggactgattatgacattagagtcaacgggattgcacccggacc

SEQ ID NO: 47992 - protein, 200 aa, Panicum virgatum
  misc_feature: Ceres CLONE 2039957
  misc_feature (13)..(187): Pfam Name: adh_short Pfam Description: short chain dehydrogenase
  misc_feature: SWISSPROT Homolog: EC 1.3.1.34 2,4-dienoyl-CoA reductase (NADPH)
MESPFRADVLKGKAALVTGGGSGIGFEIAAQLASHGAQVAIMGRRREVLDKAVAALRSQGLRAVGFDGDVRKQEDAARVLAATVEHFGKLDILVNGAAGNFLASPEDLTPKGFRTVLDIDTVGTYTMCFEALKYLKKGGPGKGPSTGGLIINISATLHYTATWYQIHVSAAKAGVDSITRSLALEWGTDYDIRVNGIAPG

SEQ ID NO: 47993 - DNA, 668 bp, Panicum virgatum
  misc_feature: Ceres CLONE 2039994
  misc_feature: Encodes the peptide sequence at SEQ ID NO. 47994
gcacaaccgaaccgaatcgaatcctccgcaagtcgccgccgccgcttactccaccggaagatcgccggcgaggatgtcgtacgcctacctcttcaagtacatcatcatcggcgacacaggcgtggggaagtcatgcctgctgctgcagttcacggacaagcgcttccagcccgtgcacgacctcaccatcggcgtcgagttcggcgcccgcatgatcaccatcgacaacaagcccatcaagctccagatttgggacacggctggccaggaatcattcagatctataactagatcatactacagaggggctgctggtgcccttttggtttatgatatcaccaggagggagacattcaatcatcttgcaagctggctggaagatgcaaggcagcacgcaaatgccaacatgacagtaatgctgattggaaacaaatgtgatctgtctcacaggcgtgctgtcagctacgaggaaggtgaacagttcgccaaagagcatggtctggtctttatggaggcatctgctaaaactgcacaaaacgttgaggaggcattcatcaagaccgctggaacaatatacaagaaaatccaagatggcatctttgatgtatcaaatgagtccaacggaatcaaagttggctacgttgttcccaactcatctggtggtggtg

SEQ ID NO: 47994 - protein, 198 aa, Panicum virgatum
  misc_feature: Ceres CLONE 2039994
  misc_feature (8)..(169): Pfam Name: Ras Pfam Description: Ras family
  misc_feature (8)..(122): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
  misc_feature: Functional homolog of the protein sequence given in SEQ ID NO 50164
  misc_feature: Useful for making plants with altered terpenoid content
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYVVPNSSGGG

SEQ ID NO: 47995 - DNA, 675 bp, Panicum virgatum
  misc_feature: Ceres CLONE 2039995
  misc_feature: Encodes the peptide sequence at SEQ ID NO. 47996
ctagggtttgagcgccgccaccgccgcccgcctctctcttggaaacaacctctgtctcctcatcgtccacttgttccacgctgacgatgggagatggaaactctcccccagctgcctcccgctccacctccagcgaagaagattacggatcatggacatggaagcagaagtttgaggatctcattacctgcgatcccagccgtaatatcatgccaaagcatcctgaatctgcttcctatttcaaggaaaagcttgaggaattattcggaaagtacctacgtacggtatcccctaaactgcgccctgtatttcagaaggatagcgtcacaaagttctttcacgtgtccaatgtctggtcgcacttcatgggtctccgagagttcctgtacccggagattctcagtaccattgcctcctacaacgccctgcgatgtgctaggatggcactgaagggcggcgctccatttcgcggccgccgtgcagaccccaacggccgccaccgctacggcttcacgcccctccacgtggccgccgagaacttcagcgtggacatggtcaagctcctcttccggcacggcgcatcggcaaacatccgcaccaagggtgagaacgtcgtggagggcctcctgcctcttcatgtcgccgttgagaatgccagcatgcacaagtacctgg

SEQ ID NO: 47996 - protein, 196 aa, Panicum virgatum
  misc_feature: Ceres CLONE 2039995
  misc_feature (140)..(172): Pfam Name: Ank Pfam Description: Ankyrin repeat
MGDGNSPPAASRSTSSEEDYGSWTWKQKFEDLITCDPSRNIMPKHPESASYFKEKLEELFGKYLRTVSPKLRPVFQKDSVTKFFHVSNVWSHFMGLREFLYPEILSTIASYNALRCARMALKGGAPFRGRRADPNGRHRYGFTPLHVAAENFSVDMVKLLFRHGASANIRTKGENVVEGLLPLHVAVENASMHKYL

SEQ ID NO: 47997 - DNA, 717 bp, Panicum virgatum
  misc_feature: Ceres CLONE 2040011
  misc_feature: Encodes the peptide sequence at SEQ ID NO. 47998
aagcggcgacagagcgcctccctcccttccctacgaccctaccacccgctccgcgagagtccgaccgctcggcgctcgctcccaccacagaaatctcgccgctggtcagtgatatctccctccggcctccgcacccgccgcctgctcctcctcctcgcctcctcttcctcgccgcgaaaacaataacccgcgcctttgcctgcttcgggatttttcagttcgtcatcttctgctcccgcccgagttcacgcaggtagaagaggctcgtcctgtttatcatgtcaggaggatcagctggatcttcaacatcatcaaggcgggccagctttaattctttatctagagacctagaccttccttcagaacaagggtgtctatctattgttgtacttggggcttctggtgaccttgccaagaagaaaactttcccagcactctaccaccttttcgatcagggatttatacagtctggagaagtgcatatatttggttatgctagatcaaatctttctgatgatgggttaagagaacgcattcgtggatatctcaaaggagccgcggaggaagatctttcagaatttttgcaattgataaaatatgtcagtggttcttatgacaatggggagggatttgagaaattgaacaaggcaatatcagagtatgaggcgtcaagcaaatcagaaagctatcgcaggctcttttatttggcattgcctc

SEQ ID NO: 47998 - protein, 146 aa, Panicum virgatum
  misc_feature: Ceres CLONE 2040011
  misc_feature (36)..(146): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MSGGSAGSSTSSRRASFNSLSRDLDLPSEQGCLSIVVLGASGDLAKKKTFPALYHLFDQGFIQSGEVHIFGYARSNLSDDGLRERIRGYLKGAAEEDLSEFLQLIKYVSGSYDNGEGFEKLNKAISEYEASSKSESYRRLFYLALP

SEQ ID NO: 47999 - DNA, 415 bp, Panicum virgatum
  misc_feature: Ceres CLONE 2040020
  misc_feature: Encodes the peptide sequence at SEQ ID NO. 48000
gcaactaacagcaacccatcgtcgtcgctactagctagctactcaggggcactctcgctgctcgcccataatctccttcttctccgatcccaagcaaaagagcaagaccatgtcgacggtgagccgtgcatccctcgaccagaagcttgccctcgccaagcgatgctcgcgagaggcgaccctcgcaggggctaaggctgcagctgtagcgaccatcgcctctgcaattcccacgctggcgagcgtgaggatgctgccatgggcgaaggccaacatcaaccccacaggccaggcactcatcatctccacagtcgccgggatggcctacttcatcgccgccgacaagaagatcctgtcgctagcgaggcaccactcgttcgaggacgcacccgagcacctcaggaacccctcctac

SEQ ID NO: 48000 - protein, 101 aa, Panicum virgatum
  misc_feature: Ceres CLONE 2040020
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIISTVAGMAYFIAADKKILSLARHHSFEDAPEHLRNPS

SEQ ID NO: 48001 - DNA, 648 bp, Panicum virgatum
  misc_feature: Ceres CLONE 2040053
  misc_feature: Encodes the peptide sequence at SEQ ID NO. 48002
atcgcatcgcatcgcatcgcatcgcaccacaccaccaccacccaacccccgttcctcgcagttgcagcacgctcttctgctccaagctaggagagcaaggccgggcccaacgcgcggcggatggcggagacggagcccaccaccaacggcggcagcgctggcggcggcattggggccatcctcgccgccggcgaccgggacttcctcgtccgcaactccggcgagcaggtgaagatcagcagcatagaggcgagccctgtagccctctacttctcagcctcatggtgcccgccatgcaggcggttcacacccaagctgatcgaattatacaaagaactggcctctcagggcaagagctttgaggttgtatttgtttcaggtgatcaggatgaggaagcattcaattcatactttggaaagatgccatggttggctgtccctttctctgactctgaaggccgtgaaggccttgatggccggtttaaggtatctggtatcccacaccttgtcattcttgatgcaaaaactggtgaagtttacactgaagatggtgttgagttcgtgagcgagtatggtgtagaggcttaccctttcacaccagagaggatcaacgaactgaaggagcaggaaaaagcagaaaaggataat

SEQ ID NO: 48002 - protein, 175 aa, Panicum virgatum
  misc_feature: Ceres CLONE 2040053
  misc_feature (17)..(142): Pfam Name: AhpC-TSA Pfam Description: AhpC/TSA family
MAETEPTTNGGSAGGGIGAILAAGDRDFLVRNSGEQVKISSIEASPVALYFSASWCPPCRRFTPKLIELYKELASQGKSFEVVFVSGDQDEEAFNSYFGKMPWLAVPFSDSEGREGLDGRFKVSGIPHLVILDAKTGEVYTEDGVEFVSEYGVEAYPFTPERINELKEQEKAEKD

SEQ ID NO: 48003 - DNA, 683 bp, Panicum virgatum
  misc_feature: Ceres CLONE 2040054
  misc_feature: Encodes the peptide sequence at SEQ ID NO. 48004
aagaaaaagaaaagaggatgaaaatgctttcaaaagtgggaagaggaggaaggcaacaaagtgggcatcacgcgctccattgcagagtcccagcttcctcctccttcccacaattctatcctcggtcggctcaccgccccggtgaccgccgccgcctttgacgcctgcctccgccgccgtctcgcaccaaaactgcgtagcgcttgtctttgctgagctgcttgcgcgcggagctctggctacttgacttcgggtttgttccccatctgaggccaagattcggagcgtcgccgagggaaggcgatgaaggggaagggcggcgcgatggacaggaggtcctccaccaggtggaggatgctggtgctctgcgcattcagcttcggcctcggcatgctcttcacggaccggttctggacagcaccagataccaacaaccatatcatgtctcaacgccggaggcaagatcaagagctgcagctcgtatcagaggattgcaatacaaagaggaagcgtggggaagacaaggatataatgggagaggtaaccaagacccatgaagctatacaatcattggataagtccatctcaactctgcagatggagcttgcagcaaagaggagcacactggagctgctccgttctagtggttcgcctgtaacctctgaaattagccaaccaaggaa

SEQ ID NO: 48004 - protein, 126 aa, Panicum virgatum
  misc_feature: Ceres CLONE 2040054
  misc_feature: Functional homolog of the protein sequence given in SEQ ID NO 51007
  misc_feature: Useful for making plants with altered carbohydrate content
MKGKGGAMDRRSSTRWRMLVLCAFSFGLGMLFTDRFWTAPDTNNHIMSQRRRQDQELQLVSEDCNTKRKRGEDKDIMGEVTKTHEAIQSLDKSISTLQMELAAKRSTLELLRSSGSPVTSEISQPR

SEQ ID NO: 48005 - DNA, 704 bp, Panicum virgatum
  misc_feature: Ceres CLONE 2040066
  misc_feature: Encodes the peptide sequence at SEQ ID NO. 48006
acgtccgcaccgctcgctgcctttcgtcaactccactcctcccctcttctacgccgcgtccacctcctcttcggcgcgccgccgccgtcgcagcagccatggatgaggagtacgacgtgatcgtgctgggcacggggctcaaggagtgcatcctcagcgggctcctctccgtcgacggcctcaaggtgttgcacatggatagaaatgactactatggaggagattccacctcactcaaccttaaccagctgtggaagaggtttagaggggaagacaagcctccggcacatctaggtgcaagcagagactacaatgtggacatggtcccaaaggtgcaacagtcttatcctatgcagatatttctttctccacctttattagcacagctaatgtatgcagaaatgcatttgggattacataaatataacaccaatgaccaaccccatgatcgtgtattggttctatcttggcgggaaagatttgtactcttcgtatgtgatttgtgtgaaattttcgcagatttaggcattcagagaactgaaaataccttgccgaactgcttgaaaaaaaagaagtctgcaaagcattcctgctagatttatgacttgattgttaatattttatactagtgtgtaccataattaatttatgttgcttccttgtaaaaaaactgtttctgttatcagtttatgatggcaaatggg

SEQ ID NO: 48006 - protein, 165 aa, Panicum virgatum
  misc_feature: Ceres CLONE 2040066
  misc_feature (1)..(164): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKVQQSYPMQIFLSPPLLAQLMYAEMHLGLHKYNTNDQPHDRVLVLSWRERFVLFVCDLCEIFADLGIQRTENTLPNCLKKKKSAKHSC

SEQ ID NO: 48007 - DNA, 721 bp, Panicum virgatum
  misc_feature: Ceres CLONE 2040086
  misc_feature: Encodes the peptide sequence at SEQ ID NO. 48008
aatatcttgttctctttcttattggtctcttgttctctttcttattgggcactcggccaagccaagcaagcgcccccttatctccagggtccacgggaggacgcagcaccaaggcaccgcccttccctcctcctcctctctcctcggaggttaagggacggtatttctgaccatggcaggaactttactccagtcagttgccctcggaacaacattcgcaggtcgcataagcaaccagcaatggaggtcccatggcgccaggaggcctgcctctatgttggcaatgtcgcttagccgccccgtcaagatgtcagcatttgttggcctaagatcagtacatagcttctcgatcacaccgacagtgtccaattccaggtcagcagttgcgtcttacagatcgtcacggcggacaaggcgttctcgttttgttactcgtgcgatgtttgagcggtttacagagaaagctattaaggtcatcatgcttgcgcaagaggaagcgaggcgcctgggtcacaattttgttggaaccgagcagattctcttgggtctgatcggagagggcactggtatcgcagcaaaggtgctcaagtccatgggtataaatctcaaggatgcacgtgtggaagtggaaaagatcattggacggggcaacggctttgttgctgttgaaataccattcacaccacgtgctaaacgtggtttgggagctctcattggaaga

SEQ ID NO: 48008 - protein, 182 aa, Panicum virgatum
  misc_feature: Ceres CLONE 2040086
  misc_feature (105)..(157): Pfam Name: Clp_N Pfam Description: Clp amino terminal domain
MAGTLLQSVALGTTFAGRISNQQWRSHGARRPASMLAMSLSRPVKMSAFVGLRSVHSFSITPTVSNSRSAVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRGLGALIG

SEQ ID NO: 48009 - DNA, 705 bp, Panicum virgatum
  misc_feature: Ceres CLONE 2040088
  misc_feature: Encodes the peptide sequence at SEQ ID NO. 48010
gggtctactcgtctcgacctgcagctacagctacagctacctttcttcggccccctcaaaatcctccaaccaatcccaccagcttctcggcgactcggctcaaatccgccccgaaacctcccaccgaccgcaccgtccgcccgggtcgtgcgcgatcggcagctgccccggcgctccggatcgagagaaaggaggccgctttggcggttctggcgggcgaatctagcggcgattcgctcagatttggatttagggttttggaggtggtagtgggcttgtgccgccgggagagatgtcggcggctgtggcgtgcgcggagagggcgaccaacgacatgctcatcggcccggactgggcggtcaacatcgagctctgcgacatcatcaacatggatcctggacaagcaaaagatacactcaagcttctaaagaaacgtcttggaagcaagaattcaaaagttcaaattctaacactttatgtgctggagacactaagcaaaaattgtggggatgttgttcaccaactgattgttgaacgcgacatattaagtgaaatggttaagatagtaaagaaaaagccagatttaaatgttcgggagaagatattgagtttgattgacacatggcaagtggcttttggaggtccttctggaagatatccccagtatcatgcagcttaccaagaactcagggctgctggtgttga

SEQ ID NO: 48010 - protein, 137 aa, Panicum virgatum
  misc_feature: Ceres CLONE 2040088
  misc_feature (2)..(136): Pfam Name: VHS Pfam Description: VHS domain
MSAAVACAERATNDMLIGPDWAVNIELCDIINMDPGQAKDTLKLLKKRLGSKNSKVQILTLYVLETLSKNCGDVVHQLIVERDILSEMVKIVKKKPDLNVREKILSLIDTWQVAFGGPSGRYPQYHAAYQELRAAGV

SEQ ID NO: 48011 - DNA, 686 bp, Panicum virgatum
  misc_feature: Ceres CLONE 2040102
  misc_feature: Encodes the peptide sequence at SEQ ID NO. 48012
aggatccaactagttacacagagaatgaatgccaagaactgctctggcggattcatgaggggaataggttgactggtggactgaaattcgtcacaaaatgctatggaatagttggttttgtaaagtttcttggtccttattacatggttgtaataaccaggagaaggaaagttggcacaatatgcggccatgagatctattccattggaaagagcgaaatgatcgcaattccaagtgttatagtctggcccaacgtggcttattctagggatgagaacagatataagcgcctactttgctcggttgatctttcgaaggatttcttcttcagctactcttacaacatcatgcgcagccttcagaagaacataaccgagaagaatactggacaggttgtttatgaaacaatgtttgtatggaatgagtttctgacacgggcagtccggaatcatctcaagaataccagttggactgttgccttagtccatggattttttaaacagtcgaagctctcagtatcagggaaggatttttggttgacacttatagctaggcgctcgcgccattttgctggaacgagattcttgaaacgaggtgttaatgaaaagggcagggtcgccaatgatgttgagactgaacagattgtttttgaagacacatctgatggaatcccaagtcacatggct

SEQ ID NO: 48012 - protein, 227 aa, Panicum virgatum
  misc_feature: Ceres CLONE 2040102
  misc_feature (33)..(227): Pfam Name: Syja_N Pfam Description: SacI homology domain
  misc_feature: SWISSPROT Homolog: EC 3.1.3.36 Phosphoinositide 5-phosphatase
DPTSYTENECQELLWRIHEGNRLTGGLKFVTKCYGIVGFVKFLGPYYMVVITRRRKVGTICGHEIYSIGKSEMIAIPSVIVWPNVAYSRDENRYKRLLCSVDLSKDFFFSYSYNIMRSLQKNITEKNTGQVVYETMFVWNEFLTRAVRNHLKNTSWTVALVHGFFKQSKLSVSGKDFWLTLIARRSRHFAGTRFLKRGVNEKGRVANDVETEQIVFEDTSDGIPSHM

SEQ ID NO: 48013 - DNA, 684 bp, Panicum virgatum
  misc_feature: Ceres CLONE 2040110
  misc_feature: Encodes the peptide sequence at SEQ ID NO. 48014
cttgcaaaagaaagatacagggactgggagcggaaatttggagaatttgccaaggtagttgagctcactggtgaaactgcagctgatttaaagcttctggataaaggggagatcataatcagtactcctgagaagtgggatgcactgtctcgcaggtggaaacagcgaaagcacattcaacaggtcagcttattcatagttgatgagctgcatctacttgggtctgacaagggacatgttttggaagtcattgtctctaggatgaggcgtatttcaagccatattggcagtaacatacggatcgtagcactttcagcatcacttgcaaatgctaaggatcttggtgaatggattggtgccacctctcatggtctctttaacttccctccagcagtgcgacctgtgccattggaaattcacattcaaggtgtggatatagcaaactttgaggcaaggatgcaagcaatgacaaagcctacatacactgccatcacacagcatgccaagagtggtaaacctgccctggtgtatgtaccaacaaggaagcatgcaaggttgactgcattggacttgtgtgcatactctagtgttgagggtggtggaacaccatttctccttgggtcagaagatgagatggatactttcaccagagggtgtgaggaagagacgctaaaaaatacactt

SEQ ID NO: 48014 - protein, 227 aa, Panicum virgatum
  misc_feature: Ceres CLONE 2040110
  misc_feature (1)..(114): Pfam Name: DEAD Pfam Description: DEAD/DEAH box helicase
LAKERYRDWERKFGEFAKVVELTGETAADLKLLDKGEIIISTPEKWDALSRRWKQRKHIQQVSLFIVDELHLLGSDKGHVLEVIVSRMRRISSHIGSNIRIVALSASLANAKDLGEWIGATSHGLFNFPPAVRPVPLEIHIQGVDIANFEARMQAMTKPTYTAITQHAKSGKPALVYVPTRKHARLTALDLCAYSSVEGGGTPFLLGSEDEMDTFTRGCEEETLKNT

SEQ ID NO: 48015 - DNA, 470 bp, Panicum virgatum
  misc_feature: Ceres CLONE 2040124
  misc_feature: Encodes the peptide sequence at SEQ ID NO. 48016
ctattacaccaaaagttgatgtttacagttttggtatggtattgttggaaatcatatcaggaaagaggaacacaccagaagtaaacagtaagagcagttatcatgttgcgtttttgccggtgcagggcatcagcaagcttcatgagggggatctacagagtttggtggatccacaattacatggtgacttcgacttagaagagtttgaaagggtttgcaaagttgcattttggtgtatccaagataatgaatgtgatcggccgacaatgggtgaagtagttcgtgttcttgagggtctccaggagattgatatgcccccaatgccaagactccttgcagctataacaaaacgctctgatgcagctttattgtaataattcatcttgcagtaggtatatatttttgttttagcaaatttgaaagttgtgctattgttgagctaaaggaataaaaggacaagcttgcaattt

SEQ ID NO: 48016 - protein, 123 aa, Panicum virgatum
  misc_feature: Ceres CLONE 2040124
  misc_feature: SWISSPROT Homolog: EC 2.7.11.1 Non-specific serine/threonine protein kinase
ITPKVDVYSFGMVLLEIISGKRNTPEVNSKSSYHVAFLPVQGISKLHEGDLQSLVDPQLHGDFDLEEFERVCKVAFWCIQDNECDRPTMGEVVRVLEGLQEIDMPPMPRLLAAITKRSDAALL

SEQ ID NO: 48017 - DNA, 702 bp, Panicum virgatum
  misc_feature: Ceres CLONE 2040143
  misc_feature: Encodes the peptide sequence at SEQ ID NO. 48018
cacacggcctcctcggtgagatggtcagattgaaggtccctgcattggaacaagctctgaatgggttagttcagtccctgagcagtaagaaccaatttgatgaagctttgctggtaatccagcatgctacctctgccaagctcaagctatcactctcagcttgcaatgccatgctgcgtggtctggttaagcaaaggagtggcctgcggttgttcatgcttgcgtacatggagattgtgaagtctggagtgcttcctgatgtggaaacactgaattggttaattcagtccttgtgtgaatcaggccgtgtagacctggcactgattcagtttgacaggatgagcaggaaaaggtgttctcctaacagtcatacttttgagatactcatcatagcgctttgttcccataacagagcagatgaagctgtggatctcttctataagatgctgcaactaagatgcacccctgatggtagtttttatgctcaggtgatacccctattttgcaagttcagtaaagtcaaggaggtgactaagttgcatcaaatgacgaaagaagatggccttcagttggatgtgcattcgtacagtgccctcattagatgtttatgtgagaatcaattattggatgatgcgctaatgatgcttaacaaaatggtagcatcaggtcatgctccaagggcaagtgcatatgtggacattg

SEQ ID NO: 48018 - protein, 233 aa, Panicum virgatum
  misc_feature: Ceres CLONE 2040143
  misc_feature (123)..(157): Pfam Name: PPR Pfam Description: PPR repeat
  misc_feature (193)..(227): Pfam Name: PPR Pfam Description: PPR repeat
  misc_feature (88)..(122): Pfam Name: PPR Pfam Description: PPR repeat
HGLLGEMVRLKVPALEQALNGLVQSLSSKNQFDEALLVIQHATSAKLKLSLSACNAMLRGLVKQRSGLRLFMLAYMEIVKSGVLPDVETLNWLIQSLCESGRVDLALIQFDRMSRKRCSPNSHTFEILIIALCSHNRADEAVDLFYKMLQLRCTPDGSFYAQVIPLFCKFSKVKEVTKLHQMTKEDGLQLDVHSYSALIRCLCENQLLDDALMMLNKMVASGHAPRASAYVDI

SEQ ID NO: 48019 - DNA, 608 bp, Panicum virgatum
  misc_feature: Ceres CLONE 2040149
  misc_feature: Encodes the peptide sequence at SEQ ID NO. 48020
taaccatactccagcagctcaaaacctctagcctgctaccaagaaatgggtctggttgcttctcccctgataaatcacactggccatcctcctggcctaaaaaaccacataagaaccaatggtggcaatttgtcatggcaccaaaaaaataaaaaaaagggtgaacttaataatgttaaatcactaccctggaacggccaacctgtaaaatatttgaacccttcaaaaatcccaaggaaggaatggttcaaccaccaattcctctttggctcccccacttcaacataccaaattgaaagggcttggaatgaacatggcaaggggcccagcacttgggaacacttctgccacacttatcctgaaaagaaaattgaaggaaacaatggggatgttgcaatgaactcctaccatatgtatgaagaagaagtcaagttgcttaaacaaatgggcatggacccctataggttctccatctcttggtccaaaatactgccaaaagggacgctccaaagtgggataaactattatggccttcaatactaccgaaacctgatcaacacgttgaaagaaaatggcatagaaccatatgtaaccattttccactggga

SEQ ID NO: 48020 - protein, 187 aa, Panicum virgatum
  misc_feature: Ceres CLONE 2040149
  misc_feature (64)..(187): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51342
  misc_feature: Useful for making plants with altered cell wall content and/or composition
MGLVASPLINHTGHPPGLKNHIRTNGGNLSWHQKNKKKGELNNVKSLPWNGQPVKYLNPSKIPRKEWFNHQFLFGSPTSTYQIERAWNEHGKGPSTWEHFCHTYPEKKIEGNNGDVAMNSYHMYEEEVKLLKQMGMDPYRFSISWSKILPKGTLQSGINYYGLQYYRNLINTLKENGIEPYVTIFHW

SEQ ID NO: 48021 - DNA, 710 bp, Panicum virgatum
  misc_feature: Ceres CLONE 2040167
  misc_feature: Encodes the peptide sequence at SEQ ID NO. 48022
aaacgcagtggcgccgtgccgcactgcctgctgccatctcccaccataactctcacccgccccgcacgcctgcctgtctgtcggtccctcccgctctgctccgcacactcggtgcaggtgcagcgtcgtcccctgctctgctccccaccccaccccacccagcgcccgcattgccgccggtgagcggagggccgcggcggcgcgggggaggaaccaggaggaggagggacgggaagagaggcggcaggatgttcgggcgggacccgtggggcgggccgctggagatctccaacgccgactcggcgacggacgacgaccggagccgggacctggaccgggcggcgctgacgcggcagctcgacgagacgcagcagagctggctcctcgccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcgtcatgatgatcgtcaagctcgtaccgcacaagcgcccgccgccgccgccgcccgaccagtacacgcaggcgctgcacaaggcgctcatgttcttcaacgcccagcgatctggtccgctgcccaagcacaacggcgtcagctggaggggcaattcctgcatgaaggatggtctctcggacagcaccgtccggcgg

SEQ ID NO: 48022 - protein, 153 aa, Panicum virgatum
  misc_feature: Ceres CLONE 2040167
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MFGRDPWGGPLEISNADSATDDDRSRDLDRAALTRQLDETQQSWLLAGPGDQAGKKKKKYVDLGCVVLDRKIFMWTVGTILGLGVFIGFVMMIVKLVPHKRPPPPPPDQYTQALHKALMFFNAQRSGPLPKHNGVSWRGNSCMKDGLSDSTVR

SEQ ID NO: 48023 - DNA, 654 bp, Panicum virgatum
  misc_feature: Ceres CLONE 2040223
  misc_feature: Encodes the peptide sequence at SEQ ID NO. 48024
aatacactcatgttaatcttgtataaaagtccgccacggatacaataaggcacacaacatcagagcaagccggcagccatgggaagcttgaagctatccttgttctgcattgtaattcccatcgttctccttgcttcaatcgttgccgaggagctgccggccggcgacaacgacgatgagctccgaacgttcatagtgcacgtgcagccgtccgagaaccacgtgttcggcacggccgacgaccgggcggcgtggtacaggtcgttcctcccggaggacggccggctcctccacgcgtatcaccacgtcgccagcggcttcgccgcccggctgacgcgccgggagctcgacgccatgtccgccgccccagggttcctctcggcggagccgaacgaggtctaccagctgctgacgacgcacacgcctgggttcctcggactggacgtgccgcagggcgtgagcgcaagaaaccatagtgtttccgggtttggcgacggcgtcatcatcggcgtgctcgacaccggcgtcttcccctaccacgcatcgttcagcggcgacggcatgccgccgccgccgccgaggtggaaggggcgctgcgacttcaacggctcggcgtgcaacaacaagctcatcggcgcgcggtccttcgagtcc

SEQ ID NO: 48024 - protein, 191 aa, Panicum virgatum
  misc_feature: Ceres CLONE 2040223
  misc_feature (36)..(111): Pfam Name: Subtilisin_N Pfam Description: Subtilisin N-terminal Region
  misc_feature: SWISSPROT Homolog: EC 3.4.21.25 Cucumisin
MGSLKLSLFCIVIPIVLLASIVAEELPAGDNDDELRTFIVHVQPSENHVFGTADDRAAWYRSFLPEDGRLLHAYHHVASGFAARLTRRELDAMSAAPGFLSAEPNEVYQLLTTHTPGFLGLDVPQGVSARNHSVSGFGDGVIIGVLDTGVFPYHASFSGDGMPPPPPRWKGRCDFNGSACNNKLIGARSFE

SEQ ID NO: 48025 - DNA, 700 bp, Panicum virgatum
  misc_feature: Ceres CLONE 2040224
  misc_feature: Encodes the peptide sequence at SEQ ID NO. 48026
ctatgcttcatttgataagtatgttgaagtggagcgtctggaaggtgacaacaagtatcatgccgaacagcatggccttcaggatgcaaagaaaggagttcttttcattgacttccctcctgttttacaacttcagctaaaacgttttgaatatgatttcatgcgtgatacaatggtgaagattaacgatcggtacgagttcccacttcagttggatcttgatagagataatggaaaatatttatcacctgatgctgacaggaatgtgcggaatctttacacccttcacagtgttcttgtccatagtggtggtgttcatggtggacattattatgctttcatacgacctactctttctgatcaatggttcaagtttgatgatgagcgtgtaacaaaggaagatgcaaagaaggcactggaagaacaatatggcggtgaggaggagctacctcagacaaatcctggcttaaacaacactcctttcaagtttaccaaatattcaaatgcatatatgcttgtgtacatccgtgaaagtgacaaggacaaaattatttgtaatgtggatgagaaagacatagcagagcatcttcgtattagattggaaaaagaccgtgaagagaaggagcgcaggaaaaaagagaaagctgaggcacacctctataccatcatcaaggttgcgagggatgatgacttgaaagct

SEQ ID NO: 48026 - protein, 232 aa, Panicum virgatum
  misc_feature: Ceres CLONE 2040224
  misc_feature (9)..(174): Pfam Name: UCH Pfam Description: Ubiquitin carboxyl-terminal hydrolase
  misc_feature: SWISSPROT Homolog: EC 3.1.2.15 Ubiquitin thiolesterase
YASFDKYVEVERLEGDNKYHAEQHGLQDAKKGVLFIDFPPVLQLQLKRFEYDFMRDTMVKINDRYEFPLQLDLDRDNGKYLSPDADRNVRNLYTLHSVLVHSGGVHGGHYYAFIRPTLSDQWFKFDDERVTKEDAKKALEEQYGGEEELPQTNPGLNNTPFKFTKYSNAYMLVYIRESDKDKIICNVDEKDIAEHLRIRLEKDREEKERRKKEKAEAHLYTIIKVARDDDLK

SEQ ID NO: 48027 - DNA, 697 bp, Panicum virgatum
  misc_feature: Ceres CLONE 2040249
  misc_feature: Encodes the peptide sequence at SEQ ID NO. 48028
agcgccctcgtgcctcgccaccacctccccaaccgtgaattgattcgaaacgaacacccagcaagcagctcgagctgcgtcgccattgcaggctttcagctgagccgagcacttctctctctctctctctctctctctctctcagacacagagggaaaacaggagaggaaaacggcaggtgcgtgaaacccaatccggcgcatccccgcctccattaataggggggatgcgtgtcgcggctacctcagcgacgcgagctgcctaggtgcctcgctcctcctcctccttctcctgcgccagctagctgcgctggccactcagtggagactggagagaggagccgccagcagctagtaggagacaggaggagacagaggggagtgggcggagcagctagagatagcgtcgtcgtggagatggacggcggcggcggggaggcgtggcgcggggcggtgtcgccggcggcgcgctacgcggagtccggcggcgccagcctgacgtgggagaacctcacggcggtgctgccgggcggcggtggccgagccaccaagaagctggtgcaggggctgtacggctacgccgtgcccggccgcgtcgtcgccatcatggggccgtccggctccggcaagtccacgctcctcgactcgctctccgggaggctggccaggaacgtggtcctcaccgggaaggtgctgct

SEQ ID NO: 48028 - protein, 93 aa, Panicum virgatum
  misc_feature: Ceres CLONE 2040249
  misc_feature (42)..(80): SWISSPROT Homolog: EC 3.6.3.28 Phosphonate-transporting ATPase
  misc_feature (56)..(91): SWISSPROT Homolog: EC 3.6.3.25 Sulfate-transporting ATPase
MDGGGGEAWRGAVSPAARYAESGGASLTWENLTAVLPGGGGRATKKLVQGLYGYAVPGRVVAIMGPSGSGKSTLLDSLSGRLARNVVLTGKVL

SEQ ID NO: 48029 - DNA, 621 bp, Panicum virgatum
  misc_feature: Ceres CLONE 2040257
  misc_feature: Encodes the peptide sequence at SEQ ID NO. 48030
acgtggtgagctgttcttccgctctctcccccttcccttctctctcttgtgtctgtgcgcgcgacatatgttggctggccggccgcggtggtggtcgtcttccggctattaaggccgttcttgatgagttggtgagggaggaggaggaggagagctcgggtcgtcgctgcgtgcaggggttgtgtgaaggagagccggagagggggggcgtggtggtgcttggccgggccaatggcgccgtcgtggtgggggaaggacgcgagggccaatggcggcggcggcgggacgccggtggtggtgaagatggagaaccccaactggtccatctccgaggtctccgcgtcggaggtggcgccgggctcgccggcgggcggcggcgggggcaaggccgggcggggcaagaacgcgcgccagatcacgtgggtgctgctcctcaaggcgcaccgcgccgcgggccgcctcacgggggcggcctccgccgcgctcgccgtcgcggccgccgcgcgccggagggtggcggcggggcggaccgactcctacgcctcgccgggggagaacaccgcgctgcgcacgcgcatctacggctgcatccgggtgttcctcgtgctgtccctgctgcct

SEQ ID NO: 48030 - protein, 129 aa, Panicum virgatum
  misc_feature: Ceres CLONE 2040257
  misc_feature: Functional homolog of the protein sequence given in SEQ ID NO 51744
  misc_feature: Useful for making plants with altered carbohydrate content
MAPSWWGKDARANGGGGGTPVVVKMENPNWSISEVSASEVAPGSPAGGGGGKAGRGKNARQITWVLLLKAHRAAGRLTGAASAALAVAAAARRRVAAGRTDSYASPGENTALRTRIYGCIRVFLVLSLL

SEQ ID NO: 48031 - DNA, 526 bp, Panicum virgatum
  misc_feature: Ceres CLONE 2040259
  misc_feature: Encodes the peptide sequence at SEQ ID NO. 48032
gtactccggatcagcgtcattgcgggtatcgatcgggtggaggaggcgattgcacactaacttttgccttgcctctcctctccccctaaacaacttcctctatctctctctctctctctctctctctcgcacagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataaca

SEQ ID NO: 48032 - protein, 130 aa, Panicum virgatum
  misc_feature: Ceres CLONE 2040259
  misc_feature: SWISSPROT Homolog: EC 3.5.2.6 Beta-lactamase
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDN

SEQ ID NO: 48033 - DNA, 659 bp, Panicum virgatum
  misc_feature: Ceres CLONE 2040271
  misc_feature: Encodes the peptide sequence at SEQ ID NO. 48034
acaaccagctccttttggctacacttgttgggtgcatcgttctaatcagttcattggttttggcattccttttgagtcgatcaacgcctcttgctgtccaaatactaacgaccaaaattcaggaagcagaaaacgatgatggatggacgtctccttgatgctgccacaaccggtgacgcggtgacaatgaaacacttggccctgcacgacccgggcgtgctgcttggaacaaccccgcaggggaacacctgcctccacatctcctccacccatggccaccaggggttctgcatggatgccgtggccctgaaccggtctctcctctccgctatcaacgcagatggggagacgccactcaccgcagcgacgagtggccacaccagcttagcttcgttgcttctcaagtggtgccgtgatctccagctgagcgagtcaatcttgaagcaagacaacaaagggtacaatgtgctgcaccacgccatcagaagcggccacagggagctcgcactggagctgatagcagcagagcctgccttgtcggaggctgtgaacaacaaagacgagtctcccatgtacatggcagtcatgagaaactatgaggatgtctttgagaaattattggagattccgggctctgctcatggaggagccgggaacca

SEQ ID NO: 48034 - protein, 174 aa, Panicum virgatum
  misc_feature: Ceres CLONE 2040271
  misc_feature: SWISSPROT Homolog: EC 2.7.11.1 Non-specific serine/threonine protein kinase
MMDGRLLDAATTGDAVTMKHLALHDPGVLLGTTPQGNTCLHISSTHGHQGFCMDAVALNRSLLSAINADGETPLTAATSGHTSLASLLLKWCRDLQLSESILKQDNKGYNVLHHAIRSGHRELALELIAAEPALSEAVNNKDESPMYMAVMRNYEDVFEKLLEIPGSAHGGAGN

SEQ ID NO: 48035 - DNA, 689 bp, Panicum virgatum
  misc_feature: Ceres CLONE 2040278
  misc_feature: Encodes the peptide sequence at SEQ ID NO. 48036
ccagatgagctacttgaatgaaccttcagttcttcacaatctgcaattgcgatattctcgtgatcttatttatacaaaagcaggacctgttttgattgctgttaatccattaaaagagattccactgtatggaaaagcttcaatgttgcagtacaagcaaaagaccaaggatgatcctcatgtgtatgcagttgccgatttagcttttaatgagatgctacaagatggcataaaccaatccataataataagtggtgaaagcggagcaggaaaaactgagacggctaaaattgcaatgcaatatttggctgctctagggggtgctagtgggatggaatctgaggttcttcagaccaatgttattctggaagcattgggaaatgcaaaaacatcacgaaaccataactcaagtcgatttggcaaacttattgaaatacacttttctgaaactgggaagatgtgtggtgctaaaattcagaccttcctgcttgaaaagtcaagggtggttcaaagggcacaaggagagagatcttaccatattttctatcaactgtgctctggagctcctcaccttctaaaaaaaaaattgtctctgaaaagtgccaatgactacacttatttgaagcagagtaattgcttgagatttgacggtgtcgatgattctaaaattttcactgtgttagtggatg

SEQ ID NO: 48036 - protein, 229 aa, Panicum virgatum
  misc_feature: Ceres CLONE 2040278
  misc_feature (1)..(229): Pfam Name: Myosin_head Pfam Description: Myosin head (motor domain)
  misc_feature: SWISSPROT Homolog: EC 2.7.11.1 Non-specific serine/threonine protein kinase
QMSYLNEPSVLHNLQLRYSRDLIYTKAGPVLIAVNPLKEIPLYGKASMLQYKQKTKDDPHVYAVADLAFNEMLQDGINQSIIISGESGAGKTETAKIAMQYLAALGGASGMESEVLQTNVILEALGNAKTSRNHNSSRFGKLIEIHFSETGKMCGAKIQTFLLEKSRVVQRAQGERSYHIFYQLCSGAPHLLKKKLSLKSANDYTYLKQSNCLRFDGVDDSKIFTVLVD

SEQ ID NO: 48037 - DNA, 725 bp, Panicum virgatum
  misc_feature: Ceres CLONE 2040287
  misc_feature: Encodes the peptide sequence at SEQ ID NO. 48038
aacacgacacgccaaaccaaaaccacataggacgccaggagctccgcgtcccaaattttttctgcaaagagcaagccaaagaggagttcgttcccggaatctctcgctcgcgtgcgcgggatttgatccccaaccacccaagtctctcgccctctctctttctccggcggttggttccttcgatcccaaatcgtgatccactcgatggcggccaccgccggcggcaacaagatccgcaacgccaagctggttcttctcggggatgtgggcgccggcaagtccagcctggttctccggtttgtgaaaggccagttcgtcgaattccaggaatcgaccatcggggcagctttcttctcgcagaccttggcagtgaacgatgagacagtgaagtttgagatatgggacacggcagggcaggagaggtatcacagcttggctcccatgtattaccggggtgctgctgctgcgatagttgtctacgacatcaccaatgcggttagtacaatgcagacatacttgagctagtaatgtctcgatagttgtctacgatagttgtcagccgtgatgataatttctcgatgttatgatctactcggtcatgcttggcaattgctaaaattaacaggtgcaacttgtgtcacaacaaatgactgtagaattactggcacaattattgctgatgcaattactagtagctctgaatagcaaactgcattgtctttctt

SEQ ID NO: 48038 - protein, 106 aa, Panicum virgatum
  misc_feature: Ceres CLONE 2040287
  misc_feature (14)..(106): Pfam Name: Ras Pfam Description: Ras family
  misc_feature: SWISSPROT Homolog: EC 2.7.11.1 Non-specific serine/threonine protein kinase
  misc_feature: Functional homolog of the protein sequence given in SEQ ID NO 50162
  misc_feature: Useful for making plants with altered lignin content
MAATAGGNKIRNAKLVLLGDVGAGKSSLVLRFVKGQFVEFQESTIGAAFFSQTLAVNDETVKFEIWDTAGQERYHSLAPMYYRGAAAAIVVYDITNAVSTMQTYLS

SEQ ID NO: 48039 - DNA, 676 bp, Panicum virgatum
  misc_feature: Ceres CLONE 2040293
  misc_feature: Encodes the peptide sequence at SEQ ID NO. 48040
gacatcgtcagagtgaacgcgtctctccgggcacgacctgccggcgccgccgtacgcccctcccggcgcggcctactctcgccggctccttcgtcgcctactcctccgcagcattagcggcgattaattagcagagaagggcgagaatgcagccgccgccgcagtcgcagggagcaatggccaccggcgctgccaccctcaccgttccgtgctccatgggccgccgcccgaagcggagcagccagcgccgcggctccggctcagcctccctctccgtccgtgcgtcctcggacgcaaacacggtgacgctgctggactacggcgcggggaacgtgcgcagcgtgcgcaacgccatccgccacctcggcttcggcatccgcgacgtgcggagcccggaggacatcctcgccgccgaccgcctcgttttccctggcgtcggcgccttcggctccgccatggacgtcctcaatggcactggcatggctgacgcgctccgcgagtacatccaaaaggaccgccccttcctaggcatctgcctcggcctccagctgctcttcgactccagcgaggagaacggcccggtgagcggccttggtgtgataccgggcgtggtcaggcgattcgactcctccaagggcctcatagttcctcacattggctggaacgctcttgagat

SEQ ID NO: 48040 - protein, 166 aa, Panicum virgatum
  misc_feature: Ceres CLONE 2040293
  misc_feature (44)..(162): Pfam Name: GATase Pfam Description: Glutamine amidotransferase class-I
  misc_feature: SWISSPROT Homolog: EC 6.3.5.2 GMP synthase (glutamine-hydrolyzing)
MATGAATLTVPCSMGRRPKRSSQRRGSGSASLSVRASSDANTVTLLDYGAGNVRSVRNAIRHLGFGIRDVRSPEDILAADRLVFPGVGAFGSAMDVLNGTGMADALREYIQKDRPFLGICLGLQLLFDSSEENGPVSGLGVIPGVVRRFDSSKGLIVPHIGWNALE

SEQ ID NO: 48041 - DNA, 650 bp, Panicum virgatum
  misc_feature: Ceres CLONE 2040305
  misc_feature: Encodes the peptide sequence at SEQ ID NO. 48042
aaagctcatctccaggaggcccctcgccgccgcgctccacctctcgcgccactcgccgcccttgatcctcctcttcacgtcagcgtcatcatcgagctcgaccgaagacaccacataagcctccgggcccagaggttgtagtgctgacaggatagacagaggagcagtggaatccactggggaagtatggtcaacaccttcggcagaaccgagaaacatttctatcgggaaggagatattctgcaataggtcactcaacatgaggaacatcacagcagtaggatttgatatggactacactcttgcacagaacaagcccgagaccttcgaggcccttgcttactatggtacaatcgagaagcttgtgaaggatctgcactaccctgaagagctgctgactagggagtttgattggaaatacatggtcagaggattagttctagataagaagagaagaaataattagaagatggaccgacacaagtatgtaaaagttgcataccatggttttagggaattgtcgaaagaagaaaaagttgctgcttatgggagtacatagataagagactcatttgatgaacctgattatgcccttatagatacgcttttctcattgggagaagcttatctatttgctcaacttgttgatt

SEQ ID NO: 48042 - protein, 68 aa, Panicum virgatum
  misc_feature: Ceres CLONE 2040305
  misc_feature: SWISSPROT Homolog: EC 3.1.3.5 5'-nucleotidase
MRNITAVGFDMDYTLAQNKPETFEALAYYGTIEKLVKDLHYPEELLTREFDWKYMVRGLVLDKKRRNN

SEQ ID NO: 48043 - DNA, 695 bp, Panicum virgatum
  misc_feature: Ceres CLONE 2040329
  misc_feature: Encodes the peptide sequence at SEQ ID NO. 48044
agcggctcccagtgccaggtccgatttgcttgctcgtcgctctacctcagcttgttcgatgatgcgactttggtttttgagcacctttttgtgtgaagttttgatttatttctctgtttgctggatttagggactgcgaggacgactccgctgccggaccggaaggcgctggagatgattctagagaagctgcaaaaaaaggatacatacggagtgtttgctgagccagtggatccggaggagttgcctgattatcatgatgtgatagagcacccaatggacttcggtaccgtcaggaggaagcttgccaggaatgcataccgctcattcgagcaatttgaggatgatgtcttcttaatttgcagtaatgcaatgcagtacaatgcacctgatacaatttacttcagacaggcccattccatacaagagctggcaagaaagaagtttcaggaactaagggatgagggcatacctatagaaaaccaccacataaagattgaacagaaagccagaccaaactcctgcaatagagaaccagtcaaaaagcccgtcttgcggtatcaggatgatgatctagacttcctgtcccgcaaagagcaagttaagagacccaatccaaaaaatttggaaggtgatattatctttaaagatcaagttaagaaacctggggttgggacacaggatgagagttcttt

SEQ ID NO: 48044 - protein, 173 aa, Panicum virgatum
  misc_feature: Ceres CLONE 2040329
  misc_feature (2)..(82): Pfam Name: Bromodomain Pfam Description: Bromodomain
  misc_feature: SWISSPROT Homolog: EC 2.3.1.48 Histone acetyltransferase
MILEKLQKKDTYGVFAEPVDPEELPDYHDVIEHPMDFGTVRRKLARNAYRSFEQFEDDVFLICSNAMQYNAPDTIYFRQAHSIQELARKKFQELRDEGIPIENHHIKIEQKARPNSCNREPVKKPVLRYQDDDLDFLSRKEQVKRPNPKNLEGDIIFKDQVKKPGVGTQDESS

SEQ ID NO: 48045 - DNA, 692 bp, Panicum virgatum
  misc_feature: Ceres CLONE 2040342
  misc_feature: Encodes the peptide sequence at SEQ ID NO. 48046
accgaagtctactgccattcctacccctcctagcccgcgtcgccacgaggtcgccgcgccggcgaaggaggggaggggcgacctcgccggagaagaggccatgggcccgccgcagccagccaggggcggccctatcaacatcgaggcgtgcgcgcggccgatcgccgtcgacaaccgcatctccctcccctactacttccgcatcgcgggcagcctcctccgaccggctaatatatatcggaacgagaaaaacatcctcgacctgtatgtaatcctgctgagatactcgagtttgttgtgcgagacgataccgaagcatcgcgatttccatgccttcaagttgagagaaaaggcgttttttgataaacttagtgatgttatcaaagagcttgagtcattgaagccagttgtgcagcggcaggttgccgagcataacagaggaggtactgtggaatctaatactaatagtctaaatggaacctatgctacaactcataggatagagcagcataccccaagcttgtatactccacagacatttgtacgtagcgctaatggagcactgcaaaagtccttccaaattgggagacaagtgccatcattacccagtgtccaacaagataggcagatgcataaacaatttatgaacctgccttatccaagtgaagaaacactagctagacattccatat

SEQ ID NO: 48046 - protein, 197 aa, Panicum virgatum
  misc_feature: Ceres CLONE 2040342
  misc_feature: SWISSPROT Homolog: EC 3.1.2.15 Ubiquitin thiolesterase
MGPPQPARGGPINIEACARPIAVDNRISLPYYFRIAGSLLRPANIYRNEKNILDLYVILLRYSSLLCETIPKHRDFHAFKLREKAFFDKLSDVIKELESLKPVVQRQVAEHNRGGTVESNTNSLNGTYATTHRIEQHTPSLYTPQTFVRSANGALQKSFQIGRQVPSLPSVQQDRQMHKQFMNLPYPSEETLARHSI

SEQ ID NO: 48047 - DNA, 710 bp, Panicum virgatum
  misc_feature: Ceres CLONE 2040346
  misc_feature: Encodes the peptide sequence at SEQ ID NO. 48048
caaccgcatcagataaagttttgaaagcaaaatccttgagagttcttgagcatgcacctgatgatgaagtagaaggagagatggtatacctacaagctaggctgcttgacaatgctgttgttctgaagcacagatacgaaaaattgatagcaaaggttgtacagaatctttctcgtgagctggatgcattcagcagaagaaaatgggaccttatttttgtgaatcagtttctccgtgatgttagagaagctaagaaacgtgggagaaaagaaaagagacataaggaagcccaagctgtactagctgcagctgcagctgctgttgcatcctcttcacgaaattcatccatgagaaaagatgcaaaggaagatgcagcacctgctaatcaagagagttctccaaaacttgttgctggatcttcaagagttgggcaacggactaaagatacattaaagtcatccaacagcaaagtaccaccagataacaaatttggcagttttcatatgccaatctcctcaaatgaaaatgcactccattgtgatgtatgcatgcgaactgagactgtcttgaaccgaatatttatctgctccagatgcaaggctgctgtgcacatagattgctacagaagtgtggagaattctattggcccctggaaatgtgaactttgcgaagatcaagatatttcttttagaacctcaaccgctagtgat

SEQ ID NO: 48048 - protein, 235 aa, Panicum virgatum
  misc_feature: Ceres CLONE 2040346
  misc_feature (178)..(225): Pfam Name: PHD Pfam Description: PHD-finger
  misc_feature: SWISSPROT Homolog: EC 2.1.1.43 Histone-lysine N-methyltransferase
TASDKVLKAKSLRVLEHAPDDEVEGEMVYLQARLLDNAVVLKHRYEKLIAKVVQNLSRELDAFSRRKWDLIFVNQFLRDVREAKKRGRKEKRHKEAQAVLAAAAAAVASSSRNSSMRKDAKEDAAPANQESSPKLVAGSSRVGQRTKDTLKSSNSKVPPDNKFGSFHMPISSNENALHCDVCMRTETVLNRIFICSRCKAAVHIDCYRSVENSIGPWKCELCEDQDISFRTSTAS

SEQ ID NO: 48049 - DNA, 638 bp, Panicum virgatum
  misc_feature: Ceres CLONE 2040358
  misc_feature: Encodes the peptide sequence at SEQ ID NO. 48050
tcccggagcgcctgcctgcctgcctcgttaagcaacggccgggcaccactgcagcaccctgcatgagccgggggcgtcgtccgcgactggtaggacttcaagtgagaccaccactacgctcctccaccactccactccactccacttcactcgtgggtgagagaggaggaggacttcggaggtcccgaggcctgcttcttccttgtttgggaggttgctgcttgttttatcttaaaatgggctctcatgatggtgagggtgatgagttgccacccccccctccggtgccaccaaatgtggtgcccattaaagctgatgatgttttgggtgaaggtgaatcaccaccaaacaaaccatcaaagcctaagaaactaccaatggccaggcctggtgtaggacgaaaagggcaagcaatccagctctattcaaatcactttaaagtctcggtgaagaatactgaagagtttttctttcactatgatgtgaagttgaagtatgaggatgatcaacccgttgatgggaaagtggtaggcagaaaggtgattgataaactgcagcagacatatcactctgagctttctaacaaggactttgcatatgatggagaaaagagcctgtctacagttggtgctcttcca

SEQ ID NO: 48050 - protein, 133 aa, Panicum virgatum
  misc_feature: Ceres CLONE 2040358
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
MGSHDGEGDELPPPPPVPPNVVPIKADDVLGEGESPPNKPSKPKKLPMARPGVGRKGQAIQLYSNHFKVSVKNTEEFFFHYDVKLKYEDDQPVDGKVVGRKVIDKLQQTYHSELSNKDFAYDGEKSLSTVGAL

SEQ ID NO: 48051 - DNA, 708 bp, Panicum virgatum
  misc_feature: Ceres CLONE 2040373
  misc_feature: Encodes the peptide sequence at SEQ ID NO. 48052
gttcggcgttttgctgccacagcaacgccgccgccgccgcttctcgctctcctctctcgccgccatacacctcccccgctccgctcctttccttctccgctctacttctcagatccagcgcggcgatttctcctcttcctagcccggctcccccggcccccttgtgctagtttggttggattcagggggctaggttttagattcagagacatggcggaagtggaggactacgagatcattagggagggtgaggccgagatcctccagctcaaggaaaaagccgccttcttcaatcccgtgcaggttcacaacagagacatgtccattgctgttttaagggcctttgttgccaagcgcaaggaagaacatgaagcgctggcgaataagaggaataaatcgcatcaagaaaacaaacagagtgaaacatctgttcagaatggagaggatgcttcaactagccagcttgatgaaatggatgttgttcctgaaaaggatctaaatcaagctcaagcaacaaaaacaccttcctggaaagtaaccagagaacttaagccaccacttgttcttgaggctttggctgcttctgggttgagatctctccggtatgcccgtgaagttgatggcttaggaaaggtagttgctctggacaatgataaagcttctgtcgattgttgcaagcggaatataaagttcaatggtgtttcctct

SEQ ID NO: 48052 - protein, 165 aa, Panicum virgatum
  misc_feature: Ceres CLONE 2040373
  misc_feature: SWISSPROT Homolog: EC 2.1.1.32 tRNA (guanine-N(2)-)-methyltransferase
MAEVEDYEIIREGEAEILQLKEKAAFFNPVQVHNRDMSIAVLRAFVAKRKEEHEALANKRNKSHQENKQSETSVQNGEDASTSQLDEMDVVPEKDLNQAQATKTPSWKVTRELKPPLVLEALAASGLRSLRYAREVDGLGKVVALDNDKASVDCCKRNIKFNGVS

SEQ ID NO: 48053 - DNA, 669 bp, Panicum virgatum
  misc_feature: Ceres CLONE 2040390
  misc_feature: Encodes the peptide sequence at SEQ ID NO. 48054
agagtgccgacgggaagcttcgatccctgagcagagttcaagcaggaggaggaggaggaggaggaggagatgaacgtcgacttcggcgcgcccaaggagctcgcggggggcctgcagcagcgcagggccctctaccagccccgcctcccgccgtgcctccagggcccgacggtgcgggcggagtacggcgacgcgaccaccaccatcgaccccagctgcgccaacgtcgtgtggggcctgcatgacgctctcaaagcctacaatcctcagagcgtgctctacggatttgttggtggcactgaggggctgtttgcaaacaaggcattggagatcactgacgatgttcttatttcctacaagaaccagggtggtttcgatttgctcggcaggagtatcgatcagatccgcacaactaagcaagtcaactctgcaatggcaacatgccgcagtctgaacttggatgggctggtcatcattggaggtgtgacctccaattcagatgctgcacagcttgcagagatccttatccaaaataactgtaagaccaaggttgttggtgtgccggtttcattgaatggtgatctcaagaaccagtttgttgaaacaaccgttggatttgatacagtttgcaaggtaaattcacagcttgtaagcaatgtttgcctcgat

SEQ ID NO: 48054 - protein, 199 aa, Panicum virgatum
  misc_feature: Ceres CLONE 2040390
  misc_feature: SWISSPROT Homolog: EC 2.7.1.90 Diphosphate--fructose-6-phosphate 1-phosphotransferase
MNVDFGAPKELAGGLQQRRALYQPRLPPCLQGPTVRAEYGDATTTIDPSCANVVWGLHDALKAYNPQSVLYGFVGGTEGLFANKALEITDDVLISYKNQGGFDLLGRSIDQIRTTKQVNSAMATCRSLNLDGLVIIGGVTSNSDAAQLAEILIQNNCKTKVVGVPVSLNGDLKNQFVETTVGFDTVCKVNSQLVSNVCL

SEQ ID NO: 48055 - DNA, 403 bp, Panicum virgatum
  misc_feature: Ceres CLONE 2040412
  misc_feature: Encodes the peptide sequence at SEQ ID NO. 48056
tagtatcctgaactctatgcgtacgacaatccgcaacatgggcgactcagcaggtgttggtggcggtgccgttacatcactaattacaatgcttcttacgggagggagcctttctactggtggtctgagacaggagccacagctgacagcgtgcgagccatttgatgtctacgcgaagcccttctcgctatgacggttcctggtattcccgaagaagctactatacaggtgctcctgtatcgcgttatcatcatgtacattttcgttattgaaattgatccatccatcccataaaagagctaaaatgtatgcttttggatttgacatgtatttacgacgatttccatatttgaatcattcacaatgcggcaattgcactttaatttattacttgttcaggccc

SEQ ID NO: 48056 - protein, 63 aa, Panicum virgatum
  misc_feature: Ceres CLONE 2040412
  misc_feature: The sequence is a functional homolog of SEQ ID NO 110 in the 11/479,226 US patent application
  misc_feature: The sequence is a functional homolog of SEQ ID NO 1289 in the 11/479,226 US patent application
  misc_feature: The sequence is a functional homolog of SEQ ID NO 180 in the 10/374,780 US patent application
  misc_feature: The sequence is a functional homolog of SEQ ID NO 234 in the 10/225,068 US patent application
  misc_feature: The sequence is a functional homolog of SEQ ID NO 596 in the 10/412,699 US patent application
SILNSMRTTIRNMGDSAGVGGGAVTSLITMLLTGGSLSTGGLRQEPQLTACEPFDVYAKPFSL

SEQ ID NO: 48057 - DNA, 693 bp, Panicum virgatum
  misc_feature: Ceres CLONE 2040425
  misc_feature: Encodes the peptide sequence at SEQ ID NO. 48058
gagacctaatccaatcaagcatttacacgaaaacaaaagaagaaatcatgccgtgctgttcgctccatgatggccctagcagaggtaacatcattggtcgtacgtgctccaagcagcagcttatgaagtccgctatggctgtactggcactgatgctggtttataggtgtggatacgtccgttgcgcgacggtcccccaagacagcacggacatgctggcactgatcgatttcaggcaagcaatcaccggagatcccaaaggattcttctattcctggaacaacagtgtcaactactgcaattggaatggggtcacatgcagcaaaacgcacagagggcgcgtcagggagctcaacctcacaggccagagcttggaaggcaggatctctctatctcttgggaacttaaccatacttaagatactcgatctctcctcaaatagcctctctggtcagttgcccgatcttaactgcctccgtaagctgcagttccttgttatgagcaataacaagttgcagcactttgctcctaacgcacttacaaactgttccaacttactacatctagacctttctgcaaacaatttagtgggttcaattccccccggaatcagtttcctctacaagcttgagtttctgaaccttcaatcgaataatttcactggaccaatcccatcaagtctaggcaacatca

SEQ ID NO: 48058 - protein, 215 aa, Panicum virgatum
  misc_feature: Ceres CLONE 2040425
  misc_feature (52)..(92): Pfam Name: LRRNT_2 Pfam Description: Leucine rich repeat N-terminal domain
  misc_feature: SWISSPROT Homolog: EC 2.7.11.1 Non-specific serine/threonine protein kinase
MPCCSLHDGPSRGNIIGRTCSKQQLMKSAMAVLALMLVYRCGYVRCATVPQDSTDMLALIDFRQAITGDPKGFFYSWNNSVNYCNWNGVTCSKTHRGRVRELNLTGQSLEGRISLSLGNLTILKILDLSSNSLSGQLPDLNCLRKLQFLVMSNNKLQHFAPNALTNCSNLLHLDLSANNLVGSIPPGISFLYKLEFLNLQSNNFTGPIPSSLGNI

SEQ ID NO: 48059 - DNA, 717 bp, Panicum virgatum
  misc_feature: Ceres CLONE 2040427
  misc_feature: Encodes the peptide sequence at SEQ ID NO. 48060
aaaaaaatccaacccaaaagcacgaattttcctcgtgttcttctccggttctccccaccgaaaagcacgagcagcacaccggcaacggcaacggcaaagaaagcgacacgacacccacacgagcgggcgctgagcaacctgtcgaggaggagaccatgcaggacggcggcgaggtgctgttcctggacggcgtcggggaggtcgtcgtctccatcggccgcagcggcttctctctacagcatctgcatccggaactggtctcttcatgttggtcatctattacactgcagcctaaattggacaacaaaatcaagttttcagatgtttacgctgtagagctgctcgataagggtcctatcagtgggccttggaatacaagaactgttattcaaggcaagaaaaatattgagatgcaccgatttgttgtacatgggattaccagaacaagaaaacgtccttctccatgggtaccttgtgaatatatttttggtcacaaagacttgaagacctgcaaaaattggttcgagcgtctcatggcatgcataaacaatgaaggcgatagaccaaagaacctgatggtatttgttcatccattatgtggaaaaggtagaggggtcaagaattgggaaacagtagccccattatttggtagagcgaaaataaaaacaaaggtgatagtgacagatagagcagggcatgcatacgacacgttagtat

SEQ ID NO: 48060 - protein, 187 aa, Panicum virgatum
  misc_feature: Ceres CLONE 2040427
  misc_feature: SWISSPROT Homolog: EC 2.7.1.138 Ceramide kinase
MQDGGEVLFLDGVGEVVVSIGRSGFSLQHLHPELVSSCWSSITLQPKLDNKIKFSDVYAVELLDKGPISGPWNTRTVIQGKKNIEMHRFVVHGITRTRKRPSPWVPCEYIFGHKDLKTCKNWFERLMACINNEGDRPKNLMVFVHPLCGKGRGVKNWETVAPLFGRAKIKTKVIVTDRAGHAYDTLV

SEQ ID NO: 48061 - DNA, 430 bp, Panicum virgatum
  misc_feature: Ceres CLONE 2040432
  misc_feature: Encodes the peptide sequence at SEQ ID NO. 48062
gacctgcctccccgcacgtaaagacgcactagacctcctctgccgatggtgctgggatcctgccccgatcgcgtcggcaacctcccacccacacggggcgaaccgaagatcatcaggggagggacgcttccttcctcacgcatcccgatcgaaccgggggtcccgttttcgtttcgtcagggagcctccgaggacactagaggtcgatcggagcggagaggccatcgaggaacttccttcaactctagttccacgagggggcgccaccgtgcaccacacttgcaggccttgacatccgatgatgctgaagaaaccatggcagggatgcgttctcatgctcgccttgcttcactgtgacgccgcaggcatattaatcccctcaaaaaattctccgtcagagttcgccaagatcgttcaggctaagcagacc

SEQ ID NO: 48062 - protein, 43 aa, Panicum virgatum
  misc_feature: Ceres CLONE 2040432
  misc_feature: Functional homolog of the protein sequence given in SEQ ID NO 50730
  misc_feature: Useful for making plants with altered carbohydrate content
MMLKKPWQGCVLMLALLHCDAAGILIPSKNSPSEFAKIVQAKQ

SEQ ID NO: 48063 - DNA, 685 bp, Panicum virgatum
  misc_feature: Ceres CLONE 2040439
  misc_feature: Encodes the peptide sequence at SEQ ID NO. 48064
acaacccaaaccatcactccatcagagggagagggagagggagaggagtgcgcgcgccctcgctccaatgccggcctaggctgggccaggcagcggcgtcgtccgccggagcagcgagcagcgccgcagctgcggggagctgctgagctagaggggcagcgaggcggcgatccggcgagcgggaggaggaggaagaggagcagcagcggcaggcggccgaggcggggatgacggcggaggaggggcggtcgctggcggagacgcccacctggtcggtggccaccgtcaccacgctcatgttcgccgcctgcttcctcgtcgagcgctccctctcgcgcttcgccaagtggctgcgcaagaccaagcggaaggccatgctcgccgcgctcgagaaggtccgcgaagagctgatgctgcttggcgtcatctcgttgttgctgagccagacgtcgcacttcatatccgagatctgcgtgccctcctcgctcttcaccagccgcttctacatgtgctcggagaccgactacaaggaccttctgcagaacgcgggcgcgaaccagacggctctggagaagaccatgtttggcagccagtcgatgcacgtctgcagcgagggccatgagcctttcgtttcgtacgagggcctcgaacagctgcatcggtttttgttcatccttggtatcac

SEQ ID NO: 48064 - protein, 152 aa, Panicum virgatum
  misc_feature: Ceres CLONE 2040439
  misc_feature (4)..(152): Pfam Name: Mlo Pfam Description: Mlo family
MTAEEGRSLAETPTWSVATVTTLMFAACFLVERSLSRFAKWLRKTKRKAMLAALEKVREELMLLGVISLLLSQTSHFISEICVPSSLFTSRFYMCSETDYKDLLQNAGANQTALEKTMFGSQSMHVCSEGHEPFVSYEGLEQLHRFLFILGI

SEQ ID NO: 48065 - DNA, 710 bp, Panicum virgatum
  misc_feature: Ceres CLONE 2040445
  misc_feature: Encodes the peptide sequence at SEQ ID NO. 48066
aaatcgactccagccatgaccactaccagcatgaagctcattttgtccatcctccccatcctaattgtagggtttataccagaactaagcaccggtaatgaccacaggcacttcgcctacactggcttcgccaacagcaacctcaccctagacggcgcagctagaatcacgtcgaccggcgtcatcgagctgacaaatgatacagcccggatcaagggccatgcagtttacccatctccactgcgcttccgcctgtcccctgatggcatggtgcagtccttctctacctcatttgtgtttggtattctctcttcatttggcgacataaggggccatggctttgccttcttcattggcccaagcaatgatttcactgaagcttttccaatccaatttttggggcttttcaactccacaaacaatggcagttcgatcaaccaaatctttgcaattgagcttgacaccatccaaaatactgagtttggggacatcgacaacaaccatgttggaatcgacatcaacagcctcaactctttgatatccaacacagctggtttctacaataacggtaagaatggcatgttcacaaacctacccctcattggaagtgggccaatccaaacttgggtagagtatgatggaaacacaacacagatcagtgtgaccttagctcctcttggcatggaaaaacctatgaggccactcctctc

SEQ ID NO: 48066 - protein, 231 aa, Panicum virgatum
  misc_feature: Ceres CLONE 2040445
  misc_feature (29)..(231): Pfam Name: Lectin_legB Pfam Description: Legume lectin domain
MTTTSMKLILSILPILIVGFIPELSTGNDHRHFAYTGFANSNLTLDGAARITSTGVIELTNDTARIKGHAVYPSPLRFRLSPDGMVQSFSTSFVFGILSSFGDIRGHGFAFFIGPSNDFTEAFPIQFLGLFNSTNNGSSINQIFAIELDTIQNTEFGDIDNNHVGIDINSLNSLISNTAGFYNNGKNGMFTNLPLIGSGPIQTWVEYDGNTTQISVTLAPLGMEKPMRPLL

SEQ ID NO: 48067 - DNA, 661 bp, Panicum virgatum
  misc_feature: Ceres CLONE 2040460
  misc_feature: Encodes the peptide sequence at SEQ ID NO. 48068
atcgatcaatcaaccaacccacctccgcgaaatgtccatctcgatgcgcctcgcgatcccggcgccggcggccgcgaccgtggcgccgccgcggctgagggtgcgggtggccgggaacgggggctctcttcccgccgcgcgcgtcgccctgcggacggagacggccgcgctcaggggatgcgcctcgctgcccctgaagccgcagcctctgggcgcgggccagccgagccgccgccggggggcggccgccgtgtgccactcgtcggcgcacctgagcgcgcggacgatgcagtggatctccgccggggccagcgcagtgctattgcttgctaaaggaacagccataaacaaatctttccttgtgccatttttcgctttgcaagcaccttgcagcataatctcgtggatcaagggtgattatggccaatggactgcttttcttgctcttttggtgcgcttgttcttcttcattccaggtgaacttgagcttccgctgtcaacaatgctgctagtgagcgttgctccttaccaattaatgaatctgaggggaactcaaggtggtgcagttctgtcattggccatagctgggtttctcgcttttcaacacttcaccagggtgggaggtctaggcaaagcctttgagcagggatcggtcattgcg

SEQ ID NO: 48068 - protein, 209 aa, Panicum virgatum
  misc_feature: Ceres CLONE 2040460
  misc_feature (38)..(209): Pfam Name: WCOR413 Pfam Description: Cold acclimation protein WCOR413
MSISMRLAIPAPAAATVAPPRLRVRVAGNGGSLPAARVALRTETAALRGCASLPLKPQPLGAGQPSRRRGAAAVCHSSAHLSARTMQWISAGASAVLLLAKGTAINKSFLVPFFALQAPCSIISWIKGDYGQWTAFLALLVRLFFFIPGELELPLSTMLLVSVAPYQLMNLRGTQGGAVLSLAIAGFLAFQHFTRVGGLGKAFEQGSVI

SEQ ID NO: 48069 - DNA, 703 bp, Panicum virgatum
  misc_feature: Ceres CLONE 2040475
  misc_feature: Encodes the peptide sequence at SEQ ID NO. 48070
acgaaatgggtgttcagccagctgaattagctgttgccatcatcatcatcagcagcagcagctagggagttcttggcggccggcttcgatcaagagtcttgaagagggggaggggcggcgccgcgtgcatggagagccagcgcgtggtggtggtcgtggaggacgcggccgccgcccgcgccgcgctgcagtgggccgtcggcaacttcatccgcggcggcgactccatcacgctgctccacgtctgcccgcccgcgcgctcgcgccggaagcgccgcaggctccggcttggcggcttccagctcgcgctcgccttcaaggacctctgcaacggcatcgccgaggccaaggtggagatcgtggtgacggaaggggagctcggggagacggtggtggccacggtcaaccagctcggcgccaccacgctcgtcgtcggcctccacgacaagagcttcctctacagggcgccgagcccgtacacgagagtgaggagcctggggtgcagggtcctcgccgtccggcagcacgccacggcgcgggacggcttcttgaacgccgacctcacccagatcgagaccataagcttgcacataccaccgccaaagatcccgttcccgatgttcacgctcccgcttggcgtgatatggaggagatcgaagcggagaaagtgatgctgcgaggaggacggagctcttcttctgtc

SEQ ID NO: 48070 - protein, 180 aa, Panicum virgatum
  misc_feature: Ceres CLONE 2040475
  misc_feature (2)..(131): Pfam Name: Usp Pfam Description: Universal stress protein family
MESQRVVVVVEDAAAARAALQWAVGNFIRGGDSITLLHVCPPARSRRKRRRLRLGGFQLALAFKDLCNGIAEAKVEIVVTEGELGETVVATVNQLGATTLVVGLHDKSFLYRAPSPYTRVRSLGCRVLAVRQHATARDGFLNADLTQIETISLHIPPPKIPFPMFTLPLGVIWRRSKRRK

SEQ ID NO: 48071 - DNA, 709 bp, Panicum virgatum
  misc_feature: Ceres CLONE 2040477
  misc_feature: Encodes the peptide sequence at SEQ ID NO. 48072
catcattttaggaaatgatgcagaactcggtagtgacattgatccagaagaagctcaacaggcacttgaaatagccgaagctaacttgagtagagctgagggtacgaaagaattggttgaagcgaagctagctctcagacgagctaggatacgagtcgaggctgtcaattggattcccccatccaattgaagacaatccaaaggtttcgttgatacaaagaaaaaggaaagaagggtagaaaaagttattagatagcgaagcgaagtaagcccaatgctatctagtaatttttctacctacctacctactattggatttgaaccaatgactcccgccgtatgaaagcaatactctaaccactgagttaagtaggcaatttatcaccacaaaagaagccccattacttcgatcgattatagatcgaatcctttttataagcaataccccgccattattggtatgtttatattatattatatagtaaacaaaggaatatcctctggcattagagaatattcatcttgacaagaaattatctatatgttaagatatctctgacaagggctatagctcagttcggtagagcaactcgcttacacgtgcgccaatgcttttcaagggaacttattatgcaatgaacagaattgaacttattgcaaaatcaatgtcttacttcatggattcgaaagaataggagaacaatagcct

SEQ ID NO: 48072 - protein, 62 aa, Panicum virgatum
  misc_feature: Ceres CLONE 2040477
  misc_feature (11)..(58): Pfam Name: ATP-synt_DE Pfam Description: ATP synthase, Delta/Epsilon chain, long alpha-helix domain
  misc_feature: SWISSPROT Homolog: EC 3.6.3.14 H(+)-transporting two-sector ATPase
IILGNDAELGSDIDPEEAQQALEIAEANLSRAEGTKELVEAKLALRRARIRVEAVNWIPPSN

SEQ ID NO: 48073 - DNA, 697 bp, Panicum virgatum
  misc_feature: Ceres CLONE 2040479
  misc_feature: Encodes the peptide sequence at SEQ ID NO. 48074
tcgtgacaagagagcaagcatcatccataacgttctagcagcaactgacaccttcgtttccccaagtcgagcagaggcagagcgatcagccatggcggcggccgacgtgcacatggccgggggcgcagagacggagaccttcgcgttccaggccgagatcaaccagctgctctccctcatcatcaacaccttctactccaacaaggagatcttcctgcgggagctcatctcaaactcatcagatgcgctcgacaagatccggttcgagagcctgacggacaagagcaagctggacgcccagcccgagctcttcatccgcctggtgcccgacaaggcctccaagacgctctccatcatcgactccgccgtgggcatgaccaagtccgacctcgtcaacaacctcggcaccatcgcgcgctccggcaccaaggagttcatggaggcgctggcggccggcgccaccgacgtctccatgatcggccagttcggcgtggggttctactccgcctacctcgtcgccgacaaggtcgtcgtcaccaccaagcacaacgacgacgagcagtacatctgggagtcgcaggccggcggctccttcaccgtcacgctcgacaccaccggcgatcgcctcggccggggcaccaagatcacgctcttcctcaaggacgaccagctcgagtacctggaggagcgccgcctc

SEQ ID NO: 48074 - protein, 201 aa, Panicum virgatum
  misc_feature: Ceres CLONE 2040479
  misc_feature (37)..(192): Pfam Name: HATPase_c Pfam Description: Histidine kinase-, DNA gyrase B-, and HSP90-like ATPase
MAAADVHMAGGAETETFAFQAEINQLLSLIINTFYSNKEIFLRELISNSSDALDKIRFESLTDKSKLDAQPELFIRLVPDKASKTLSIIDSAVGMTKSDLVNNLGTIARSGTKEFMEALAAGATDVSMIGQFGVGFYSAYLVADKVVVTTKHNDDEQYIWESQAGGSFTVTLDTTGDRLGRGTKITLFLKDDQLEYLEERR

SEQ ID NO: 48075 - DNA, 408 bp, Panicum virgatum
  misc_feature: Ceres CLONE 2040507
  misc_feature: Encodes the peptide sequence at SEQ ID NO. 48076
atcgcatctcctattctcctctcgctctctgttgtgtgactgattgccaagaaagctctctgcttgcttgtgttccagcctctgaatctcgcgaggatgtcgtgctgcggaggcaactgcgggtgcggctccggctgcaagtgcggctccggctgcggagggtgcaagatgtacccggacatgactgagcagggcaccaccagcagcagccagactgtcatcatgggcgttgcaccaatcgacaaggggtacgccgagggcggatttcacgccagcgcccgaaccgacaatggttgcgattgcctgtgccagctgcgcctgcagacgccgcccctgctaatgatgtcctcatggcctcgaggcgaatggacgagatttgaaaggtcttcagcgacggaaacctcgatg

SEQ ID NO: 48076 - protein, 103 aa, Panicum virgatum
  misc_feature: Ceres CLONE 2040507
  misc_feature (1)..(71): Pfam Name: Metallothio_2 Pfam Description: Metallothionein
MSCCGGNCGCGSGCKCGSGCGGCKMYPDMTEQGTTSSSQTVIMGVAPIDKGYAEGGFHASARTDNGCDCLCQLRLQTPPLLMMSSWPRGEWTRFERSSATETS

SEQ ID NO: 48077 - DNA, 716 bp, Panicum virgatum
  misc_feature: Ceres CLONE 2040522
  misc_feature: Encodes the peptide sequence at SEQ ID NO. 48078
attcgaatttggtttctgattgcgtgcgctggtgcgtgcaggagacgtcgaggacgctctccgacctggaagagggcagcaacgttcaggttcggtgcccagccccgttcccgcaaacccctcgctctcttccacccccgcgcgcaaaccagttgattaaccttcctctctctctctctctctctctctctctctctctgttgtctttttcatcgtcaaaattggaattatctcagccagggaacgtcgggttctgtcgagtaatcaagttggccaagcatgacgccgggaagctggtcctcgccaccatagcgctgctcgtagcctccctcagcaacattctcgttccgaaatatggtggcaagataattgacattgtgtcaagagatgttcggcgcccagaagataaagctcaagccttggaggacgtgaagggcacaatcttgtacattgtgataatcgttgtagtcggttcagtttgcacggctcttcgggcatggctattcaattctgctagtgagagagtagtcgctcgacttaggaaggacttgttcagtcatctcataaaccaggaaatagcattttttgatgtgactaggacaggagagctcttaagcaggctttctgaagatacacagataataaagaatgcggctacaaccaacttatcggaggcactgcgcaatatcactactatagctatcggtcttggtttt

SEQ ID NO: 48078 - protein, 237 aa, Panicum virgatum
  misc_feature: Ceres CLONE 2040522
  misc_feature: SWISSPROT Homolog: EC 3.6.3.44 Xenobiotic-transporting ATPase
SNLVSDCVRWCVQETSRTLSDLEEGSNVQVRCPAPFPQTPRSLPPPRANQLINLPLSLSLSLSLSLLSFSSSKLELSQPGNVGFCRVIKLAKHDAGKLVLATIALLVASLSNILVPKYGGKIIDIVSRDVRRPEDKAQALEDVKGTILYIVIIVVVGSVCTALRAWLFNSASERVVARLRKDLFSHLINQEIAFFDVTRTGELLSRLSEDTQIIKNAATTNLSEALRNITTIAIGLG

SEQ ID NO: 48079 - DNA, 684 bp, Panicum virgatum
  misc_feature: Ceres CLONE 2040526
  misc_feature: Encodes the peptide sequence at SEQ ID NO. 48080
agctttgccccatttttatctccgagtcctctcccaagtctcctaaccccaaagtggtggagagagagatggttgaaatggatctgttggagaggaacattaagaagggggaggaggccggcggggtgggtaccgtgatggtgagtttggcgatgactctgagaggccataccggaggacctatgagcgccatagcggtaccggccgtgggtttgaaatgaagcgtgagggtgcagggcgtgggaactggggaactaccactgatgaaattatcgcccaggaaactgaggaaggcctgaagctggatgagaaggcccctgttccagagaagcagggtgcactggaggatgctccacaggcagaggagaacaaggataacaaggacacaaatgaggaagaagagaaggaagaggataaggagatgaccctggaggagtttgagaaaataagggaggaaaagcggaaggcacttcttgccctaaagactgaagagaggaaggttgaagttgataaggacctgcagtctatgcagccgctttccactaagaaaggaaatgacgaaattttcgtaaaactgggttctgataaggatgctctgaagaagaaagaaaatgctgaacgtgatgagcgtgctaagaagtctctgagcatcaatgagttcttgaaacctgctgatggagaaag

SEQ ID NO: 48080 - protein, 155 aa, Panicum virgatum
  misc_feature: Ceres CLONE 2040526
  misc_feature (1)..(96): Pfam Name: HABP4_PAI-RBP1 Pfam Description: Hyaluronan / mRNA binding family
MKREGAGRGNWGTTTDEIIAQETEEGLKLDEKAPVPEKQGALEDAPQAEENKDNKDTNEEEEKEEDKEMTLEEFEKIREEKRKALLALKTEERKVEVDKDLQSMQPLSTKKGNDEIFVKLGSDKDALKKKENAERDERAKKSLSINEFLKPADGE

SEQ ID NO: 48081 - DNA, 684 bp, Panicum virgatum
  misc_feature: Ceres CLONE 2040530
  misc_feature: Encodes the peptide sequence at SEQ ID NO. 48082
cccttcagaggcaaacaaaccagcactgaagaacataatgggcaaggccaacctccatgttttcttcctcctatttttgatcttgagttctttctgcgagtccaacgaccaactaacagttacacaggaaaactcactctcccccggcaacatggtcatatctgatgggggagtctttgctcttggttttttctccccaaccaactccagcaagagcttgtaccttggaatctggtacaacaacatccccgagtgcaccgtcgtgtggatcgccaatcgcgatagcccaatcaccaaccattcatccgtgaagctcgccataaccaatagttcagagatggtgttgttcgactctgaaggacgctctgtttggatgacggcgaacaccaccaccgctggaggtgatgacggagctgtcgcggttctgctcgactcaggtaactttgtgctccggttgctcaacggcacggtcgtgtggcaaagcatcgatcatcccaccgacaccatacttccaaacacgacgttcttgctgagctacaaggcacaagtggttgaaagcctcgttgcctggaagggccctgatgatccatctactggggacttctcctcaagcatcgatcccagctcgtaccttcaaatcttcatctggaacgggagtttgccgtacaagcgcctcgatgttgt

SEQ ID NO: 48082 - protein, 215 aa, Panicum virgatum
  misc_feature: Ceres CLONE 2040530
  misc_feature (72)..(185): Pfam Name: B_lectin Pfam Description: D-mannose binding lectin
MGKANLHVFFLLFLILSSFCESNDQLTVTQENSLSPGNMVISDGGVFALGFFSPTNSSKSLYLGIWYNNIPECTVVWIANRDSPITNHSSVKLAITNSSEMVLFDSEGRSVWMTANTTTAGGDDGAVAVLLDSGNFVLRLLNGTVVWQSIDHPTDTILPNTTFLLSYKAQVVESLVAWKGPDDPSTGDFSSSIDPSSYLQIFIWNGSLPYKRLDV

SEQ ID NO: 48083 - DNA, 710 bp, Panicum virgatum
  misc_feature: Ceres CLONE 2040542
  misc_feature: Encodes the peptide sequence at SEQ ID NO. 48084
agcagcaacagtacagctgcagcatccgtagccttcgcttcgttcccctcctgtccttccctttcccttggcttccttgctttgcttgctcctctgccgccccgtcgccgccgtctcctccgtggcgcatcaggcattcgaacccgctcgtcaaaaggaatccgtccgcgagatcgaaagcaacagctcccgattattaaagccacgctttttcaaaagccgcgggggttaaaaaccctgggaaattttggaggaagcgaaattcgtttcctcgcatccgaaactgcagttgcgtgctcgaggcgggggtgcacagcctagaagctccagcgcccgacggcgccggcgccccgttctctccgtgggatcctccgccggccgccactccactgagctctgtggtggacttgggtggagattcaacccggcgcggattggactggtcggttcttttgctgaataccacacatgacaagggttatacatgactctggagaaggcgtgcagaaggaggcacttgatctggtttcttctgatgttaacttccccaagggccatttcccggactacaggattggaccaaacaatcaaatcattgatccagaggaggcacatgaggctgtgcctctcaaggagattgttgcaaaggaaacagcgcagctgctagagcagcacaagcgcctttcagtgcgcgatctcaaagagaagtt

SEQ ID NO: 48084 - protein, 80 aa, Panicum virgatum
  misc_feature: Ceres CLONE 2040542
  misc_feature: Functional homolog of the protein sequence given in SEQ ID NO 50332
  misc_feature: Useful for making plants with altered alkaloid content
  misc_feature: Useful for making plants with altered terpenoid content
MTRVIHDSGEGVQKEALDLVSSDVNFPKGHFPDYRIGPNNQIIDPEEAHEAVPLKEIVAKETAQLLEQHKRLSVRDLKEK

SEQ ID NO: 48085 - DNA, 638 bp, Panicum virgatum
  misc_feature: Ceres CLONE 2040543
  misc_feature: Encodes the peptide sequence at SEQ ID NO. 48086
gagaacaatctcaggttcctccctcccccattcgcgtgccttcggtttctcgatgtttgcctgttcgttcgtcagatcaaccaatccttcgcatccgatttgcgtctccttttctatctggaattgggtcaagagatctggttgcttaaacacgattaagaattagatatttataggtttcgttggtgatggcgagctcagggttctcgtggacgctgccggaccacccgaagctccccaaggggaagccggtggccgtcgtcgtgctggacggatggggcgaggccaacgccgaccagtacaattgcatccatgtcgctcagacccccgtcatggattccctcaagaatggtgctccagagaggtggagactcgtgaaggctcatggaactgctgtgggtctcccatctgatgatgatatgggcaacagtgaagttggccacaatgctcttggagctggtcgcattttcgcccaaggcgctaagctcgtggaccaagctcttgcctccggaaaaatttatgagggtgatgggttcaactacatcaaagaatcttttgaaaatggtacacttcaccttattgggttgttgagtgatggtggcgtccactcccgtcttgaccaactgcagctacttctg

SEQ ID NO: 48086 - protein, 149 aa, Panicum virgatum
  misc_feature: Ceres CLONE 2040543
  misc_feature (18)..(149): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSGFSWTLPDHPKLPKGKPVAVVVLDGWGEANADQYNCIHVAQTPVMDSLKNGAPERWRLVKAHGTAVGLPSDDDMGNSEVGHNALGAGRIFAQGAKLVDQALASGKIYEGDGFNYIKESFENGTLHLIGLLSDGGVHSRLDQLQLL

SEQ ID NO: 48087 - DNA, 666 bp, Panicum virgatum
  misc_feature: Ceres CLONE 2040554
  misc_feature: Encodes the peptide sequence at SEQ ID NO. 48088
aacaccggcactccagcagggcacagcaagggcatctgctctgcatttcttcgcctgatccagtccaaccggagagagtgcacgagaacgacaggctggaatcaatcgtgtcggcaaaccaagcagaggcggagagcaacttttgctgcctcggacgcgttggcggcgcgcggcgtcgaggcccgccgagaatcctgcagcgcggcgaggttcccggcgcctcacggcgcggctgcggctgcactgcagcgatcctagaccgcgacagcatgcatggtcgcgcacagagccattagcagcaccgccgttgctctgctcatcatgtcgccggctcttcctgttcacgtgcagtagatggatggaggaggaagaaggagcttacgtccctagctcccagcgggttcagatggacgtcgttagctccaaatgtgacggaacgtgatggaatgctacttctaggacagtgaaaccattggacgccgcttagaaacttcttgatatttctaaggggcgataaggcagggaatgagtacaaccaaggtgaagagacgtgtggggaagtatgagctcggtcggaccataggtgaaggcacattcgcaaaggtcaggttcgcaaagaacactgagacaggcgaaccggtagccatcaaggtcgtagataaggag

SEQ ID NO: 48088 - protein, 46 aa, Panicum virgatum
  misc_feature: Ceres CLONE 2040554
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
  misc_feature: The sequence is a functional homolog of SEQ ID NO 32 in US patent 7179962
MSTTKVKRRVGKYELGRTIGEGTFAKVRFAKNTETGEPVAIKVVDK

SEQ ID NO: 48089 - DNA, 582 bp, Panicum virgatum
  misc_feature: Ceres CLONE 2040560
  misc_feature: Encodes the peptide sequence at SEQ ID NO. 48090
gcgtctcgcatcctcgccgctgctgctgctattaacgccaccgccggccaacaacccgaaacctacctccgccgtggtcgccgcatccgccgccaagatggcgagccaaggggagccgtcggcctccgcttcggatccgaaaggcaagaaggattactccacgggcatcttggagcggaagaagtcgccgaaccgcctggtcgttgatgaggccaccaacgacgacaactccgtcgtcgctctccgcccggataccatggagaggctgcggctcttccgcggcgataccgtgctccttaagggtaagaagaggaaagatactatatgcattgtccttgcagatgaaacctgtgaggaaccaaaggttcggatgaactaggttgtccgccagaacctgagggtgaggcttggtgatgtggtttccgtccatcagtgccaggatgtgaaatatgggaagcgtgtacacattcttccaattgatgatacagttgaaggcattacagggaacctgtttgatgtcttcttgaaagcatacttcctagaagcgtaccgtcctgtgaggaaaggagaccttttccttgt

SEQ ID NO: 48090 - protein, 93 aa, Panicum virgatum
  misc_feature: Ceres CLONE 2040560
  misc_feature (30)..(93): Pfam Name: CDC48_N Pfam Description: Cell division protein 48 (CDC48), N-terminal domain
MASQGEPSASASDPKGKKDYSTGILERKKSPNRLVVDEATNDDNSVVALRPDTMERLRLFRGDTVLLKGKKRKDTICIVLADETCEEPKVRMN

SEQ ID NO: 48091 - DNA, 706 bp, Panicum virgatum
  misc_feature: Ceres CLONE 2040574
  misc_feature: Encodes the peptide sequence at SEQ ID NO. 48092
attattcacgcctaagctcttcagttatagctcacgagttgaaactagaaaatggagaaaccagatgggtggttgataccattgttgggaaagaggatggacttggttgtgagaatctccatggaagtggtgcaattgccagcgcgtattctaaggcatacaaagaaaccttcaccctgacatttgtgactggaagagctgttggcattggagcctatctggctcgtttaggtatgcggtgcatacaacgtcttgatcaaccaattattctgactgggttttctgcactgaacaagcttctgggacgggaggtatacagttctcatatgcaattgggtggccccaaaatcatggctacaaatggtgttgtccaccagaccgtgtcagatgatcttgaaggtgtttctgctatactgaagtggctcagttatgttcctccatatgttggtggtccccttcctattatgaaacccctggacccaccagaaagacctgtaacatacttccctgaaaattcttgtgatgctcatgcggccatatgtggcattcaggatggtgaaggcaactggttgggtggcatgtttgacagggaaagcttcgtggaaacattggaaggctgggcaaaaacagttatcactggaagagcaaaacttggtggaataccagttggtgtcatagctgtggaaacccagacggtgatgcaagt

SEQ ID NO: 48092 - protein, 234 aa, Panicum virgatum
  misc_feature: Ceres CLONE 2040574
  misc_feature (2)..(234): Pfam Name: Carboxyl_trans Pfam Description: Carboxyl transferase domain
  misc_feature: SWISSPROT Homolog: EC 6.4.1.3 Propionyl-CoA carboxylase
  misc_feature: Functional homolog of the protein sequence given in SEQ ID NO 51511
  misc_feature: Useful for making plants with altered oil content
  misc_feature: Useful for making plants with modulated herbicide sensitivity
YSRLSSSVIAHELKLENGETRWVVDTIVGKEDGLGCENLHGSGAIASAYSKAYKETFTLTFVTGRAVGIGAYLARLGMRCIQRLDQPIILTGFSALNKLLGREVYSSHMQLGGPKIMATNGVVHQTVSDDLEGVSAILKWLSYVPPYVGGPLPIMKPLDPPERPVTYFPENSCDAHAAICGIQDGEGNWLGGMFDRESFVETLEGWAKTVITGRAKLGGIPVGVIAVETQTVMQ

SEQ ID NO: 48093 - DNA, 676 bp, Panicum virgatum
  misc_feature: Ceres CLONE 2040613
  misc_feature: Encodes the peptide sequence at SEQ ID NO. 48094
cttctgaacacgttgaataagcaagttaggcatttcactggttcgggaaatacccctatgacttacaatctcaggcctgtcattgaagaaatccaaaggtctgcagaggaatgtggtgacagacgaacttcgaagatgtgcttgggaatgctgaaggccatgaggaatcgtcctgatcagaactgtgttgcttatagaaagggtcttggtgttgtctgtaacaaaaaaggtggatttggtgaagatgactttgttgttgagttctttggggaggtttacccttcttggagatggtatgaaaagcaagatggtatcaagcatatacaaaacaacagtgaagatcaagctcctgagttttacaacattatgttagaaaggccaaagggagaccgaaatggatatgacttggtttttgttgatgcaatgcacaaggccaactatgcaagtaggatctgccactcctgcaacccgaactgtgaagcaaaagtgacagctgtggatgggaaatacatgattggagtttacactcttcgaccaattgcagaaggcgaggaaatcacatttgattacaattctgtaactgagagcaaagaagaacacgaagcttcgatctgcctttgtggaagtcaagtatgccggggcagctatttaaatttttccggtgaaggagcttttg

SEQ ID NO: 48094 - protein, 225 aa, Panicum virgatum
  misc_feature: Ceres CLONE 2040613
  misc_feature (51)..(197): Pfam Name: SET Pfam Description: SET domain
  misc_feature: SWISSPROT Homolog: EC 2.1.1.43 Histone-lysine N-methyltransferase
LLNTLNKQVRHFTGSGNTPMTYNLRPVIEEIQRSAEECGDRRTSKMCLGMLKAMRNRPDQNCVAYRKGLGVVCNKKGGFGEDDFVVEFFGEVYPSWRWYEKQDGIKHIQNNSEDQAPEFYNIMLERPKGDRNGYDLVFVDAMHKANYASRICHSCNPNCEAKVTAVDGKYMIGVYTLRPIAEGEEITFDYNSVTESKEEHEASICLCGSQVCRGSYLNFSGEGAF

SEQ ID NO: 48095 - DNA, 698 bp, Panicum virgatum
  misc_feature: Ceres CLONE 2040621
  misc_feature: Encodes the peptide sequence at SEQ ID NO. 48096
atccgagccaccgagccatcaaaccccagaagctttccctccccatccgccgagtgttgccctcagcagcaatctgatccgcccccggtcgatcaccgcaagcggaccagagagatgggttcccgctacgaggtggaggtgacggtgggctcggcccgggacctcaagaacgtcaactggcgccacggcgacctccggccctacgccgtcgcctgggtcgactccggcgcccgctgctccacccgcgtcgacctcgacggcggcgagagccccgcctgggacgagaaggtcctcgtcccgctcccgccggcctcccgcctcgacgacgccgtgctccacgtcgacgtcgtccacgccaacgccgacgagggcgtcaagccgctcgtcggctccgcgcgcctcccgctccgcgacgtcctcgacgaggccggcctcggcggcaaggccgcgcggaccctccgcctcaagcggccctcggggcggccccagggtcgcctcgacgtccgcgtcgccgtcaaggagcccgccaggtactacgacccctacccggcgcccgggggctacgcgcagacgggcacacgcgacccctacggccccggcgccggcgggtactacggtggctccgccggcgccggcggcggctacggcccgggcgccgcgtacggctcggccggctacggcgccgcgcagccttacgc

SEQ ID NO: 48096 - protein, 194 aa, Panicum virgatum
  misc_feature: Ceres CLONE 2040621
  misc_feature (7)..(95): Pfam Name: C2 Pfam Description: C2 domain
MGSRYEVEVTVGSARDLKNVNWRHGDLRPYAVAWVDSGARCSTRVDLDGGESPAWDEKVLVPLPPASRLDDAVLHVDVVHANADEGVKPLVGSARLPLRDVLDEAGLGGKAARTLRLKRPSGRPQGRLDVRVAVKEPARYYDPYPAPGGYAQTGTRDPYGPGAGGYYGGSAGAGGGYGPGAAYGSAGYGAAQPY

SEQ ID NO: 48097 - DNA, 688 bp, Panicum virgatum
  misc_feature: Ceres CLONE 2040634
  misc_feature: Encodes the peptide sequence at SEQ ID NO. 48098
agccacagaggaagaataatccattcgccttgcttgcgcctcccgtctgcgtgcgatcgacgcagagaaggcgcgggcgctcaacgccatcgccaccatccggttccgatccgatggccttcatgcgctcgcactcaaatgcatcttccggcatgggagttgctcctaacatcagggagacattcgtcgagcttcagatgaagaaggcattccgatatgttatcttcaaaattgaggaaaagcaaaagcaggtggttgttgagaagaccggtgctactactgaaagctatgatgactttttggcctccctcccagaaaatgattgcagatacgctctgtatgattttgatttcgtcactggggagaatgtgcagaaaagcaagatatttttcattgcctggtgagcttcataatcgcagtctttattctgtttcatctttagtagttacattaacctatggtgtttctgccaatgaatgagtagatctgttaagaaatagttaaacaagtaaacttttaatgagttagtcatgtgttaggaatctatgtaaaaatatttagatgtatccagggtttttttccccaaccggacaccccaaaccggagcactccggttccggtttaccggaccggtttgaccggttaccggtagaaaccggtcaaattcaaatttgaattcaaaatactc

SEQ ID NO: 48098 - protein, 96 aa, Panicum virgatum
  misc_feature: Ceres CLONE 2040634
  misc_feature (18)..(92): Pfam Name: Cofilin_ADF Pfam Description: Cofilin/tropomyosin-type actin-binding protein
  misc_feature: Functional homolog of the protein sequence given in SEQ ID NO 50159
  misc_feature: Useful for making plants with modulated time to senescence
MAFMRSHSNASSGMGVAPNIRETFVELQMKKAFRYVIFKIEEKQKQVVVEKTGATTESYDDFLASLPENDCRYALYDFDFVTGENVQKSKIFFIAW

SEQ ID NO: 48099 - DNA, 577 bp, Panicum virgatum
  misc_feature: Ceres CLONE 2040635
  misc_feature: Encodes the peptide sequence at SEQ ID NO. 48100
atctcaattcatctcccttttgctcaagcgacttgaattcgattcaaagcttcttcctcattttcttctgcttcctctgtctctcggagcacaagaggttcttgttgattagattgattctttggttggttggtctttgatcttgatccaaaggcgagtaagccatggctctgactctgcgttcctcaacatcgttcctgtcgccggtggatcccgtctccaagctcctccacaaggcgggggccgaggacgcggcgccgtgctgcgtggccgtgcccgcgacggcggcgccaagccgcaggctgcgcctcctccgggcgggcgccgcggcggcgccggcgccggcgccggaggcggagcgccaccaggaggccgagctgctccacggcggcgcggcgcagcagcagcagcacgggcgggcccggggcggcgtgccggtgtacgtgatgatgccgctggacacggtggggcccggcgggcagctggggcgcgcgcgcgcgctggcggcgagtctgatggcgctgcggggcgccggggtggagggcgtgatggtggacgtgtggtggggcgtgggtgg

SEQ ID NO: 48100 - protein, 137 aa, Panicum virgatum
  misc_feature: Ceres CLONE 2040635
  misc_feature: SWISSPROT Homolog: EC 3.2.1.2 Beta-amylase
MALTLRSSTSFLSPVDPVSKLLHKAGAEDAAPCCVAVPATAAPSRRLRLLRAGAAAAPAPAPEAERHQEAELLHGGAAQQQQHGRARGGVPVYVMMPLDTVGPGGQLGRARALAASLMALRGAGVEGVMVDVWWGVG

SEQ ID NO: 48101 - DNA, 691 bp, Panicum virgatum
  misc_feature: Ceres CLONE 2040638
  misc_feature: Encodes the peptide sequence at SEQ ID NO. 48102
attgcccatccgctcgctttagcattcccctctgccaccagccaccgtgcgacaccttcgcccactgccatcgccgacctccgtgtcccgccgccttactccgccctacgcccgtccggcgtgcccctgcgcggccatgagctgctgtaatggcccgttcggaggacaaccagctttcgcttatggctatgagggagatgcgagctcccgagtgaagttggtattattgggagaatttggtgttgggaagagcagcatcgttcttcgctttgtccgtggccagtttgaccctacttcccaggtcactattggtgcttcatttttatcacaagcattggcattagaggactccacaacagtgaagtttgaaatatgggacactgctggacaggagaggtacatatcaggagctgctggacaggagaggtatgctgccttggcaccattgtacttccggggagctggcgctgccattgttgtctatgacataaccagtccagaatcatttaacaaagcacaatactgggtgaaggaacttcagaaacatggcggtcctgatatggttatggctttggttggaaataaggctgatttgcaggaaaatcgcaaggtgtcttctcaggaagcacaagagtatgcagaaagaaacagtatgtttttcattgaaacatcagcaaaaacggccgacaac

SEQ ID NO: 48102 - protein, 184 aa, Panicum virgatum
  misc_feature: Ceres CLONE 2040638
  misc_feature (27)..(184): Pfam Name: Ras Pfam Description: Ras family
  misc_feature (27)..(152): Pfam Name: Miro Pfam Description: Miro-like protein
MSCCNGPFGGQPAFAYGYEGDASSRVKLVLLGEFGVGKSSIVLRFVRGQFDPTSQVTIGASFLSQALALEDSTTVKFEIWDTAGQERYISGAAGQERYAALAPLYFRGAGAAIVVYDITSPESFNKAQYWVKELQKHGGPDMVMALVGNKADLQENRKVSSQEAQEYAERNSMFFIETSAKTAD

SEQ ID NO: 48103 - DNA, 678 bp, Panicum virgatum
  misc_feature: Ceres CLONE 2040645
  misc_feature: Encodes the peptide sequence at SEQ ID NO. 48104
acccgtaactaaattctctacccctcctcttcactcctctcctctcagtccacaccatttcttctgctactgtttcagaattcagagcacccaacgttttgcttttgtttcatgctggcagcttaacttgttcccttgcaggggtttacgcgctctccagcaatgacatcagggttggcaccaacgttgaggtcgacggcgcgccatggaaagttctagagtttctccacgtcaagcctggaaaaggtgctgcttttgtcaggacaaaaatgcgcaattatgtcacaggcaatacagttgagaaaacgtttcgagctggaagtacgctacaggaaccatccctttcaaaggaaaccaagcaatttacatacaaggatggctcccagttcgtgttcatggatctgacaacatttgaagaaagtcggttgaacgaagcagatgtcggtgacaagcaaaaatggctgaaagagggaatggattgcaatttgttgtactggaatgggaagatcattgatttcgagctgcccatcaccgtgagactgactgtgactgatactgaccccggggcaagcgatagtgcacaaggaggaacaaagcctgcaaccctagaaactggagctgttgtcacggtgccctcttttgtgaacgtaggcgatgacatcctagttgattcaagaa

SEQ ID NO: 48104 - protein, 136 aa, Panicum virgatum
  misc_feature: Ceres CLONE 2040645
  misc_feature (27)..(81): Pfam Name: EFP Pfam Description: Elongation factor P (EF-P) OB domain
  misc_feature (89)..(136): Pfam Name: Elong-fact-P_C Pfam Description: Elongation factor P, C-terminal
MRNYVTGNTVEKTFRAGSTLQEPSLSKETKQFTYKDGSQFVFMDLTTFEESRLNEADVGDKQKWLKEGMDCNLLYWNGKIIDFELPITVRLTVTDTDPGASDSAQGGTKPATLETGAVVTVPSFVNVGDDILVDSR

SEQ ID NO: 48105 - DNA, 521 bp, Panicum virgatum
  misc_feature: Ceres CLONE 2040655
  misc_feature: Encodes the peptide sequence at SEQ ID NO. 48106
  misc_feature (330)..(330): n is a, c, t, g, unknown, or other
  misc_feature (338)..(338): n is a, c, t, g, unknown, or other
  misc_feature (368)..(368): n is a, c, t, g, unknown, or other
agggatagcatcgcaatcgcaagcaaagcaaatccaagcggcttcctccctcctatctgcagatcccccaccgactgccccctcccccaggccgccgcctccattaatggccgccaccaagaaccctccaaccccctcctgacctccctcccgactcgcctccgtcgccgtccgttccccacgccctctgcctgtacgttcttggtcggcctaaaggaaggaggaagcgaagggtgggggtggggcgaaccggttggggccaggccatcgatgctgagctcggcatcctcggcgggggcggggatgggggtggggggatataccattganaactcccnttctgataacaacctcctctccctattccntgaaggtgtgaagtacggcgctggcatcggcccaagtgtctatgacatccactctcccaagatcccatctaccgaggagatcgctgaccgcattaacaagatgcttgccgtgcttgacaccaacatcctatgggtgaaccccgactgtggtct

SEQ ID NO: 48106 - protein, 173 aa, Panicum virgatum
  misc_feature: Ceres CLONE 2040655
  misc_feature: SWISSPROT Homolog: EC 2.1.1.14 5-methyltetrahydropteroyltriglutamate--homocysteine S-methyltransferase
  misc_feature (110)..(110): Xaa is any aa, unknown, or other
  misc_feature (113)..(113): Xaa is any aa, unknown, or other
  misc_feature (123)..(123): Xaa is any aa, unknown, or other
RDSIAIASKANPSGFLPPICRSPTDCPLPQAAASINGRHQEPSNPLLTSLPTRLRRRPFPTPSACTFLVGLKEGGSEGWGWGEPVGARPSMLSSASSAGAGMGVGGYTIXNSXSDNNLLSLFXEGVKYGAGIGPSVYDIHSPKIPSTEEIADRINKMLAVLDTNILWVNPDCG

SEQ ID NO: 48107 - DNA, 695 bp, Panicum virgatum
  misc_feature: Ceres CLONE 2040661
  misc_feature: Encodes the peptide sequence at SEQ ID NO. 48108
agtgccgcgtcgcatcaatcaaggcagtctgcagctgaaactgaacagacgacgaaagcggaggaaaagccgagggaggcggaggcatagccttctccgacacatgacaagatccgcgcgaaatccaaatccaattgtgcacccgcctcctcttctcatggcccgcagctcgccggcggttttgctcctgctgttggcgctcgccggcgtggccgccgccggggacatcgtccaccaggacgacgaggccccgaagatccccggctgcgccaacgatttcgtcctggtaaaagtgcagacctgggtcaacaagaaagagaaagatgaatttgttggtgtaggtgctcggtttggccccaagatagagtcaaaggaaaagcatgccaaccgaacaagactgttgttagcacagccttctgattgctgcacccctcccacagcgaaggtttctggagatattttgttagtggagaggggactctgtaggttcactaaaaaagctaaggttgctgaatctgccggtgcttctgccattgtaatcatcaatgataagcatgagttatacaagatggtatgtgaccgcaatgaaacagatctagatattggtatacctgcggttcttctgccaaaagatgcaggctctaaattacgaagtcttctctcaagtggtgaagtcttagtgcagctgtactctc

SEQ ID NO: 48108 - protein, 179 aa, Panicum virgatum
  misc_feature: Ceres CLONE 2040661
  misc_feature (72)..(168): Pfam Name: PA Pfam Description: PA domain
MARSSPAVLLLLLALAGVAAAGDIVHQDDEAPKIPGCANDFVLVKVQTWVNKKEKDEFVGVGARFGPKIESKEKHANRTRLLLAQPSDCCTPPTAKVSGDILLVERGLCRFTKKAKVAESAGASAIVIINDKHELYKMVCDRNETDLDIGIPAVLLPKDAGSKLRSLLSSGEVLVQLYS

SEQ ID NO: 48109 - DNA, 530 bp, Panicum virgatum
  misc_feature: Ceres CLONE 2040675
  misc_feature: Encodes the peptide sequence at SEQ ID NO. 48110
  misc_feature (290)..(290): n is a, c, t, g, unknown, or other
  misc_feature (294)..(294): n is a, c, t, g, unknown, or other
  misc_feature (298)..(298): n is a, c, t, g, unknown, or other
  misc_feature (307)..(307): n is a, c, t, g, unknown, or other
  misc_feature (308)..(308): n is a, c, t, g, unknown, or other
  misc_feature (316)..(316): n is a, c, t, g, unknown, or other
  misc_feature (317)..(317): n is a, c, t, g, unknown, or other
  misc_feature (327)..(327): n is a, c, t, g, unknown, or other
  misc_feature (332)..(332): n is a, c, t, g, unknown, or other
  misc_feature (338)..(338): n is a, c, t, g, unknown, or other
  misc_feature (346)..(346): n is a, c, t, g, unknown, or other
aaactgccacacccgcacgcctccccagtcaaacacagctcagctcagctagcgaactcctcttatctacacagcccccaacgcacgccctgatccctgcttctccttggctgcttcccttctccctccctcctcccgctcgatcggtttcaccgttcactgtccgcgctctccagtctccacccgccgcggtcagcccggcagcgtcgtgctcctccgaccagtgactagtgtcgggaggtgagagaggtggggttgattgcaagtggggaggtggggtgggtgatgtncggntcgncggtgcccnnggacctcnncctgcccgcngcccngccgcngccgaccnggacgccgccgcggatgagctccccgggcctgctgcggtacaggtcggcgccgagcacgctgctcggcgaggtcatgtgcgggtatcacgacgtccacgccgccgcggcggccggcgcggcagggcacggcccggcgcacgccgcagcggacaacgtcctgacccggtttctcgccgggcacca

SEQ ID NO: 48110 - protein, 81 aa, Panicum virgatum
  misc_feature: Ceres CLONE 2040675
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature (2)..(2): Xaa is any aa, unknown, or other
  misc_feature (5)..(5): Xaa is any aa, unknown, or other
  misc_feature (8)..(8): Xaa is any aa, unknown, or other
  misc_feature (11)..(11): Xaa is any aa, unknown, or other
  misc_feature (16)..(16): Xaa is any aa, unknown, or other
  misc_feature (18)..(18): Xaa is any aa, unknown, or other
  misc_feature (21)..(21): Xaa is any aa, unknown, or other
MXGSXVPXDLXLPAAXPXPTXTPPRMSSPGLLRYRSAPSTLLGEVMCGYHDVHAAAAAGAAGHGPAHAAADNVLTRFLAGH

SEQ ID NO: 48111 - DNA, 599 bp, Panicum virgatum
  misc_feature: Ceres CLONE 2040683
  misc_feature: Encodes the peptide sequence at SEQ ID NO. 48112
aagatcgctcgcggcgctcgagcagcaacagcagccgggccgacgcggccggcgcgcacgacacgagcacgccggaggggacagaccagccagccacagccttgccggcagccgaaacgcaccccggcaggcgccagcccacgcgccgcgccacgaggaggaggtgccctccctcctccataaagagagacgccgccgcattccgctcgcgccgagcacgcgcggggcgggcaagcgtatgagcagcggcgctcgcggcgggccgggttcatggaggccgtgggcgacggagctgcagcgggggcgggggacggggcgccgcccagccggtcgcagcagggcgccaagcgcggccgcggcggcggcgtgaggggcggcgaggcggaggcggcgtggggcctgccgccggcgctgccgccgccgcagggcccgggggcgggctcgcggatctaccgcgtgcgggccagcgggggcaaggaccggcacagcaaggtgtacacggccaagggcatccgcgaccgccgcgtgcgcctgtcggagcccaccgccatccagttctacgacctgcaggaccgcctgggcttcgaccagcccaacaa

SEQ ID NO: 48112 - protein, 109 aa, Panicum virgatum
  misc_feature: Ceres CLONE 2040683
  misc_feature (53)..(109): Pfam Name: TCP Pfam Description: TCP family transcription factor
MEAVGDGAAAGAGDGAPPSRSQQGAKRGRGGGVRGGEAEAAWGLPPALPPPQGPGAGSRIYRVRASGGKDRHSKVYTAKGIRDRRVRLSEPTAIQFYDLQDRLGFDQPN

SEQ ID NO: 48113 - DNA, 657 bp, Panicum virgatum
  misc_feature: Ceres CLONE 2040690
  misc_feature: Encodes the peptide sequence at SEQ ID NO. 48114
gaaacaccccccggcggtccggcatccctcccatgtcgcagtagtgctgaccaaaaccctaaccctaaattcctccaccgacgccctcttcctgaggccgtatacatggacgcgaaggacattctcgggctcccgaagacccccttcgcgtcctctcaggagaagaagtcgcggccgcccaaggagccgcagcgcaagcccgatggcgtctcgcgcgaggtctatgcgctcacaggaggggtgggaatggccccgctcatgccgactatcgaggcatcacacctgaagcggcggcctgctgcggagaaggagaaggtagcatggcagtggttacctttcacatcctctgcgcgaactgacaaccttcaactctatcactgggttagagttgttaatggtgttccaccaactggtgactatcagtttgcaaaatataataaggcttggagtagggaggaaacagaccagctatttgaattatgtgaacggtttgaccttcgtttcatagtaatagcagataggtttccaacttctcgcagtgtggaagatctgaagagccgctactattctggtagtttaatcttgatatctctgtggtcagatagaatccgcttttgaaattcttccgtttctagccttctatgttttatagatgca

SEQ ID NO: 48114 - protein, 170 aa, Panicum virgatum
  misc_feature: Ceres CLONE 2040690
  misc_feature (111)..(157): Pfam Name: Myb_DNA-binding Pfam Description: Myb-like DNA-binding domain
MDAKDILGLPKTPFASSQEKKSRPPKEPQRKPDGVSREVYALTGGVGMAPLMPTIEASHLKRRPAAEKEKVAWQWLPFTSSARTDNLQLYHWVRVVNGVPPTGDYQFAKYNKAWSREETDQLFELCERFDLRFIVIADRFPTSRSVEDLKSRYYSGSLILISLWSDRIRF

SEQ ID NO: 48115 - DNA, 680 bp, Panicum virgatum
  misc_feature: Ceres CLONE 2040700
  misc_feature: Encodes the peptide sequence at SEQ ID NO. 48116
agtttcggcttctcttctcgggcgagggggaggccggcgccgcgaccatcgcgaggaagggaagtgaaggggcgcgttggatcccgctggattggattgggactggatcatcgcgggcagatgcgctgagctcctgccgggcggagtgagcgatgggcgaccttgctgatctcgcgtgcgcgggcgaggccgcgcgctcgcatctcgccagcggcggccgccgggacctgctggcggagctgctggagctcgcggcggcggacgacgccgcggggttccgggagaagctcgcggcggcaggcggcgatgcggagctggcggacggggtgggtctgtggtacggccggagcaaggcgtacgagccgcgcacgccgctgatggtggcggcgacgtacggcagcgcggcggttgtgtcgctgctgctcggcctgggatgcgtcgacgtcaaccggcgaccgggcgtcgacggcgctaccccgctgcactgcgccgcctccggcggctcgccgaacgccgtcgccatcgtcaaggtgctccttgctgccggcgccgacccggtcgcccccgacgccgccggccgcttccctgcggacgtcatcctggctcctcctgcttcgccggacgccttgggcgatctggagatgctccttggccgccgccgaggtctagctgtcgcgacc

SEQ ID NO: 48116 - protein, 175 aa, Panicum virgatum
  misc_feature: Ceres CLONE 2040700
  misc_feature (105)..(140): Pfam Name: Ank Pfam Description: Ankyrin repeat
  misc_feature: The sequence is a functional homolog of SEQ ID NO 230 in the 10/412,699 US patent application
MGDLADLACAGEAARSHLASGGRRDLLAELLELAAADDAAGFREKLAAAGGDAELADGVGLWYGRSKAYEPRTPLMVAATYGSAAVVSLLLGLGCVDVNRRPGVDGATPLHCAASGGSPNAVAIVKVLLAAGADPVAPDAAGRFPADVILAPPASPDALGDLEMLLGRRRGLAVA

SEQ ID NO: 48117 - DNA, 672 bp, Panicum virgatum
  misc_feature: Ceres CLONE 2040707
  misc_feature: Encodes the peptide sequence at SEQ ID NO. 48118
ggcaaaaaaaaaaaaacacaagccgaaaccctcgcctcgccctgccctgcccctcgccgccgccgccgccgcccgcagcagcgcccctcgtcccggccgtcctccggcccccgaagcgccgccgaaagccacagatccggccggatccgatgtcgggctcgtccgggcgcgcggccccgcggtacgcgccggacgacccgtcgttgcccaagccgtggcgcggcctcgtcgacggcaccaccggctacctctactactggaacccggagaccaacgtcacgcagtacgagaagcccaagcgccccgaggacgacctcccgccgcccccgcccccgctgcctcccccgcctccccggagccgcgaccgccgcgagaggtccagatcccgctcccgcaccccgccccggcgcgaccacagggaccgcgaccgtgaccgtgaccgcgacaggcgccacgacgagcacgcgtcgtccaagtcggcggcttcccaccaccatcctgctcccgccgccgctgccgtacccgatgatccgtccaccgaggcgtaccgccgccgccacgagatcaccgtcacgggggataacgtgccgcctcccataacttcatttgaggctggtggctttccgtcagaaattctgaaggaggtatgaaataccgttggtgaagcccttg

SEQ ID NO: 48118 - protein, 166 aa, Panicum virgatum
  misc_feature: Ceres CLONE 2040707
  misc_feature (19)..(49): Pfam Name: WW Pfam Description: WW domain
MSGSSGRAAPRYAPDDPSLPKPWRGLVDGTTGYLYYWNPETNVTQYEKPKRPEDDLPPPPPPLPPPPPRSRDRRERSRSRSRTPPRRDHRDRDRDRDRDRRHDEHASSKSAASHHHPAPAAAAVPDDPSTEAYRRRHEITVTGDNVPPPITSFEAGGFPSEILKEV

SEQ ID NO: 48119 - DNA, 455 bp, Panicum virgatum
  misc_feature: Ceres CLONE 2040710
  misc_feature: Encodes the peptide sequence at SEQ ID NO. 48120
accacacgccgagacttgctcttcttcttcttgttgttgaggaatagatagatagaattctggggcagccggggcccgagatcggcgaggagccgtccggccggccgtgcttgcttgcgccattgatacatccatccatctcatctactagagagggagttgtagcaccagatccacccaacacaatggagacccgggacagcgttccctccaccgcgccgctcccctacgcctactcgccgctcccggacgccgacgccgcctccgccgaggtctccagcagcgccaacggccgcctcaagcccctctgcgacgccgccctcctgctgtccgccgtgctgctcctggccgacacggccctggccggcgtcctcatcgagcccccccaccccatctctgagggagtggaagagacgacgaccgcggcgccggcggctgagaggatcaggggccac

SEQ ID NO: 48120 - protein, 89 aa, Panicum virgatum
  misc_feature: Ceres CLONE 2040710
  misc_feature: Functional homolog of the protein sequence given in SEQ ID NO 51130
  misc_feature: Useful for making plants with altered carbohydrate content
METRDSVPSTAPLPYAYSPLPDADAASAEVSSSANGRLKPLCDAALLLSAVLLLADTALAGVLIEPPHPISEGVEETTTAAPAAERIRG

SEQ ID NO: 48121 - DNA, 677 bp, Panicum virgatum
  misc_feature: Ceres CLONE 2040716
  misc_feature: Encodes the peptide sequence at SEQ ID NO. 48122
aggcggaggacgccgcactgtgccggcacctacctgagagcgacctccatcttccctgcctcgctcgctcgctcatccaactccaagcagctcggccatcgcactgcttgctggcatcttttatatccccggcctctcctgcagtcctgctgccctctccttcccaccctgctgcctgccaccatcgtatctcggcttcttagcttccacacagcgatcgatcatcgtcgaggacggtgatcggtggcggcgccgccgagcgcggccgaccgacgacatcgacggggttaagctgcttggtggctggctggctggctagcccggccggcatggcgaagcagtcgtgctgccacaagaagaagctgaggagagggctctggtcgcccgaggaggacgagaagctcatgaaccacattgccaagtacggccacggctgctggagctccgtcccgaagctcgcaggccttgagaggtgtggcaagagctgcaggctgaggtggataaactacctgaggccagacctcaagcggggcacattctcgcagcaggaggagaacctcatcatacacctccactccttgctgggaaacaagtggtctcagattgcggcgcagctgcccggccggacggacaacgaggtcaagaacttctggaactcgtacatcaagaagaggctc

SEQ ID NO: 48122 - protein, 115 aa, Panicum virgatum
  misc_feature: Ceres CLONE 2040716
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: Functional homolog of the protein sequence given in SEQ ID NO 50235
  misc_feature: Useful for biocontainment applications
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 51269
  misc_feature: Useful for making plants with modulated biomass
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: Functional homolog of the protein sequence given in SEQ ID NO 50609
  misc_feature: Useful for making plants with altered lignin content
  misc_feature: The sequence is a functional homolog of SEQ ID NO 1917 in the 10/374,780 US patent application
  misc_feature: Functional homolog of the protein sequence given in SEQ ID NO 50610
  misc_feature: Useful for making plants with altered cell wall content and/or composition
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: Functional homolog of the protein sequence given in SEQ ID NO 50784
  misc_feature: Useful for making plants with altered alkaloid content
  misc_feature: Useful for making plants with modulated nitrogen use efficiency
  misc_feature: The sequence is a functional homolog of SEQ ID NO 824 in the 10/412,699 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1004 in the 11/435,388 US patent application
  misc_feature: The sequence is a functional homolog of SEQ ID NO 1002 in the 11/435,388 US patent application
  misc_feature: The sequence is a functional homolog of SEQ ID NO 1010 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1073 in the 10/374,780 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 296 in the 11/479,226 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 442 in the 10/412,699 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 58 in the 10/666,642 US patent application
  misc_feature: The sequence is a functional homolog of SEQ ID NO 1863 in the 10/374,780 US patent application
  misc_feature: The sequence is a functional homolog of SEQ ID NO 822 in the 10/412,699 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 569 in the 10/374,780 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 836 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 271 in the 11/479,226 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 1681 in the 10/374,780 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 790 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 743 in the 10/666,642 US patent application
  misc_feature: Functional homolog of the protein sequence given in SEQ ID NO 50238
  misc_feature: Useful for making plants with altered terpenoid content
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 446 in the 10/412,699 US patent application
  misc_feature: The sequence is a functional homolog of SEQ ID NO 796 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1572 in the 10/374,780 US patent application
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1566 in the 10/374,780 US patent application
  misc_feature: The sequence is a functional homolog of SEQ ID NO 36 in US patent 7193132
  misc_feature: The sequence is a functional homolog of SEQ ID NO 2178 in the 10/374,780 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 186 in the 10/412,699 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: Functional homolog of the protein sequence given in SEQ ID NO 50241
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 126 in the 10/412,699 US patent application
  misc_feature: The sequence is a functional homolog of SEQ ID NO 1563 in the 10/374,780 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 1564 in the 10/374,780 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1565 in the 10/374,780 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 1692 in the 11/479,226 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 1075 in the 10/412,699 US patent application
  misc_feature: The sequence is a functional homolog of SEQ ID NO 591 in the 10/374,780 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
MAKQSCCHKKKLRRGLWSPEEDEKLMNHIAKYGHGCWSSVPKLAGLERCGKSCRLRWINYLRPDLKRGTFSQQEENLIIHLHSLLGNKWSQIAAQLPGRTDNEVKNFWNSYIKKR

SEQ ID NO: 48123 - DNA, 674 bp, Panicum virgatum
  misc_feature: Ceres CLONE 2040719
  misc_feature: Encodes the peptide sequence at SEQ ID NO. 48124
actccactccgctctgcactgtggcgaactcgcagtctcgcactactgcgctgcgcacgcacacgcgctgctcccctcccctcccctcccccctctctcgctcgcttaaatgccccaaccctaatcattcccaagccctctttctctctccccctctcccacctcgcagccccacctcctctttccctccctccccatacaccatggcgatctccgagctcgggtgagctgaccagaatgcggccgatttgaggaggcggcgggagggtgatggggggttccggccggattcttcgcgagggtactgtagagtaggtttcggttccggtggacgtgggaggaccggaggatgagctcgtcgtcggcggccagcatcggccagacgcagccgccgccgccggaggaagagaagaagtgcctcaactcggagctgtggcacgcgtgcgccggcccgctcgtctgcctccccaccgtcggcacgcgcgtcgtctacttcccgcagggccacagcgagcaggtggcagcgtcgacgaacaaggaggtggacgggcacatccccaactaccccaacctgccgccgcagctcatctgccagctacatgatgtcacaatgcatgcggatgtggagactgatgaagtgtacgctcagatgacgctgcagccgctgaacccac

SEQ ID NO: 48124 - protein, 108 aa, Panicum virgatum
  misc_feature: Ceres CLONE 2040719
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 100 in the 10/666,642 US patent application
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 298 in the 10/412,699 US patent application
MSSSSAASIGQTQPPPPEEEKKCLNSELWHACAGPLVCLPTVGTRVVYFPQGHSEQVAASTNKEVDGHIPNYPNLPPQLICQLHDVTMHADVETDEVYAQMTLQPLNP

SEQ ID NO: 48125 - DNA, 724 bp, Panicum virgatum
  misc_feature: Ceres CLONE 2040720
  misc_feature: Encodes the peptide sequence at SEQ ID NO. 48126
gctgccctctcgccatgtgatcgcgaccaccagaccagcggcagcggcagcggcagcaaccgccccgcggcgcggcacgggcacgggcacagcgctacgcaacaacaaaagcaggtcctctcgtctgtctcgtctcgtctgtctcgtctcgtcgtctccccctgtcccgcggctcgcctcacctcacctcacctcactccaccctcgttcgttggctgcctccccaccccacttccgcgcgcagaccgagggggcggcggcgatggggaagaacatgcgcatcaagacggcgcccaaggccaaccgcgtccccctcctcggcgacggggagacgtcgagggcgctctccgacctggaggagggcagcaacgtccagccgaaatatggtggcaagataattgacattgtgtcaagagatgttcggcgcccagaagataaggctcaagccttggaggacgtgaagggcacaatcttgtacattgtgataatcgttgtagtcggttcagtttgcacggctcttcgggcatggctattcaattctgctagtgagagagtagtcgctcgacttaggaaggacttgttcagtcatctcataaaccaggaaatagcgttttttgatgtgactaggacaggagagctcttaagcaggctttctgaagatacacagataataaagaatgctgctacaaccaacttatcagaggcactgcgcaatatcactact

SEQ ID NO: 48126 - protein, 153 aa, Panicum virgatum
  misc_feature: Ceres CLONE 2040720
  misc_feature: SWISSPROT Homolog: EC 3.6.3.44 Xenobiotic-transporting ATPase
MGKNMRIKTAPKANRVPLLGDGETSRALSDLEEGSNVQPKYGGKIIDIVSRDVRRPEDKAQALEDVKGTILYIVIIVVVGSVCTALRAWLFNSASERVVARLRKDLFSHLINQEIAFFDVTRTGELLSRLSEDTQIIKNAATTNLSEALRNIT

SEQ ID NO: 48127 - DNA, 549 bp, Panicum virgatum
  misc_feature: Ceres CLONE 2040729
  misc_feature: Encodes the peptide sequence at SEQ ID NO. 48128
aacatgttcttgtgccttgatcgttgatcatttcttaattttgttttccattcttgggtccccgtctatctgttggtcgaatcctcaggccataggaatcagatgggttttctaccctatacgattcatcctgtagcgaaagatggcgacccactttgttagataccctcccatggaccccaagaggaacctcaagttcgccctcgaatctttctgggatgggaacagcacccctgaggatctggagaaggtccccaccgacctcacggctagcatctggaagcagatggatgatgctgggatcgagtacatccccagccacgccttctcgtactatgaccaggtccttgaccccaccgccatacatggagcagtccccgaacgctactcatggattggtggggagattgggttcgatacctacttctcgttggacacgggcaacgccactgtccttgctatggaaatcaccaactactttgacacgcactaccactttatcgtccctgagttcgtccctaacaccaagttctcctactcttctcacaa

SEQ ID NO: 48128 - protein, 135 aa, Panicum virgatum
  misc_feature: Ceres CLONE 2040729
  misc_feature (2)..(135): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
MATHFVRYPPMDPKRNLKFALESFWDGNSTPEDLEKVPTDLTASIWKQMDDAGIEYIPSHAFSYYDQVLDPTAIHGAVPERYSWIGGEIGFDTYFSLDTGNATVLAMEITNYFDTHYHFIVPEFVPNTKFSYSSH

SEQ ID NO: 48129 - DNA, 672 bp, Panicum virgatum
  misc_feature: Ceres CLONE 2040775
  misc_feature: Encodes the peptide sequence at SEQ ID NO. 48130
agctcagcctcgggtctcccccctccctcgccctctctttctctctctctctgggacggcccttggtcttcgcgtgctgctgcccgcgttgtcggggaggcgccgccacgccgcgcacctagcaccgccgcccgagcaagtaggtggtagtaggtttctgccaagaacgtccaggccaggccggcggcggcgccatcttgctggcatcgacgcggcgcggcgcctctgcctgctccatgcttgaggagcagtgaagctcccgcgtggccgcgcgaccatgaagcagtccccggcgagctccggcgtcgcccccgcggccgcggccgcggccgcctccgccggcggggcgccacccgaaggggagcggaaggcgccggcgatcaacgcggacctgtggtacgcctgcgcgggcccgctcgtgtcgctgccgccggtgggcagcctcgtcgtctacttcccgcagggtcacagcgagcaggttgcagcttctatgcaaaaggatattgatgcgcatgtgccaagctacccaaatcttccctcgaagttgatatgtcttcttcacagtgttactttgcacgctgatccggacactgatgaggtgtatgctcagatgactcttcagccagtgaacacatatggaaaagaggctttacagctatccgagcttgcact

SEQ ID NO: 48130 - protein, 131 aa, Panicum virgatum
  misc_feature: Ceres CLONE 2040775
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
MKQSPASSGVAPAAAAAAASAGGAPPEGERKAPAINADLWYACAGPLVSLPPVGSLVVYFPQGHSEQVAASMQKDIDAHVPSYPNLPSKLICLLHSVTLHADPDTDEVYAQMTLQPVNTYGKEALQLSELA

SEQ ID NO: 48131 - DNA, 712 bp, Panicum virgatum
  misc_feature: Ceres CLONE 2040802
  misc_feature: Encodes the peptide sequence at SEQ ID NO. 48132
cccagccctcacctcctcttcccccagcgccgccgccacgcccccgccgccacacagcgcgagcacccccgccttctctctcgttctcccagagggtttcaggcgtcgtatgtaggagaagatggcgctggcaatctccatggaaggaatcgaggcgcgtgcgcgggagcttggggtggacctctccgccgtcgatctggactccatcaccctcccggccggcgaggacttcggcatcctcagtgatgatgaggagatacttcgagatgaggacccccctgaacttgaaatgggtttatccaacattatcgtagtggacaatctgccggttgttcctccagaaaaatttgagaagcttgagaatgtcattaggaagatatacagccaaattggagtgataaaagaaaatggtctatggatgccggtaaacccagagacaaagaaaacgtatggctactgtttcattgagtataatacccctcaggaagctgagcttgcaagggaaaaaaccaatgggtacaagctcgacaagtctcatatctttgcagttaacatgcttgatgactttgagaaatacatgaaggttcctgacacatggacgcctgcagaaataaagccatacactcctggagaaaatcttctgaaatggctaactgatgaaaaggcccgagatcaatttgtcatccgtgctggtacattgacagaagttact

SEQ ID NO: 48132 - protein, 196 aa, Panicum virgatum
  misc_feature: Ceres CLONE 2040802
  misc_feature (63)..(142): Pfam Name: RRM_1 Pfam Description: RNA recognition motif. (a.k.a. RRM, RBD, or RNP domain)
MALAISMEGIEARARELGVDLSAVDLDSITLPAGEDFGILSDDEEILRDEDPPELEMGLSNIIVVDNLPVVPPEKFEKLENVIRKIYSQIGVIKENGLWMPVNPETKKTYGYCFIEYNTPQEAELAREKTNGYKLDKSHIFAVNMLDDFEKYMKVPDTWTPAEIKPYTPGENLLKWLTDEKARDQFVIRAGTLTEV

SEQ ID NO: 48133 - DNA, 694 bp, Panicum virgatum
  misc_feature: Ceres CLONE 2040804
  misc_feature: Encodes the peptide sequence at SEQ ID NO. 48134
accaaaccctgcctcccccctccactgctctgctccggccagcctgtcccctcgccgtcacgagccgggcagccgcgcccacagcggggaaggagagccgcggatcgggatctcgcgccgccccttcgccggcgctgctgcattgcgcgggggaggagatgtggcggctgaaaatcgcggaggggggcggggacccctggctgcgcacgaagaacggccacgtcggccgccaggtctgggagttcgacgccgccgccgagcccgaccccgccgtcgacgccgcgcgccgggccttcgtcgagcggaagcacgacctcaagcacagcgccgacctcctcatgcgcctgcagttcgctaaagaaaatcctcttagcctggaccttccagcaatcaaactggacgagcatgaagatgttacggaggaagccgtagcaactactttgaaaagggcaatcagccgtttttctactctccaggcacatgatggacactggcctggggactatggtggccctatgttccttatgccaggcttgatcattacattgtatgtgactggagcactaaacactgtcatgtcatcagaacaccagaaagagatccgccgatatctttataatcatcagaatgaagatggcggctggggcttgcatatagagggtccaagcaccatgttcggctcagcactgacgta

SEQ ID NO: 48134 - protein, 178 aa, Panicum virgatum
  misc_feature: Ceres CLONE 2040804
  misc_feature: SWISSPROT Homolog: EC 5.4.99.8 Cycloartenol synthase
  misc_feature: The sequence is a functional homolog of SEQ ID NO 6 in US patent 7122717
  misc_feature: The sequence is a functional homolog of SEQ ID NO 15 in US patent 7186884
MWRLKIAEGGGDPWLRTKNGHVGRQVWEFDAAAEPDPAVDAARRAFVERKHDLKHSADLLMRLQFAKENPLSLDLPAIKLDEHEDVTEEAVATTLKRAISRFSTLQAHDGHWPGDYGGPMFLMPGLIITLYVTGALNTVMSSEHQKEIRRYLYNHQNEDGGWGLHIEGPSTMFGSALT

SEQ ID NO: 48135 - DNA, 692 bp, Panicum virgatum
  misc_feature: Ceres CLONE 2040852
  misc_feature: Encodes the peptide sequence at SEQ ID NO. 48136
gcgacggcaagctagggcgtcgtatgcgtcggcgccaccaccggaacggagggaagttgccagccgcgtgcacgtgagcagcagccaaaccaccgctgctctcccgccctccactcccggctccctcctcctggtatccctgcagctatcggccggcctccgctcctctctctccctcgtcccggtatcgttgcagcagtcggccggcctgccgccgctcctcttcctgccgtcaggcggccggctcggtttcactccgggtggtcatctcctcggttgttcagccgctgctgagggctgaagtgctcgcccaaagtgatggaaggtactagcattgctatcgagattgatggtgaggccatctgtcttgacagtgtcggagatgatgaacaagaagctcaggagaatggagagatggagcaaataatttacagtgctgaaaatggggagcaagtggccttcgacaaccaagagcagggaagggaagaagagcccacaggaaatgaagaggatagggaacatagttctataatcccaagccgtgaagagttaaccgaagaattgcggaataaagttgcatatagtgaggaagaagcttacaggatgtactgtgactatgggcaccgtatgggctttagtgttcgaaagggaaagcaatactacttttacaggaaccaaaaccatccgtacaa

SEQ ID NO: 48136 - protein, 124 aa, Panicum virgatum
  misc_feature: Ceres CLONE 2040852
  misc_feature: SWISSPROT Homolog: EC 3.1.2.15 Ubiquitin thiolesterase
MEGTSIAIEIDGEAICLDSVGDDEQEAQENGEMEQIIYSAENGEQVAFDNQEQGREEEPTGNEEDREHSSIIPSREELTEELRNKVAYSEEEAYRMYCDYGHRMGFSVRKGKQYYFYRNQNHPY

SEQ ID NO: 48137 - DNA, 673 bp, Panicum virgatum
  misc_feature: Ceres CLONE 2040857
  misc_feature: Encodes the peptide sequence at SEQ ID NO. 48138
gggataacccattcaagctaatgaaggaatccatcaagctgctatcgaagatcaaaggaactttcaggcatatagaggataaggagattcctgcaaatttggactggtttgggtggtgcacatgggatgcattttacaaagctgttaacccaacagggatcgaggagggccttcagagtctgcgcgaaggtggtgcgccaccgaggtttctgattatagatgatggttggcaagaaacagtggacgaattcaaggaagtggatgaaaccctccgtgagcagactgtgtttgcacagaggctgactgatctgaaggagaatcataagttcaggggagaaacctgcaagaatcttggggacctcatcaagaagatcaaagaaaaacatggagtcaagtaattgatttttataaaaatatttaatctagggtaactaaatcttcaaaaagaaaaaaaatctgagcaaactggtgcatgaaactacagatttgtttacatgtggcatgctttacttgggtattggggaggtgtcttagcaacatctgatgcgatgaagaagtacagcccaaagcttgcttacccagtccagtcaccaggtaatgttgccaatctgagggacattgccatggacagcttggagaaatttggagtgggcatcattgatcctgacaagat

SEQ ID NO: 48138 - protein, 131 aa, Panicum virgatum
  misc_feature: Ceres CLONE 2040857
  misc_feature: SWISSPROT Homolog: EC 2.4.1.67 Galactinol--raffinose galactosyltransferase
DNPFKLMKESIKLLSKIKGTFRHIEDKEIPANLDWFGWCTWDAFYKAVNPTGIEEGLQSLREGGAPPRFLIIDDGWQETVDEFKEVDETLREQTVFAQRLTDLKENHKFRGETCKNLGDLIKKIKEKHGVK

SEQ ID NO: 48139 - DNA, 712 bp, Panicum virgatum
  misc_feature: Ceres CLONE 2040867
  misc_feature: Encodes the peptide sequence at SEQ ID NO. 48140
accccaccagtccaccaccagcgaagatctcgtgctcgccgccctcattccccgcagcaaccagatcgccttccagaaccttctcgccgccgccgaagtcgaagccgaagcatggccggagtcggatcgaaggccctcgccgtggtcgccgtcctggcggccgccgccctctctgtggcctccgcggccgacgcgccggcgcccagccccgtctccgccgccggcgccgcggccccgcccctcgccgccgccctcgtcgcctccgccgcctccttgtgttcctgaatggttctgcgcacggagaagccaaccactccagtggcaatctgcagataatgcaaaagtcaccagtgattccagatggcgcatcccaatgtataaagtaccctatgcatcacctgtagcagtgcctcaagcacccccaggctatggaccttctccacattttccttatccaggccgcctcttgtcttctgggcatccatatggagatgtgtctggtaatatggagaactcagcgccacgtagtctccatagatggattcagtgtgatggttgtggagtgcaaccaattgtcggtccacgctacaaatctaatgtgaaagaagactacgatttgtgtgattcctgtttccatcgcatgggaaatgaagtggagtacaccaaaatagacaagcctatttttacccacaggttacggagagatcctcat

SEQ ID NO: 48140 - protein, 236 aa, Panicum virgatum
  misc_feature: Ceres CLONE 2040867
  misc_feature (177)..(220): Pfam Name: ZZ Pfam Description: Zinc finger, ZZ type
PHQSTTSEDLVLAALIPRSNQIAFQNLLAAAEVEAEAWPESDRRPSPWSPSWRPPPSLWPPRPTRRRPAPSPPPAPRPRPSPPPSSPPPPPCVPEWFCARRSQPLQWQSADNAKVTSDSRWRIPMYKVPYASPVAVPQAPPGYGPSPHFPYPGRLLSSGHPYGDVSGNMENSAPRSLHRWIQCDGCGVQPIVGPRYKSNVKEDYDLCDSCFHRMGNEVEYTKIDKPIFTHRLRRDP

SEQ ID NO: 48141 - DNA, 652 bp, Panicum virgatum
  misc_feature: Ceres CLONE 2040880
  misc_feature: Encodes the peptide sequence at SEQ ID NO. 48142
attttttcttgcacgcttctccctcctgtcacctccctctgccgcgctctctctctctgtgttaagtgcgtgcgtgaatcatcgcacacaaatagagagtagaggaggccgccaaggaatcgaagaagccagcatggcggagaaggtggtatgcgtgacgggcgccggcggcttcatcgcgtcgtggatcgtcaagctcctgctcgagcgcggctacaccgtccgtggcaccctccgcgacccagctgatcctaagaagatagaccatttgcgtgctctagatggatctgctgagaggctgcagctatttaaagcagatttattagaagaagggtcctttgatgccgtagttcagggttgtgaatgtgtattccacacagcttctccattctacaataacccaaaagatcctcaggtttttcccccttttccttgtttatttctagataaattgctgtaccatcagtagcaattcttttaggcaagaatttagatgatattcattgtctccttttcctgtcatatcatctttatagcaatttgtgtcttgttctcgttgaattttctttttaggttcttaattgttttgtagtaaaggaagcatgcttgttagacaatcacaaaacgttgcccatcattgacttttgtccag

SEQ ID NO: 48142 - protein, 111 aa, Panicum virgatum
  misc_feature: Ceres CLONE 2040880
  misc_feature: SWISSPROT Homolog: EC 1.1.1.219 Dihydrokaempferol 4-reductase
  misc_feature: Functional homolog of the protein sequence given in SEQ ID NO 51664
  misc_feature: Useful for making plants with altered carbohydrate content
  misc_feature: Functional homolog of the protein sequence given in SEQ ID NO 51420
  misc_feature: Useful for making plants with altered lignin content
  misc_feature: Functional homolog of the protein sequence given in SEQ ID NO 51537
  misc_feature: Useful for making plants with altered cell wall content and/or composition
MAEKVVCVTGAGGFIASWIVKLLLERGYTVRGTLRDPADPKKIDHLRALDGSAERLQLFKADLLEEGSFDAVVQGCECVFHTASPFYNNPKDPQVFPPFPCLFLDKLLYHQ

SEQ ID NO: 48143 - DNA, 703 bp, Panicum virgatum
  misc_feature: Ceres CLONE 2040886
  misc_feature: Encodes the peptide sequence at SEQ ID NO. 48144
ctctctctctctctctctccaccagctcccccgcgttccgttccttgcgccaccccttcgccggctccccgctctggccgatcccgcccgcccaaccgcccagcggcgcgcgcgccgacccggaccccgcggcgcggcgccgcgccggccaatgccgcgtgcctgaccctcggtttggggataccttccgttcggagctgcccgcccggtgccggcgagatccggggccggcgagatgcagcacgatcagcgcaagaagagttctgcggaggctgattttttcacagagtatggggacgcgagtcgatacaagattcaagaagtcattggtaagggaagctacggggtagtatgctccgcaatagatgtgcacacaggagagaaagtagcgatcaagaagatacatgacatctttgagcacatatctgatgctgctcggattcttcgcgagatcaagcttctgagactcctaagacatccggacattgttgagatcaaacatattatgttgcctccatcaagaagggacttcaaagatatttatgttgttttcgaacttatggagtctgatcttcaccaagttattaaggctaatgatgacttgacaaaggaacattatcagttctttctctaccaattgctccgtgctctgaaatacattcacacagctaatgtttatcatcgggacttgaagccaaagaat

SEQ ID NO: 48144 - protein, 155 aa, Panicum virgatum
  misc_feature: Ceres CLONE 2040886
  misc_feature (25)..(155): Pfam Name: Pkinase Pfam Description: Protein kinase domain
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MQHDQRKKSSAEADFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPK

SEQ ID NO: 48145 - DNA, 662 bp, Panicum virgatum
  misc_feature: Ceres CLONE 2040896
  misc_feature: Encodes the peptide sequence at SEQ ID NO. 48146
aggcattactgcctctgcggtacgaagcccacgtctccggccacctcaacgcctaaaggcaaaaccacccccgagtcccaaccgtcccatcccaccaccccgcgcactaccgccgcttccaccgcttctcggcatcgccacgcacggtgccatcactctcactcgctccctctcaccgagctcgctcaccaatggcggctcctcgctgcccgttccccatcctcatcctcctcgcgctgctggcgctgtcggcgccggcgctgctgcgagccgacggcgcggaggaggcgaggaagacgtacatcttccgcgtggaccaccgcgccaagccgtccgtgttccccacccacgcgcactggtacgcctccgcggccttcgcctcgtcccctgcggccgccccgctcgagccgctccacgtctacggcactgtcttccacggcttcgccgcgtccgtgccggcgtcccgcgccgccgagctgcggcgccacccggccgtgctcgcggccttcgaggaccgggtgcgcccgctgcacaccacccggtcgccgcagttcatgggcctccgcgcgcgcctcgggctctggtccctcgccgactacggctccgacgtcatcgtcggggtgctcgacacgggcgtctggcccgagcaccgcagcctgtcg

SEQ ID NO: 48146 - protein, 156 aa, Panicum virgatum
  misc_feature: Ceres CLONE 2040896
  misc_feature (35)..(114): Pfam Name: Subtilisin_N Pfam Description: Subtilisin N-terminal Region
  misc_feature: SWISSPROT Homolog: EC 3.4.21.25 Cucumisin
MAAPRCPFPILILLALLALSAPALLRADGAEEARKTYIFRVDHRAKPSVFPTHAHWYASAAFASSPAAAPLEPLHVYGTVFHGFAASVPASRAAELRRHPAVLAAFEDRVRPLHTTRSPQFMGLRARLGLWSLADYGSDVIVGVLDTGVWPEHRSL

SEQ ID NO: 48147 - DNA, 677 bp, Panicum virgatum
  misc_feature: Ceres CLONE 2040926
  misc_feature: Encodes the peptide sequence at SEQ ID NO. 48148
acgtgagtctcacgagcggtcgcggtcaccgtcactccctcccaactcacttcagtcacacgctcccgcccgtccgcctcttccccgactcccccagtccccccggccccaccgacgcctgcctgcggggtccagccgccggcggcggccgcgctcctccgtcctccctccgcgacgcttgcgacccgtccgtcctgcgcccagcggtccctcgtggcagcagcggggggcgagccggcggcgcccggggtcctctttgctctcgccggctgctggcagcccgccccctcgtcgtctagactggccgtgatgctcctggcgcgcaccctgcgctcccacctccgcccgccgctctccgtggcggcggcgttctcctcggcgccggcatcggcggccgcggcggaggcggagcgagcgatacgggacgggccccggaacgattggagcaggcctgcgatccaggccgtctacgactccccgctcctcgacttcctcttccacggggctcaggtccacagaaatgtgcacaaatttagagaagtgcagcaatgcacacttctttcaataaagactggtgggtgcagtgaagattgttcttactgccctcagtcatcaagatatgatactggattgaaggcccagaaattgatgaacaaagatgctgtcctagaagcagc

SEQ ID NO: 48148 - protein, 122 aa, Panicum virgatum
  misc_feature: Ceres CLONE 2040926
  misc_feature: SWISSPROT Homolog: EC 2.8.1.6 Biotin synthase
MLLARTLRSHLRPPLSVAAAFSSAPASAAAAEAERAIRDGPRNDWSRPAIQAVYDSPLLDFLFHGAQVHRNVHKFREVQQCTLLSIKTGGCSEDCSYCPQSSRYDTGLKAQKLMNKDAVLEA

SEQ ID NO: 48149 - DNA, 697 bp, Panicum virgatum
  misc_feature: Ceres CLONE 2040931
  misc_feature: Encodes the peptide sequence at SEQ ID NO. 48150
atccgaaagccaaagcgagtctcaccagtcaagagcgagttctagtagatctgttctgctgtttttagtttggaaagccttttagttccggcgatcatggaggacgagaggaacacccagcaccaccaggtcggcgaggccgccgatcaggtggaggtgaaggacaggggcatcctggacacccttctcggcaggaagaagcccgaggaccaggagaagaagcagcaggaggaggagctggcgaccggcatggcgaaggtcacggtggccgagcctgagaagcacgagcacaagaaggaggatcacgaggccggggagaagaaggagagcttcaacaatgtcaagcagtggctgaatgaaattgacaggtacgccagtgaaaatgtgaacaagcttttggtggggaacaagtgcgacttggctgagagcagagtagtttcttatgaggctggcaaggcccttgctgatgagatagggataccgttcctggagactagtgccaaggatgcaacgaatgtggagaaggcattcatgaccatggcaggagagataaagaacaggatggcaagtcaaccagctgcaagtggtgctagcaggcctgcaacagtacaaatgcggggtcagcctgttgctcagcaaagcagctgctgctcttgatcgactatctagatcgcagtagtgtgattgtgcagcaagc

SEQ ID NO: 48150 - protein, 186 aa, Panicum virgatum
  misc_feature: Ceres CLONE 2040931
  misc_feature (54)..(154): Pfam Name: Ras Pfam Description: Ras family
MEDERNTQHHQVGEAADQVEVKDRGILDTLLGRKKPEDQEKKQQEEELATGMAKVTVAEPEKHEHKKEDHEAGEKKESFNNVKQWLNEIDRYASENVNKLLVGNKCDLAESRVVSYEAGKALADEIGIPFLETSAKDATNVEKAFMTMAGEIKNRMASQPAASGASRPATVQMRGQPVAQQSSCCS

SEQ ID NO: 48151 - DNA, 741 bp, Panicum virgatum
  misc_feature: Ceres CLONE 2040940
  misc_feature: Encodes the peptide sequence at SEQ ID NO. 48152
tgctcatcatcaccacccacctctcctcccctccgccgcgacctcctcgtcccccggcgctactcccccgctccacggtccaaggaaagatggcatcccatattgttggttaccctcgcatgggccccaagagggagctcaagtttgccttggagtctttctgggatgggaagagcagcgctgaggatttggagaaagttgccactgacctcaagtctagcatctggaagcaaatgtcagaagctgggatcaagtacattcccagcaacaccttctcatactatgaccaggtccttgatacgacggccatgcttggcgctgtcccagaacggtactcttggaccggaggtgagattggcctgagcacctacttctcaatggccaggggaaatgccactgttcctgctatggagatgacaaagtggtttgacacaaactaccacttcattgtccctgaacttggcccgagcaccaagttctcatatgcttctcacaaggctgtctccgaatacaaggaggcaaaggcgcttggcattgatactgtcccagtgcttattggaccagtctcctacttgttgctctctaagcctgccaagggtgtggagaagtcattctctcttctttcacttcttggtagcatccttcccatctacaaggaggttgtcgctgagctgaaggcagctggtgcttcatggattcaatttgatgagcctacccttgtttaagactttgatgctcatg

SEQ ID NO: 48152 - protein, 211 aa, Panicum virgatum
  misc_feature: Ceres CLONE 2040940
  misc_feature (2)..(211): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
MASHIVGYPRMGPKRELKFALESFWDGKSSAEDLEKVATDLKSSIWKQMSEAGIKYIPSNTFSYYDQVLDTTAMLGAVPERYSWTGGEIGLSTYFSMARGNATVPAMEMTKWFDTNYHFIVPELGPSTKFSYASHKAVSEYKEAKALGIDTVPVLIGPVSYLLLSKPAKGVEKSFSLLSLLGSILPIYKEVVAELKAAGASWIQFDEPTLV

SEQ ID NO: 48153 - DNA, 640 bp, Panicum virgatum
  misc_feature: Ceres CLONE 2040947
  misc_feature: Encodes the peptide sequence at SEQ ID NO. 48154
aaaaaaaaaaaaaaaaaaaagtctgtccctcccgctctgctccgcacactcggtgcaggtgcaggtgcagcgtcgtcccctgctttgctccccacaccacccagcgcccgcattgccgccggtgagcggaggcggaccgcccgcggcggcgcgggggaggaaccaggaggaggagggcgcgggaagagaggcggcaggatgttcgggcgggacccgtggggcgggccgctggagatctccaacgccgactcggcgacggacgacgaccggagccgggacctggaccgggcggcgctgatgcggcagctcgacgagacgcagcagagctggctcctcgccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcgtcatgatgatcgtcaaactcgtaccgcacaagcgcccgccgccgccgccgcccgaccagtacacgcaggcgctgcacaaggcgctcatgttcttcaacgcccagcgatctggtccgctgcccaagcacaacggcgtcagctggaggggcaattcctgcatgaaggatggtctct

SEQ ID NO: 48154 - protein, 147 aa, Panicum virgatum
  misc_feature: Ceres CLONE 2040947
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
MFGRDPWGGPLEISNADSATDDDRSRDLDRAALMRQLDETQQSWLLAGPGDQAGKKKKKYVDLGCVVLDRKIFMWTVGTILGLGVFIGFVMMIVKLVPHKRPPPPPPDQYTQALHKALMFFNAQRSGPLPKHNGVSWRGNSCMKDGL

SEQ ID NO: 48155 - DNA, 638 bp, Panicum virgatum
  misc_feature: Ceres CLONE 2040956
  misc_feature: Encodes the peptide sequence at SEQ ID NO. 48156
gtccctgtctcgccgtctcctttctcctctcccccactggcactctccaccgagcagcgcgaatccttagcggccaaggctttccgagctcagctcggggagttttaaacgcggcccgaggaaaggaggatcgcactcgctgccgggctgctgctggtcgcttgctttcggtggcgagcgtctcggtaaagcggcggctgcggcagagattggacttgctggttgcgcagtgcagtgctgccgtggagacaggaatctgccgcagatcagagtaacgtgctcgactttgtcaccttcatcctctggggtcgctcggcagctgatgcccgcgttgggggattgttgaagggataaggtcgtggcaatgagcaagccggcgcgcgtgcagcgcgcgtcctcgccgcccctggttgcttcggccgtcatcttgctgctatcctccgctttaccgcgctgtcagccatacacttacgagcaagatgtgtttgcgataaatggcttgtacacggcgcttggagcaccgcagctgccaaattggactgcaaatggcggtgatccctgcaatgagggctggcagggtgtttcatgcgtggcctcaaatattacctccataattctcagcggtgcaaccctggggt

SEQ ID NO: 48156 - protein, 91 aa, Panicum virgatum
  misc_feature: Ceres CLONE 2040956
  misc_feature (36)..(76): Pfam Name: LRRNT_2 Pfam Description: Leucine rich repeat N-terminal domain
  misc_feature: Functional homolog of the protein sequence given in SEQ ID NO 50266
  misc_feature: Useful for making plants with altered cell wall content and/or composition
MSKPARVQRASSPPLVASAVILLLSSALPRCQPYTYEQDVFAINGLYTALGAPQLPNWTANGGDPCNEGWQGVSCVASNITSIILSGATLG

SEQ ID NO: 48157 - DNA, 677 bp, Panicum virgatum
  misc_feature: Ceres CLONE 2040994
  misc_feature: Encodes the peptide sequence at SEQ ID NO. 48158
atttgtccctgatccttgtgcttcgttcctgttgcgcttttctcgggccatcggtggactgacgggacgggagggaggaagaagaagaaggccactccctccgcaggcggggagaggagccctcgccattggctctccccgatcttcttactccaatcacaggcagtcgggttttacctgttttggtcccttcagccgcatatggattatggtgcttgctcccaacacttgtgttgagcaaccagagctgagatggaaggccatgtagggatgcaggaggggaaggatcctgatccaggcccattatccttgatgtggggcttccagaccgaagcatttctaacagacaccgaggttgccaatgccggatttgagaaggatggcttgtcggtcgccataaggtcacctcaggaggaaggtccgtcgctgccaatgaccccgcagtttggccagaagtccagtccaggcagcaccctcgctgagaggatgcaggcaagagctgggttcagggtgccaaagctcagcatgccgtccagtacagcagttgcagctgataacaaagtgccaggagctccatcgccctacctcacgatcccgcctggtttgagcccggcaacgctgctggattcaccagtcttcatttccaatgccatgggccaagcctcaccgaccacagg

SEQ ID NO: 48158 - protein, 141 aa, Panicum virgatum
  misc_feature: Ceres CLONE 2040994
  misc_feature: The sequence is a functional homolog of SEQ ID NO 1388 in the 10/412,699 US patent application
  misc_feature: The sequence is a functional homolog of SEQ ID NO 512 in the 10/374,780 US patent application
MEGHVGMQEGKDPDPGPLSLMWGFQTEAFLTDTEVANAGFEKDGLSVAIRSPQEEGPSLPMTPQFGQKSSPGSTLAERMQARAGFRVPKLSMPSSTAVAADNKVPGAPSPYLTIPPGLSPATLLDSPVFISNAMGQASPTT

SEQ ID NO: 48159 - DNA, 620 bp, Panicum virgatum
  misc_feature: Ceres CLONE 2041001
  misc_feature: Encodes the peptide sequence at SEQ ID NO. 48160
gctaccaacttccacaaaaccccaagcggtgcccaagtcatctcctagctcttgccatcatctccaacctgcctcggcatcccattccctcctccattgctggtacctccgaatctgaaacgctctcccggggaggtgagtgaattgtctgttgggagtggcgtaggctgcagcctgcagagcaagccagccatgaggcttcctctgctggccgcggtgtgctgcgccctcctggcgagcgccgcggcggcgaaggcccggcacttcaagtgggagatcagcaacatgttctggtcgccggactgcgaggagaaggtggtgatcggcatcaacgggcagttccccggcccgaccatccgcgcccgcgccggcgacaccatccacgtcgagctcaagaacgcgctccacaccgagggcgtcgtcatccactggcacggcatcagacagatcgggacgccgtggatggacggcacggcggcgatctcccagtgcgccatcaaccctgaagaaaccttcacctaccgcttcgtcgtcgacaagccggggacgtacttctaccacgggcactacgggatgcagagggcggcggggctgtacgggtcgctgatcgtcgacggtgg

SEQ ID NO: 48160 - protein, 142 aa, Panicum virgatum
  misc_feature: Ceres CLONE 2041001
  misc_feature (28)..(142): Pfam Name: Cu-oxidase_3 Pfam Description: Multicopper oxidase
  misc_feature: SWISSPROT Homolog: EC 1.10.3.3 L-ascorbate oxidase
MRLPLLAAVCCALLASAAAAKARHFKWEISNMFWSPDCEEKVVIGINGQFPGPTIRARAGDTIHVELKNALHTEGVVIHWHGIRQIGTPWMDGTAAISQCAINPEETFTYRFVVDKPGTYFYHGHYGMQRAAGLYGSLIVDG

SEQ ID NO: 48161 - DNA, 698 bp, Panicum virgatum
  misc_feature: Ceres CLONE 2041002
  misc_feature: Encodes the peptide sequence at SEQ ID NO. 48162
acacccgcgccacctctgctccctccctccctcaagcggagagctcctctctcccctcccctcccctccccttcctctgctaccaccaccaccaccaccaccttcccagagcacagagctcgcacacagcagcaggtccgctcctcattcccggttggtcccctcttcctcccccgccggtcggcctcttctctctcgcctcgagagagaggaagccgcgcgccgcgacacgcgggcagcgggaaccgggcgggcattatggcgcccggcggcggagacgcccggcggaacggcgagcagcaggcggcgggcggccggcaggggtgcgcgtgcgggttccccgtgtgcgcgtgcgcgggcgccgcggcggtggcctccgcggcgtcctccgccgacatggaccgcgcggcggtggccgccaccgagggccagatcggcgccgtcaacgacgagagctgggtcgccgtcgacctcagcgacgacctctccggcgacggcgccgacgacggcgtcgccatcgaggaccgcgccgtcttccgcaccgagaagatcaagggcgtcctgctccacccatacagggtgctcatcttcgtgcggctgatcgcgttcacgctgttcgtgatctggcgcatctcgcaccggaacccggacgcgctgtggctgtgggtgacgtcgatcgccggcgagttctggttcgg

SEQ ID NO: 48162 - protein, 146 aa, Panicum virgatum
  misc_feature: Ceres CLONE 2041002
  misc_feature: SWISSPROT Homolog: EC 2.4.1.12 Cellulose synthase (UDP-forming)
MAPGGGDARRNGEQQAAGGRQGCACGFPVCACAGAAAVASAASSADMDRAAVAATEGQIGAVNDESWVAVDLSDDLSGDGADDGVAIEDRAVFRTEKIKGVLLHPYRVLIFVRLIAFTLFVIWRISHRNPDALWLWVTSIAGEFWF

SEQ ID NO: 48163 - DNA, 646 bp, Panicum virgatum
  misc_feature: Ceres CLONE 2041009
  misc_feature: Encodes the peptide sequence at SEQ ID NO. 48164
atccgcgtcgattgattcttcacccaagacggggaagaacatggagctcaattttgcacctgccagagtgtctgacaagaacactgttttgggaaaggtttatgatgccagaacctccccatcatcagtgatagccgtaagtagtggagagccggtgcttagcctgaaacttggcaagagaacctattttgaagacgtctgtggagggcagagtgtcaagagttctccgtcggatacaagtgcagtgactcctgctttggtgaagaaggcaaaggcagcacaaaacgcacagaacacctactgtcaggttgaaggttgcgagattgatctctcttctgctaaagattaccatcgaaagcacaaagtctgtgaagctcactctaaggctcccaaggtggttgtcgctggtgtggagcggcggttttgccaacagtgtagccggttccatggtttagatctcttcgaccagaaaaaacgaagctgccgcaggcgtctcaatgatcacaatgcccgcagacggaagccacagcctgaagcaatttcttttggttcatcaaggctctctgcaatgttctatggtactgataagtgtttggttgccttgtggttttgtgaaaccagtgcattaatcactgtttttctttaa

SEQ ID NO: 48164 - protein, 214 aa, Panicum virgatum
  misc_feature: Ceres CLONE 2041009
  misc_feature (100)..(178): Pfam Name: SBP Pfam Description: SBP domain
  misc_feature: Functional homolog of the protein sequence given in SEQ ID NO 50782
  misc_feature: Useful for making plants with altered terpenoid content
  misc_feature: Useful for making plants with modulated flowering time
SASIDSSPKTGKNMELNFAPARVSDKNTVLGKVYDARTSPSSVIAVSSGEPVLSLKLGKRTYFEDVCGGQSVKSSPSDTSAVTPALVKKAKAAQNAQNTYCQVEGCEIDLSSAKDYHRKHKVCEAHSKAPKVVVAGVERRFCQQCSRFHGLDLFDQKKRSCRRRLNDHNARRRKPQPEAISFGSSRLSAMFYGTDKCLVALWFCETSALITVFL

SEQ ID NO: 48165 - DNA, 711 bp, Panicum virgatum
  misc_feature: Ceres CLONE 2041022
  misc_feature: Encodes the peptide sequence at SEQ ID NO. 48166
aatccgcgaggtgaatctctaatccgagctcctgccctcctgttccgccctgaattcgaggttcccccgcgctctcccccagtcgggcggcgagttttagcttcagcaattcgacccgtggttcgaggattaggcgaactggtttgcctgtgccgtgtttcgctcgaattcgtaggcagatatggcttcaacattcggtgccacttctacggttggccttatggctactccaacaggtaagaatgtgcgccttcagaggagggctaacttcagagtaaaagcagctaaggagctgtacttcaacaaggatggctcagctatcaagaagctccagactggagttaacaagcttgcagacctagttggagttacactgggaccaaagggaaggaatgtggttctggagagcaagtatgggtctcctaagattgttaacgatggtgttacagttgcaagagaggttgagctggaggatccggttgaaaacattggagctaaattggttaggcaagctgcagctaagaccaatgatctagctggagatgggacaactacttctgtggtccttgctcaggggctgatagctgagggtgttaaggttgtggcagctggtgctaatcctgttcagattacccgtggtattgagaaaacagcgaaagcactagttgaggaactacgaaagctttcaaaggaagttgaagacagcgagct

SEQ ID NO: 48166 - protein, 176 aa, Panicum virgatum
  misc_feature: Ceres CLONE 2041022
  misc_feature: Functional homolog of the protein sequence given in SEQ ID NO 50704
  misc_feature: Useful for making plants with modulated nitrogen use efficiency
MASTFGATSTVGLMATPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSE

SEQ ID NO: 48167 - DNA, 612 bp, Panicum virgatum
  misc_feature: Ceres CLONE 2041032
  misc_feature: Encodes the peptide sequence at SEQ ID NO. 48168
accgaaacactccgcccgccgcggcgttccccccactccctgtccgtcctcgccctcgggcctcggccaccacacttcgctctcgctcgctccccgccgccgcgtaccgctattaataccaccacctcctccgccagacggccaccaccgcgctccatacaaactcagctccgaccgaccatggccgccgccgcggcctcattcgccgcccttccgtgcctcctgctggtgctgctgctgccgtcgctcggcgccgccgccaatgtgacgtacgaccaccgctccctcatcatcgacggccgccgccgcctcgtcatctccacctccatccactacccccgcagcgtccccgagatgtggcccaagctggtggccgaggccaaggacggcggcgccgactgcatcgagacctacgtcttctggaacggccatgagatcgccccaggccagtactacttcgaggataggttcgacctggtgcggttcgtgaaggtcgtcagggacgccggcctgctcttgatcctgcgcattggcccgttcgtcgccgcggagtggaactttggaggcgtgccggtgtggttgcattacgtgccaggaacggttttccgtacg

SEQ ID NO: 48168 - protein, 143 aa, Panicum virgatum
  misc_feature: Ceres CLONE 2041032
  misc_feature (35)..(143): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51738
  misc_feature: Useful for making plants with altered cell wall content and/or composition
  misc_feature: Functional homolog of the protein sequence given in SEQ ID NO 51152
  misc_feature: Useful for making plants with altered carbohydrate content
MAAAAASFAALPCLLLVLLLPSLGAAANVTYDHRSLIIDGRRRLVISTSIHYPRSVPEMWPKLVAEAKDGGADCIETYVFWNGHEIAPGQYYFEDRFDLVRFVKVVRDAGLLLILRIGPFVAAEWNFGGVPVWLHYVPGTVFR

SEQ ID NO: 48169 - DNA, 682 bp, Panicum virgatum
  misc_feature: Ceres CLONE 2041052
  misc_feature: Encodes the peptide sequence at SEQ ID NO. 48170
gccaacccagcacaaccccattcgcatcgcatcgcagcgcgtcgcggcgagcgagcggcagctcgggaagaagaaaaaggaaggaaagccaggggaagcgggcgcgacccgcgcacgaccaccgccacccgcctcccctcccgtcgagtggaatccccgtggactccccccgcccccgcctccgcctccgccgacgcgcctcgccggggcgcgcacccgccgatctgcaccgccggccccgcctgcctcctcaggtatccaaccgaggaggacatagagctgggcacaagaagcttgatttgaaagggagccatgaagaaggtgttcaatcaaacggtccgggacataaaaagagaggtgaataagaatgtcctcaaggttcccagaatagaacaaaagattcttgacgccacaagcaacgagccatggggcccacatggatctctcctggcagacattgctcaagcaacgcataactatcatgagtatcagatgatcatgaatattgtgtggaagaggatcaatgacactggtaaaaattggcggcatgtctacaagggattgattgtcttggattacctggttgcgcatggtaccgagcgggttattgatgacataagagagcatgcttatcagatatcgacacttgctgacttccagtacattgattcttctgggagag

SEQ ID NO: 48170 - protein, 123 aa, Panicum virgatum
  misc_feature: Ceres CLONE 2041052
  misc_feature (23)..(123): Pfam Name: ENTH Pfam Description: ENTH domain
MKKVFNQTVRDIKREVNKNVLKVPRIEQKILDATSNEPWGPHGSLLADIAQATHNYHEYQMIMNIVWKRINDTGKNWRHVYKGLIVLDYLVAHGTERVIDDIREHAYQISTLADFQYIDSSGR

SEQ ID NO: 48171 - DNA, 662 bp, Panicum virgatum
  misc_feature: Ceres CLONE 2041053
  misc_feature: Encodes the peptide sequence at SEQ ID NO. 48172
tttagcatcaactaagatcatcgatgttgttactgcgaaggatattccacgtggaggagaaaatattggatcttccttcgtgtttggggatgagccattgtttggtgatccaattgctgagtatgctggacaagctctaggcattgtgattgcagaaacacagaggtatgctgacatggcagctaagcaggttattattgaatatgacacaaaagatttgagtccaccggtcttaactgtggaacaagctgtggaaaacagtagctacttcagtattccccaagaatattctcctaaagaagttggtgatttcgcaaggggcatggcagaagctaatcacaagatcccagcagcagaagtaaaactggcctctgagtactacttctacatggaaacacaaacagcacttgcaattccagatgaggataataccttggtagtctacagttcgtcgcagtatcctgagtttgcgcaacgtgtcatagcaaggtgcctgggcattccattcagtaatgtgcgtgtcattacaagaagggttggaggaggctttggaggaaaggcattcagatcattccaagtcgcaacggcagctgcactttgtgcatacaagctacgacgtcctgtccgaatgtaccttaatcgcaacactgatatggtaatgg

SEQ ID NO: 48172 - protein, 220 aa, Panicum virgatum
  misc_feature: Ceres CLONE 2041053
  misc_feature (1)..(72): Pfam Name: Ald_Xan_dh_C Pfam Description: Aldehyde oxidase and xanthine dehydrogenase, a/b hammerhead domain
  misc_feature: SWISSPROT Homolog: EC 1.2.3.1 Aldehyde oxidase
LASTKIIDVVTAKDIPRGGENIGSSFVFGDEPLFGDPIAEYAGQALGIVIAETQRYADMAAKQVIIEYDTKDLSPPVLTVEQAVENSSYFSIPQEYSPKEVGDFARGMAEANHKIPAAEVKLASEYYFYMETQTALAIPDEDNTLVVYSSSQYPEFAQRVIARCLGIPFSNVRVITRRVGGGFGGKAFRSFQVATAAALCAYKLRRPVRMYLNRNTDMVM

SEQ ID NO: 48173 - DNA, 626 bp, Panicum virgatum
  misc_feature: Ceres CLONE 2041061
  misc_feature: Encodes the peptide sequence at SEQ ID NO. 48174
agcccactccccgctgctccctcactccctctccccctctccctctcttccatggcgttctccgacgaggcggcggcggcgacgtagacgggtgcatcctggctgggcagcggagaagaaggcgccattggaagctcggaggccgtcacccgcagatttgaaaaccacatccctccctggaagctcctctcttccctcccaatcgcctacacacggcgtctctcggaacatcagggggcgcctcttgcaattcgacggccagaaaaagtgagggaaaaaaaaactcagccctttcttgctgctggtcgtgcccgtggagtcgcaccaatgcggcctctcgcgctgctgattgtcgcccacctcgccgccctcctggcggtggctgccgccaagggcggcgcggcgggggcggggctgaacgacgatgtgctggggctgatcgtgttcaaggccgacgtgtcggacccggagggccgcctcgcgacgtggagcgaggacgacgagcggccctgcgcctgggacggcgtcacctgcgagccccgcaccggccgcgtctcggcgctctccctcgccggcttcggcctctccggcaagctcggccggggcctcctccgcctcgaggcgct

SEQ ID NO: 48174 - protein, 99 aa, Panicum virgatum
  misc_feature: Ceres CLONE 2041061
  misc_feature (30)..(70): Pfam Name: LRRNT_2 Pfam Description: Leucine rich repeat N-terminal domain
MRPLALLIVAHLAALLAVAAAKGGAAGAGLNDDVLGLIVFKADVSDPEGRLATWSEDDERPCAWDGVTCEPRTGRVSALSLAGFGLSGKLGRGLLRLEA

SEQ ID NO: 48175 - DNA, 553 bp, Panicum virgatum
  misc_feature: Ceres CLONE 2041084
  misc_feature: Encodes the peptide sequence at SEQ ID NO. 48176
caccacggctggcgcctccgccagccaactgcgtctggtttgttctcgtctagccgctccgccgcctcaccatgaaaccctggagtccggcgcacgacatggcggatcgctcgggctctgcttcgggcctggaggagaagctctcggggctctctacgggcggctgcacctactattagcatgactccctccgggtgcgggtgagggcggagaagaacctcgactctcgaagaagcgaagaagagagaggagaataggaataagatggaggatgagcggaggctctaggaggaagagaacaagaacgaggtggctgctgctgctgctgccactgcaaagactcacaatgcatctgctgccgacaatgatgacatggatcccactcgatactatgagaataagctcaagacacttgattcgctcgaggtcataggtgtaaacccctatccgcatatcttcccagttggcatctgcgtatccaaatacgttgatatgtacaagaacttgagcgatggggataagctagatgtgacagagtgtttagctgggaaga

SEQ ID NO: 48176 - protein, 60 aa, Panicum virgatum
  misc_feature: Ceres CLONE 2041084
  misc_feature: SWISSPROT Homolog: EC 6.1.1.6 Lysine--tRNA ligase
MDPTRYYENKLKTLDSLEVIGVNPYPHIFPVGICVSKYVDMYKNLSDGDKLDVTECLAGK

SEQ ID NO: 48177 - DNA, 585 bp, Panicum virgatum
  misc_feature: Ceres CLONE 2041088
  misc_feature: Encodes the peptide sequence at SEQ ID NO. 48178
acccccgccccgcctgtccgaatcgcgcgccccggtcgagtttcgcgagggaccgagatggcgtccgagctcacctaccgcggcggcggggcgtccccggtcgccggcgccggcgccggcgcggagggatactccgcgaagccgtccaagccgctcgcgtggctgccccgcgccgcgcgctacgccgctgccgagcaccgcccggtcttcgcgctcgccgggatgctcatcgccgccgccgtcatctgcatcgcctccccgtccgctccctcctcctcctccgccgccgccgtgtcctcctactcctcctcctcctccggcattaccaacaacccgctcgcccgcttctccgtcgagccggcggcgcgccaccgcgagctggccggcgcgcggcacttcgtcggcggcaaggtgccgctgggcctcaagcgcaaggcgctccgcgtgctcgtcaccggcggcgccggcttcgtcggcagccacctcgtcgaccgcctcctcgagcgcggcgacagcgtcatcgtcgtcgacaacctcttcaccggccgcaaggacaacgtcgtgcaccacttcgcctaccccaac

SEQ ID NO: 48178 - protein, 175 aa, Panicum virgatum
  misc_feature: Ceres CLONE 2041088
  misc_feature (129)..(170): SWISSPROT Homolog: EC 4.1.1.35 UDP-glucuronate decarboxylase
  misc_feature (125)..(159): SWISSPROT Homolog: EC 5.1.3.6 UDP-glucuronate 4-epimerase
  misc_feature: Functional homolog of the protein sequence given in SEQ ID NO 50981
  misc_feature: Useful for making plants with altered carbohydrate content
MASELTYRGGGASPVAGAGAGAEGYSAKPSKPLAWLPRAARYAAAEHRPVFALAGMLIAAAVICIASPSAPSSSSAAAVSSYSSSSSGITNNPLARFSVEPAARHRELAGARHFVGGKVPLGLKRKALRVLVTGGAGFVGSHLVDRLLERGDSVIVVDNLFTGRKDNVVHHFAYP

SEQ ID NO: 48179 - DNA, 728 bp, Panicum virgatum
  misc_feature: Ceres CLONE 2041113
  misc_feature: Encodes the peptide sequence at SEQ ID NO. 48180
ctcggcttcggctcgctcctcttgatttcatcctcgcccacccaacccaatcccccttgtccactccgtttctcttccccacgaatctcccccgccggttcccgacccgccgccgtcgctcctcctcctcctcctcctcctggttcgccgccatgttggaggagctgctcatcttcacgcggggcggcctcatcctctggtcctcgtgccgggcgctcggcgccgccgccctcaagggctcgcccatcgacgccctcatccgatcctgcctcctcgaggagcgctccgccgacgccagcttctcccaggacaactacgccctcaagtggaccttccacaacgacctcggcctcgtctttgtcgccgtctaccagaagattctgcatcttctctacgtcgatgatctcctcgccgccgtccgcaaggacttctcccagatttatgatcccaagcgcaccaactacgacgacttcaccgacatattccgccagctccatctcgaggcccaggcgcgtgccgaggacatgaagaagtccaagcaggccatttcgtcccgtacgctgccagccgtctcccacaagactgctcccaaggctcgcggcgctgctgcccgtgctaccagcaagggcaaggatgactctgatggggactcggagcaccacgctttggcaaatggtaccttcacggggcaccagagtgctgcacccaacgacagcttctctggttaa

SEQ ID NO: 48180 - protein, 191 aa, Panicum virgatum
  misc_feature: Ceres CLONE 2041113
  misc_feature (27)..(187): Pfam Name: SRP-alpha_N Pfam Description: Signal recognition particle, alpha subunit, N-terminal
MLEELLIFTRGGLILWSSCRALGAAALKGSPIDALIRSCLLEERSADASFSQDNYALKWTFHNDLGLVFVAVYQKILHLLYVDDLLAAVRKDFSQIYDPKRTNYDDFTDIFRQLHLEAQARAEDMKKSKQAISSRTLPAVSHKTAPKARGAAARATSKGKDDSDGDSEHHALANGTFTGHQSAAPNDSFSG

SEQ ID NO: 48181 - DNA, 700 bp, Panicum virgatum
  misc_feature: Ceres CLONE 2041117
  misc_feature: Encodes the peptide sequence at SEQ ID NO. 48182
cttcttcccaccgccgccgccgccgaccaccaccacaggcgggacatggcgctctaccgccgcctcctgctcctccgccgcctgtcccacctccaccccgcgtccttccccgcccccgcggtcggatcctcgccaccgcccaccctcgcgggcctcctcacccccacggggcgccgccacttcgccttctcctccgccgaggaggccgccgccgagcgccgccgccgcaagcgccgactccgcgtcgagccgccgttgaacgccctccgccgcgggccgcctcccccgcgggacccccgccaacccgacaccacctccgcgctcgtgggcccgcgcctcagcctccacaaccgcgtccagtccctcatccgctcgggggacctcgacggcgcctccgccgccgcccgcgccgccgtatcctcccgcgtccggcccaccgtcttcacctgcaacgccgtcgccgcggccatggcccgcgccgggcgccacgacgacgccgtcgccctcttcgacttcttcttccgccgctccaacatcgtccccaacatcgtctcctacaacaccctcatcctcgcccacgccgaggccgcccgcgtcgacgacgcgatgcaggtgtaccgcgacatgctcgcgtccgcgccctttcccccctccgccgtcacctaccgccacttaacaaagggcttcctccctgcgggcc

SEQ ID NO: 48182 - protein, 218 aa, Panicum virgatum
  misc_feature: Ceres CLONE 2041117
  misc_feature (169)..(203): Pfam Name: PPR Pfam Description: PPR repeat
MALYRRLLLLRRLSHLHPASFPAPAVGSSPPPTLAGLLTPTGRRHFAFSSAEEAAAERRRRKRRLRVEPPLNALRRGPPPPRDPRQPDTTSALVGPRLSLHNRVQSLIRSGDLDGASAAARAAVSSRVRPTVFTCNAVAAAMARAGRHDDAVALFDFFFRRSNIVPNIVSYNTLILAHAEAARVDDAMQVYRDMLASAPFPPSAVTYRHLTKGFLPAG

SEQ ID NO: 48183 - DNA, 713 bp, Panicum virgatum
  misc_feature: Ceres CLONE 2041125
  misc_feature: Encodes the peptide sequence at SEQ ID NO. 48184
atcccacgcttcctcgcgctccccacaaaccccacaaaccctcctcgcctcctccctcgcgccgccgccgcctctctctcctagcgttcgggaagggcctcgccatggcctcggagacggagacgttcgccttccaggcggagatcaaccagctgctctccctcatcatcaacaccttctactccaacaaggagatcttcctcagggagctcatctccaactcctccaatgccttggacaagatcaggtttgagagcttgacggacaagagcaagctggatgcccagccagagctgttcatccacattgttcctgacaaggccacaaacactctgacaatcattgacagtggtattggtatgaccaagtcagatctcgtgaacaaccttggtaccattgcacggtcaggcacaaaggagttcatggaggctttggctgctggtgctgatgtttctatgattggtcagtttggtgttggtttctattctgcataccttgttgctgagagagtagttgtgaccaccaagcacaacgatgatgagcagtacgtgtgggagtctcaggctggtggctccttcactgtcaagcgtgatacctctggggagccccttggcaggggtactaagatgaccctctacctcaaggatgatcagttggagtaccttgaggagcgtcgcctcaaggatcttgatcagaagcattctgagttcatc

SEQ ID NO: 48184 - protein, 202 aa, Panicum virgatum
  misc_feature: Ceres CLONE 2041125
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSNALDKIRFESLTDKSKLDAQPELFIHIVPDKATNTLTIIDSGIGMTKSDLVNNLGTIARSGTKEFMEALAAGADVSMIGQFGVGFYSAYLVAERVVVTTKHNDDEQYVWESQAGGSFTVKRDTSGEPLGRGTKMTLYLKDDQLEYLEERRLKDLDQKHSEF

SEQ ID NO: 48185 - DNA, 663 bp, Panicum virgatum
  misc_feature: Ceres CLONE 2041155
  misc_feature: Encodes the peptide sequence at SEQ ID NO. 48186
agagctctgtagaagaagcggcgagggggcgaaccggagccactcagccgccacctcaccgcgccacgccgctcctgctcgccgccgcccgctgctctcgccatttcagccgcagcgctcgccgccgccgcagggccgcagagcctctcctcctccgcagggccgcagcgcctctcctccattcctcctgcgcccgcctgccggctgccttccggatgagaagcggcgcaaccggggcggcggaagcgtggtcggcgtgaggcttcgtcggagtccgtgaacgcgccgacaaggatcctggagatcaagtgcatgggttccttggaggcccggtaccggccggccggggcagctgaggacacggctaagagaaggactcagaaaagcaaaagtttcaaagaggttgaaaaatttgatgtttttgttctggagaaaagctcgggatgcaaattcagatccttgcaacttttgctctttgctatcatgtctgcggcatttctaacactcctatacacgccgtctgtgtatgaacatcagctacagtcaagctctagacttgtcaatgggtggatatgggataagagaagttctgatcctcgatatgtctctactgccaacattcaatgggaagatgtatataaaagtattcaaaatctgaatggt

SEQ ID NO: 48186 - protein, 116 aa, Panicum virgatum
  misc_feature: Ceres CLONE 2041155
  misc_feature: Functional homolog of the protein sequence given in SEQ ID NO 50565
  misc_feature: Useful for making plants with altered carbohydrate content
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSTANIQWEDVYKSIQNLN

SEQ ID NO: 48187 - DNA, 638 bp, Panicum virgatum
  misc_feature: Ceres CLONE 2041166
  misc_feature: Encodes the peptide sequence at SEQ ID NO. 48188
ggttgtcccctcgtgatgatcggcagctcccgcgcgcgcgccatggccagctcctccggcctgagacgaggcatcgacggtagtggcatggtggcggcgctcctcctctcgatggcactgacggcggcggccgcagacccgccgttctcgtgcggagcgtcgtcggcagaggccgcccagggttacgcgttctgcgacgcggcgctgggccccgcggcgcgcgcggcggacctggtctctcggctgacccccgcggagaaggtggcccagctgggcgacgtcgcccccggcgtgccgcggctgggcgtcccggcgtacaagtggtggaacgaggcgctgcacgggctggccacctccggcaaggggctccacttcaacgcccccggcggcgtccgcaccgccaccagcttcccgcaggtgctcctcaccgccgccgccttcgacgacggcctctggttccgcatcggccaggcgatcggccgggaggcccgggcgctgtttaacatcgcccaggcggagggcctcaccatgtggtccccgaatgtgaacatcttccgggacccgcggtggggccgggggcaggagacccccggcgaggaccccgccgtcgccagcaactacgccgccgccttcgtccg

SEQ ID NO: 48188 - protein, 198 aa, Panicum virgatum
  misc_feature: Ceres CLONE 2041166
  misc_feature (81)..(198): Pfam Name: Glyco_hydro_3 Pfam Description: Glycosyl hydrolase family 3 N terminal domain
  misc_feature: SWISSPROT Homolog: EC 3.2.1.21 Beta-glucosidase
MASSSGLRRGIDGSGMVAALLLSMALTAAAADPPFSCGASSAEAAQGYAFCDAALGPAARAADLVSRLTPAEKVAQLGDVAPGVPRLGVPAYKWWNEALHGLATSGKGLHFNAPGGVRTATSFPQVLLTAAAFDDGLWFRIGQAIGREARALFNIAQAEGLTMWSPNVNIFRDPRWGRGQETPGEDPAVASNYAAAFV

SEQ ID NO: 48189 - DNA, 751 bp, Panicum virgatum
  misc_feature: Ceres CLONE 2041191
  misc_feature: Encodes the peptide sequence at SEQ ID NO. 48190
gtccatcgctctgcacactcgcagaaaggaggcccagtcctccacccgctcgccacccaacgcggcgggcgcgtcgccatggcgctccgtctcctcctgctccccctgctcctcctcgccgccgccgacgcgctcacgccggacggccaggcgctgctggcgttcaaggcggccgtcgtcgaggaccccacgggcgcgctcgccaactgggacgccaccgccgcggacccctgcgcctggaacggcgtcgcctgctcctcctcccccgccgatgccacccagccccgccgcgtcgtcgcgctctcgctccccaagaagcgcctccttgcggcgctcccggcggcgccgctcccttcctcgctgcgccacctcaacctccgcagcaaccgcctcttcggccccgtcccgcccgagctcgtctccgccgcgcccgcgctccagagcctcgtcctctacgggaacgcgctcgacggcccgctccccgacgagctcggggcccttcccttcctccagatcctcgacctctcctccaatgccctcaacggctccctcccgccctcgatcctcaaatgccgccgcctccgcgcgctcgcgctcgcgcggaacaacctcacgggcccgctccccgccggcttcggcgcccagctctccgcgctggagcgcctcgacctctcctttcacggcttctccggcgccatcccggaagacatggggaacctctccagactccaggggacggtcgacctctcgc

SEQ ID NO: 48190 - protein, 224 aa, Panicum virgatum
  misc_feature: Ceres CLONE 2041191
  misc_feature (19)..(60): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: The sequence is a functional homolog of SEQ ID NO 956 in the 10/412,699 US patent application
MALRLLLLPLLLLAAADALTPDGQALLAFKAAVVEDPTGALANWDATAADPCAWNGVACSSSPADATQPRRVVALSLPKKRLLAALPAAPLPSSLRHLNLRSNRLFGPVPPELVSAAPALQSLVLYGNALDGPLPDELGALPFLQILDLSSNALNGSLPPSILKCRRLRALALARNNLTGPLPAGFGAQLSALERLDLSFHGFSGAIPEDMGNLSRLQGTVDLS

SEQ ID NO: 48191 - DNA, 662 bp, Panicum virgatum
  misc_feature: Ceres CLONE 2041223
  misc_feature: Encodes the peptide sequence at SEQ ID NO. 48192
agcttgactgaacgataacacaccacactgctttaatggggcgatcaccatgctgtgagaagattggcctgaagaaaggtccatggacgccagaggaggatcagaagctgcttgcctacattgaggagcacgggcatgggagctggcgatcactgcctgcgaaggcaggcttgcagaggtgcgggaagagctgcagattgaggtggacaaactacctgaggccggacatcaagaggggcaagttcagcttgcaggaagagcagaccatcatccagcttcatgcccttcttggtaacagatggtcggccattgcaacacatctaccaaagcgcacagacaatgagatcaagaattactggaatacacacctcaagaagaggctggccaagatggggatcgaccctgtcacccacaaatccatcagtggcactctcaccagcaccacagatgacaaatcagctaaggcagcggcaagcctcagccacatggctcagtgggagagtgcccgcctcgaggctgaggcacggctggctcgagaatcgaagatgcgaatagcagcaccgacaccaacctcactccattcgcagcaaacgaatgtcgctgcctccactgcttctccatgccttgacgtgttgcatgcatggcaggttgcaaagatagac

SEQ ID NO: 48192 - protein, 208 aa, Panicum virgatum
  misc_feature: Ceres CLONE 2041223
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 296 in the 11/479,226 US patent application
  misc_feature: The sequence is a functional homolog of SEQ ID NO 824 in the 10/412,699 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: Functional homolog of the protein sequence given in SEQ ID NO 50784
  misc_feature: Useful for making plants with altered alkaloid content
  misc_feature: Useful for making plants with altered lignin content
  misc_feature: Useful for making plants with modulated nitrogen use efficiency
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 271 in the 11/479,226 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: Functional homolog of the protein sequence given in SEQ ID NO 50237
  misc_feature: Useful for making plants with modulated low light sensitivity
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 726 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1010 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1002 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 788 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 790 in the 11/435,388 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 836 in the 10/412,699 US patent application
  misc_feature: Functional homolog of the protein sequence given in SEQ ID NO 51112
  misc_feature: Useful for making plants with altered cell wall content and/or composition
  misc_feature: Functional homolog of the protein sequence given in SEQ ID NO 50236
  misc_feature: Useful for making plants with modulated biomass
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 126 in the 10/412,699 US patent application
MGRSPCCEKIGLKKGPWTPEEDQKLLAYIEEHGHGSWRSLPAKAGLQRCGKSCRLRWTNYLRPDIKRGKFSLQEEQTIIQLHALLGNRWSAIATHLPKRTDNEIKNYWNTHLKKRLAKMGIDPVTHKSISGTLTSTTDDKSAKAAASLSHMAQWESARLEAEARLARESKMRIAAPTPTSLHSQQTNVAASTASPCLDVLHAWQVAKI

SEQ ID NO: 48193 - DNA, 701 bp, Panicum virgatum
  misc_feature: Ceres CLONE 2041236
  misc_feature: Encodes the peptide sequence at SEQ ID NO. 48194
cacggctcacttcacttcccccacactcgaagctcacgatgctccccatgaagaaaccgctccttggtctcctccagctcgtcctcgttgcctccacatttgcccttgcctgcagcggcgccggcgccggcgcggcgacctacattgtgtacctgaaccccgcgctcaagccgtccccctacgccacgcacctccactggcaccacgcccacctcgacgcgctctccctggacccgtcgcgccacctcctctactcgtacaccacggcggcgccgtccgcgttcgccgcccgcctcctcccgtcccacgtcgcggcgctccgggcccaccccgccgtcgcgtcggtgcacgaggacgcgctcctcctgctccacaccacgcgctcgccttccttcctccacctcccgccctacgacgcgcccgacgcggacggcgggagcccggacgtcatcatcggggtgctcgacacgggcgtctggcccgagagccccagcttcggggatgccggtctgggccccgttccggcacggtggcgcgggagctgcgagaccaatgccaccgacttcccgccgtcgatgtgcaaccggaagctcatcggcgcccgcgccttctttcgcggctactcgtcgggcggcgggaacggttcccgcgtcagctccgacctcatgtcgccgagagaccacgacgggcacggcacgcac

SEQ ID NO: 48194 - protein, 217 aa, Panicum virgatum
  misc_feature: Ceres CLONE 2041236
  misc_feature (30)..(109): Pfam Name: Subtilisin_N Pfam Description: Subtilisin N-terminal Region
  misc_feature: SWISSPROT Homolog: EC 3.4.21.25 Cucumisin
MKKPLLGLLQLVLVASTFALACSGAGAGAATYIVYLNPALKPSPYATHLHWHHAHLDALSLDPSRHLLYSYTTAAPSAFAARLLPSHVAALRAHPAVASVHEDALLLLHTTRSPSFLHLPPYDAPDADGGSPDVIIGVLDTGVWPESPSFGDAGLGPVPARWRGSCETNATDFPPSMCNRKLIGARAFFRGYSSGGGNGSRVSSDLMSPRDHDGHGT

SEQ ID NO: 48195 - DNA, 657 bp, Panicum virgatum
  misc_feature: Ceres CLONE 2041244
  misc_feature: Encodes the peptide sequence at SEQ ID NO. 48196
gtcaagcttcgaatcctcccttcccccttaccccttcccccatctccttcctctccacagccccccccccccacccccccgccagggatccgatggagaggtacgagctgctcaaggacatcggctccggcaacttcggggtggcgcggctcatgcggaacaaggagaccagggagctcgtcgccatgaagtacatccccagggggctcaagattgacgagaatgtggggagggagatcataaaccaccgctcggtgcggcactccaacatcatcggcttcaaggaggtcgtgctcacgcccacgcacctcgccatcgtcatggagtacgccgccggcggtgagctcttcgaccggatctgcagcgccggcaggttcagcgaggatgaggcgcggtatttcttccagcagctcatctgcggtgtcagctactgccacttcatgcaaatttgccaccgggacttgaagctggagaacacgctgctggatggcagcccggcgccgcgcctgaagatctgcgactttggttactccaaggtaccatttttttttaattcccccttatgtgatttcttttgaaagggacagtgggacacagaaagagcgctttcttgcttaacttgccatgctgggaagacaaaattttgacacaaaactg

SEQ ID NO: 48196 - protein, 161 aa, Panicum virgatum
  misc_feature: Ceres CLONE 2041244
  misc_feature (4)..(161): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 51745
  misc_feature: Useful for making plants with modulated biomass
  misc_feature: Functional homolog of the protein sequence given in SEQ ID NO 50598
  misc_feature: Useful for biocontainment applications
  misc_feature: Useful for making plants with modulated time to senescence
  misc_feature: Functional homolog of the protein sequence given in SEQ ID NO 50599
  misc_feature: Useful for making plants with modulated water use efficiency
MERYELLKDIGSGNFGVARLMRNKETRELVAMKYIPRGLKIDENVGREIINHRSVRHSNIIGFKEVVLTPTHLAIVMEYAAGGELFDRICSAGRFSEDEARYFFQQLICGVSYCHFMQICHRDLKLENTLLDGSPAPRLKICDFGYSKVPFFFNSPLCDFF

SEQ ID NO: 48197 - DNA, 729 bp, Panicum virgatum
  misc_feature: Ceres CLONE 2041264
  misc_feature: Encodes the peptide sequence at SEQ ID NO. 48198
  misc_feature (663)..(663): n is a, c, t, g, unknown, or other
aacttccaccgcctccacacccgcatctctttcttcttcccgtctcatcccgccgccagcgcgcgaaggtggtgcgggcgatggcgagcggcggggcggtgagggaggtggggtccaaggcggagctggacgcggcggtggccggcgcgcgggcggccgccgtgcacttctgggtggggtggtgcgaggcgtccaagcagatggacgaggtcttcgctcacctcgccgtcgacttcccccacgccgccttcctcagggttgaagctgaagaacaacctgaaatatcagaggcgtatggagttacagcggtgccatattttgctttctgcaaggaaggtaaaactgttgatactctggagggagcaaatccagctagcctggccaataaggttgcaaaaattgccgggcctgccagtgttgctgagtccgctgtacctgctagccttggagtggctgctgggcctgctgtacttgaaaaagtccaagaattggctccgcggaatggatcttctgctgctgagagcacaaactccgacagcctgccagatccactgaataagcgtttggagcagcttgtcaattcccatcctgtatttctgtttatgaagggaacccctgagcaaccaaggtgtggtttcagccgtaaagtggttgacattttgnagcaggaaggagtcaactttgggagctttgatattctcatagacaatgatgtgcgtgaaggaaatg

SEQ ID NO: 48198 - protein, 216 aa, Panicum virgatum
  misc_feature: Ceres CLONE 2041264
  misc_feature (7)..(107): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (195)..(195): Xaa is any aa, unknown, or other
MASGGAVREVGSKAELDAAVAGARAAAVHFWVGWCEASKQMDEVFAHLAVDFPHAAFLRVEAEEQPEISEAYGVTAVPYFAFCKEGKTVDTLEGANPASLANKVAKIAGPASVAESAVPASLGVAAGPAVLEKVQELAPRNGSSAAESTNSDSLPDPLNKRLEQLVNSHPVFLFMKGTPEQPRCGFSRKVVDILXQEGVNFGSFDILIDNDVREGN

SEQ ID NO: 48199 - DNA, 704 bp, Panicum virgatum
  misc_feature: Ceres CLONE 2041272
  misc_feature: Encodes the peptide sequence at SEQ ID NO. 48200
tctcgaatcgacaaaaatcccccgaactcctttccagcctctcccccgccccctccgcacccacccgcccccgcgcgcgagatcacgcgccccagcaccgcgaccaccggcgccgccgcggcgtccggagcaggcggcgagcggtcgtcacgcagcgtaggctcggctcgccggggcgggcaagatgagcgggcacgactcgaaatacttctccaccaccaagaagggggagatccccgagctcaaggaggagctcaactcccagtacaaggacaagagaaaggatgctgttaagaaagtgattgctgctatgacagttggaaaagatgtctcatcgttgttcacagatgtcgtgaactgcatgcagactgagaatttggagctcaagaaattagtatatttgtatcttatcaactatgctaagagtcaacctgatcttgccatacttgctgtgaacacatttgttaaggactcgcaagacccaaatccattgattcgtgctctggctgttaggacaatgggttgtattcgtgtggacaaaattacagagtatctttgtgatccacttcaaagatgcctcaaggatgacgatccctatgtgcggaagactgcagctatttgtgttgctaagctttatgatataaacgctgagctagtggaggacagaggatttttagaggcccttaaggattaatatctgataa

SEQ ID NO: 48200 - protein, 169 aa, Panicum virgatum
  misc_feature: Ceres CLONE 2041272
  misc_feature (118)..(154): Pfam Name: HEAT Pfam Description: HEAT repeat
MSGHDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLEALKD

SEQ ID NO: 48201 - DNA, 705 bp, Panicum virgatum
  misc_feature: Ceres CLONE 2041290
  misc_feature: Encodes the peptide sequence at SEQ ID NO. 48202
agcaaaccaatcgcatgcatactatgccctaaggcggctctctcagcgagactctggtggatgccatattccaaatggctgcgagagccgccgccgccgccatgcccggcctcctcctgctcccgtttctccttgtagctgctgcttccggtgccgccaacgatgcagccagcacgccgccgatcagccggaaaagcttccctgagggcttcgtcttcgggacggcctcgtcggcctatcagtatgaaggtggttttaacgaggggggcagaggaccaagcatctgggacaccttcacccaccagcacaaagaaaaaatcgctgatggaagcaacggggatgtagcagttgactcctaccatctctacaaggaagatgtgcgcctcatgaaggacctcgggatggatgcgtacaggttctccatatcatggagcagaattcttccaagtacctaacttttttttcttttaatttcccctaatgacgtacttcctcagtttttacatatatatatatatatatatatataaagtttttttacactgagctaattaattcatttattcaaacattgtatatatatttaaaaatagagggagtttaatgttttcataaactagaagttccaagttgatagcatgttcttattatgtgttagcacactgtttagccgtgcacgccaaggctttcgcctagctttctttg

SEQ ID NO: 48202 - protein, 117 aa, Panicum virgatum
  misc_feature: Ceres CLONE 2041290
  misc_feature: SWISSPROT Homolog: EC 3.2.1.21 Beta-glucosidase
  misc_feature: Functional homolog of the protein sequence given in SEQ ID NO 50615
  misc_feature: Useful for making plants with modulated biomass
  misc_feature: Functional homolog of the protein sequence given in SEQ ID NO 50483
  misc_feature: Useful for making plants with altered cell wall content and/or composition
  misc_feature: Functional homolog of the protein sequence given in SEQ ID NO 50586
  misc_feature: Useful for making plants with altered carbohydrate content
  misc_feature: Functional homolog of the protein sequence given in SEQ ID NO 50360
  misc_feature: Useful for making plants with modulated flowering time
MPGLLLLPFLLVAAASGAANDAASTPPISRKSFPEGFVFGTASSAYQYEGGFNEGGRGPSIWDTFTHQHKEKIADGSNGDVAVDSYHLYKEDVRLMKDLGMDAYRFSISWSRILPST

SEQ ID NO: 48203 - DNA, 711 bp, Panicum virgatum
  misc_feature: Ceres CLONE 2041299
  misc_feature: Encodes the peptide sequence at SEQ ID NO. 48204
cacttctaaaatcatccaatgttttagaccactggataaactctgcaactgaaagtctagtcagctttgttcaacaggagatggatgcatatcggctttacacggttgtgccatatttggtaaaatacatcgacaatcttactaacatctacgtgcgattgaatcgcaaacggttaaagggacgtactggagaagaagactgcagaatttctctttcaacgctataccatgctcttgttacaacttgcgtggcgatggctccatttacaccgttctttactgaagttctctatcaaaatctacggaaggcctcaaataaatctgaggagagcattcatttctgcaagtttccttccacaactggggagagagatgagcgtgttgaacaaagtgtgaataggatgatgaccatcattgatctcgcacgtaatattcgtgagcggcataacaaagctctcaaaacaccactcaaggagatggtggttgtgcatccagacaatgaattccttgaaaacatcacggggaaactgaaagagtatgtcatggaagaaatcaatgttaagactgtcactccatgtaatgatcccttggtttatgcttctctgcgggccgaacctaatttcagtgtgctaggcaaaagacttggaaaagacatgggcaaagtatcaaatgaggtgaagaagatgacccaggaacagatcttatcctttg

SEQ ID NO: 48204 - protein, 236 aa, Panicum virgatum
  misc_feature: Ceres CLONE 2041299
  misc_feature (9)..(161): Pfam Name: Anticodon_1 Pfam Description: Anticodon-binding domain
  misc_feature: SWISSPROT Homolog: EC 6.1.1.5 Isoleucine--tRNA ligase
LLKSSNVLDHWINSATESLVSFVQQEMDAYRLYTVVPYLVKYIDNLTNIYVRLNRKRLKGRTGEEDCRISLSTLYHALVTTCVAMAPFTPFFTEVLYQNLRKASNKSEESIHFCKFPSTTGERDERVEQSVNRMMTIIDLARNIRERHNKALKTPLKEMVVVHPDNEFLENITGKLKEYVMEEINVKTVTPCNDPLVYASLRAEPNFSVLGKRLGKDMGKVSNEVKKMTQEQILSF

SEQ ID NO: 48205 - DNA, 746 bp, Panicum virgatum
  misc_feature: Ceres CLONE 2041318
  misc_feature: Encodes the peptide sequence at SEQ ID NO. 48206
aggcgcaaaacgcgcggcgtcgcggaacaccccgtccacccgttccgttccaagtccggttccgaggcacgggcaccaccgccctcgctccctctctttctgccgcggcgccagccacatccccgccacctctccggctccacgccatccccgccccgctcgaccccaccgcctctcaccggcgatcccctccctctcgcccggccagttcacggctttctagtgttctgtggcctttgtttggtggttggtgcctctctgaagttggcaacttctgtaagactccagtgcaatgtcaaatgcaaaagtggtgcttgagcctgcgtttcaaggagttggccataaaccagggacagaaatatggaggattgaagattttaagccagttcctttgccaaaatcagattatggtaaattctactgtggagattcgtatatagttctgcagacgacttgtaacaaaggaggtgcctatcttcttgacatccacttctggattggaaaagattctagccaggatgaagctggaactgcagcaatcaagacaatcgagcttgacaccatgcttgggggtcgtgcagtgcagcacagggaaccacaaggctatgaatctgataaattcctgtcatacttcaagccatgcatcatacccatggagggaggatttgcttctggggttaaaaagccagaagaggagaaagttgaaacacggctgtacatttgcaaagggaaaaaagctatcagag

SEQ ID NO: 48206 - protein, 151 aa, Panicum virgatum
  misc_feature: Ceres CLONE 2041318
  misc_feature (28)..(111): Pfam Name: Gelsolin Pfam Description: Gelsolin repeat
MSNAKVVLEPAFQGVGHKPGTEIWRIEDFKPVPLPKSDYGKFYCGDSYIVLQTTCNKGGAYLLDIHFWIGKDSSQDEAGTAAIKTIELDTMLGGRAVQHREPQGYESDKFLSYFKPCIIPMEGGFASGVKKPEEEKVETRLYICKGKKAIR

SEQ ID NO: 48207 - DNA, 673 bp, Panicum virgatum
  misc_feature: Ceres CLONE 2041325
  misc_feature: Encodes the peptide sequence at SEQ ID NO. 48208
ggtttaattacccaagtttgagcgatcattcaaaatgtcgtccgaaagcggtgaaaccttcgccttccaggcggaaatcgcccaattgatgtccctcatcatcaacaccttctattccaacaaggaaatcttcttgcgtgaattgatctccaactcttctgatgctcttgataagatcagatatcaggctctgacggaacccagtgaactggactcgggcaaggatctctacatcaagatcacccccaacaaggaggagaagaccctgaccattatggacaccggtatcggcatgaccaaggccgacctcatcaacaacttgggaaccatcgccaagtccggaaccaaggccttcatggaggcactccaggccggagccgacatctccatgatcggtcaattcggagtcggattctattcggccttcctcgtggccgacaaggtcgtcgtgtcctcgaagaacaacaacgacgactgctaccagtgggagtcgagtgccggaggatccttcctcgtcaagacgatcgacgaccccgagctgacgagaggaaccaagatcacgatgcacatcaaggaggaccaggtggagtacctggaggagcgccgactgaaggagatcgtcaagaagcactcccagttcatcggctaccccatcaagttggtggtggaacgc

SEQ ID NO: 48208 - protein, 212 aa, Panicum virgatum
  misc_feature: Ceres CLONE 2041325
  misc_feature (29)..(182): Pfam Name: HATPase_c Pfam Description: Histidine kinase-, DNA gyrase B-, and HSP90-like ATPase
MSSESGETFAFQAEIAQLMSLIINTFYSNKEIFLRELISNSSDALDKIRYQALTEPSELDSGKDLYIKITPNKEEKTLTIMDTGIGMTKADLINNLGTIAKSGTKAFMEALQAGADISMIGQFGVGFYSAFLVADKVVVSSKNNNDDCYQWESSAGGSFLVKTIDDPELTRGTKITMHIKEDQVEYLEERRLKEIVKKHSQFIGYPIKLVVE

SEQ ID NO: 48209 - DNA, 632 bp, Panicum virgatum
  misc_feature: Ceres CLONE 2041330
  misc_feature: Encodes the peptide sequence at SEQ ID NO. 48210
aatctctcttcaaaaaatagagcacccttgagccaaaccccggagaaaccctaggaaagccggttcctctctcagcggcggcgcagcatccgcgacgaacgatggccggctaccgtagccggagtccgagccggagctatagccctcggaggcgatacagccggagccctcctaggcgcaagcgctacgacgacccccgtgaccgctaccgcgggggtgggggcggcggtggcggagcccggcgtgggtacggtcggccgtcggccgtcggcgcagtccggtctcctcatccgcaacatatccctcacaaccaggccagaagatattcgagttccgtttgaggaattcggccctgtaaaggatgtctatcttccaagaaacttccacaccagagaacttcgtggttttggattcgtgaaattccgctaccctgaggatgctgcggtggccaagcaagagatgaatcatcaagttataggtggccgagagatttcaatagtttatgctgaagagaatagaaagacaccccaagaaatgcgcatgagaacaagaacaagtggtaggtacatggacagaaggtacacaaggcaatcactatctagatctcccaggtctcattcccactcttcttt

SEQ ID NO: 48210 - protein, 57 aa, Panicum virgatum
  misc_feature: Ceres CLONE 2041330
  misc_feature: Functional homolog of the protein sequence given in SEQ ID NO 50855
  misc_feature: Useful for making plants with altered terpenoid content
MNHQVIGGREISIVYAEENRKTPQEMRMRTRTSGRYMDRRYTRQSLSRSPRSHSHSS

SEQ ID NO: 48211 - DNA, 711 bp, Panicum virgatum
  misc_feature: Ceres CLONE 2041342
  misc_feature: Encodes the peptide sequence at SEQ ID NO. 48212
gtcctcccgcttcactcgtaccgcgccgcaccccgcaaaccctagctcgaacaccgtcgcgcggggaggcgcgcagctccaatcccccagataatttcctctccaaattctcagtcaccaccactctagcctccaccgcccccctccacctctcctctgtccatctgtatttcgtttgagacttttcctttttgggattttgtggtgttttttccattgtttgtttcaggagcgcgtggcctcggaggattcggggcggctgggctagggttctggcgtctaagtgaagggttctgcgccgtctgttccgtgcgatctattggcgtgaggattgcgatcagttaccatgtcatcatatcctgtgctaaacaaccggccgatcgatcagtggagagttactgatctgaaggatgaactccgaaagaggaggctccccgtcaaaggtttgaaggaggaacttgtgaggcggctcttcgattccattcagagtgaacaagctgctagcgaagcaactgaagatgttggactgaatgcagctgatgatcggcagcctgacgtaaatgttactcaggaaactacagttgctattacagaagttcaccaagatactatggttcatgttactcggcaagttgaagttcctggctctgaaattggtcaggaatccatggtttctgctgttggaggggctcccagtattgatgttgaagc

SEQ ID NO: 48212 - protein, 121 aa, Panicum virgatum
  misc_feature: Ceres CLONE 2041342
  misc_feature (12)..(46): Pfam Name: SAP Pfam Description: SAP domain
MSSYPVLNNRPIDQWRVTDLKDELRKRRLPVKGLKEELVRRLFDSIQSEQAASEATEDVGLNAADDRQPDVNVTQETTVAITEVHQDTMVHVTRQVEVPGSEIGQESMVSAVGGAPSIDVE

SEQ ID NO: 48213 - DNA, 632 bp, Panicum virgatum
  misc_feature: Ceres CLONE 2041401
  misc_feature: Encodes the peptide sequence at SEQ ID NO. 48214
tgggacgccaccccccgctgccgggctcctcctccatcctctcctttcctccgccttctcttccctgcccccgcttcctcccttgccgtgttcacccgcccgcccgcgggccgcggcgcatcctcacaccacccttccccacagctcacgagcctggcgttattgcgcgccgcctcgccgcgttagcttcgggcgctttggcgtggggctgcctgtgtaacggtgccggtgccgtgccgctcacgagggagaggcacttcacttgaggctctagagagctcttctgcgtgctctggagagagagaaggggggaggtgaaaggtgaggggtgccatggggatggaacggcggcggcggcgggaagctgccgtacagctacgccggcgccggccaccaccaggatggcaagctcgtcaagagcttcagccgcgtggagccgcgcaagttcgggatggggctcgtcgccggcttcctcctcgtcacctgcgcctacttctccaccgccaagttcgacgccatccgcatcgccatggtcagccccatttccacggacgcggctgggattggcccgctggcgaccgcgaccgccgccgccgacacctccaaacagcaattagatttgggcgtgcaac

SEQ ID NO: 48214 - protein, 60 aa, Panicum virgatum
  misc_feature: Ceres CLONE 2041401
  misc_feature: Functional homolog of the protein sequence given in SEQ ID NO 50756
  misc_feature: Useful for making plants with altered carbohydrate content
MGLVAGFLLVTCAYFSTAKFDAIRIAMVSPISTDAAGIGPLATATAAADTSKQQLDLGVQ

SEQ ID NO: 48215 - DNA, 698 bp, Panicum virgatum
  misc_feature: Ceres CLONE 2041406
  misc_feature: Encodes the peptide sequence at SEQ ID NO. 48216
gaacctcaccgccgagaaccccagatcaaacccctccccccgcccgttcacattcccattccgcccgcgcgatccagccttcttccctgcccgccagagggtggacaaagaaatcgggccaggaatctcaccagcccccggggtttcttgatccgggcgcgggattggtcgcgcccaggacccagagcaaggcgaatcaagaacgccccgcgggtgccagggccggggaggaatcaagatcgcttttttttcccctctcttctcttgagggctgtcgcttctgttccgctccccgcgcggcaatgccggatccggccggcggcgccccccgcccccacgccgccgggctggcatgccccgtctgagccaccccgccggccgccgcggctcccgatgctcgtctggtccacgggggcaggagagggagcagcggccgtgcgcgtgggcggcggccagcgaggatgcagatccgcctgtcgccgagcatgaggagcatcaccatctccactagccatggcctgctagactttatgaggctcaaggccgccgcgcggcacttctcctaccgcaccgtcttccacaccgtcctcatcctcgccttcctcctgcccttcgtcttcatactcaccgctgtcatgacgctcgagggctttcacagtgctcctccctagattgtctggggagacggttaggtccac

SEQ ID NO: 48216 - protein, 69 aa, Panicum virgatum
  misc_feature: Ceres CLONE 2041406
  misc_feature: Functional homolog of the protein sequence given in SEQ ID NO 51640
  misc_feature: Useful for making plants with altered cell wall content and/or composition
MQIRLSPSMRSITISTSHGLLDFMRLKAAARHFSYRTVFHTVLILAFLLPFVFILTAVMTLEGFHSAPP

SEQ ID NO: 48217 - DNA, 673 bp, Panicum virgatum
  misc_feature: Ceres CLONE 2041410
  misc_feature: Encodes the peptide sequence at SEQ ID NO. 48218
gtcctgcactcgatcgcctcttccgtcgggaggtcttggatggtgcccgcatgctagctgcactgaattgtacaaggtggatacgaatcatttagctcaaggataatgttttggacatctatctagctgttacatgtgtaatatatgcccgccttatgatacttctattgctctgaatttttctaatctcaagacacatgggttcgattagagattacaagtggaagcgtatgggtaccaacgaagcatcccctcctactgttctctgcctcttctttctgttctgcttaggctgcaaatgcttagcgtcagaattcgaagccacccagacagcaaccctcaaggttgatgcctcaccgcagcttgctcggaagattcctgatacactatttgggatcttttttgaggagatcaaccatgcaggagctggtggaatatgggctgaactcgttagtaacagaggttttgaagctggaggccctcatactccatcaaacatcgacccatggtccatcattggagatgactcttccatatttgtggcgactgatcgtacatcatgtttcagtcgaaacattgtttctctaaggatggaggtcctctgtgatgactgtccagctgggggtgttggcatttacaacccaggattctggggcatgaacatagaagatgg

SEQ ID NO: 48218 - protein, 158 aa, Panicum virgatum
  misc_feature: Ceres CLONE 2041410
  misc_feature: SWISSPROT Homolog: EC 3.2.1.55 Alpha-N-arabinofuranosidase
  misc_feature: Functional homolog of the protein sequence given in SEQ ID NO 51746
  misc_feature: Useful for making plants with altered carbohydrate content
  misc_feature: Functional homolog of the protein sequence given in SEQ ID NO 51313
  misc_feature: Useful for making plants with altered cell wall content and/or composition
MGSIRDYKWKRMGTNEASPPTVLCLFFLFCLGCKCLASEFEATQTATLKVDASPQLARKIPDTLFGIFFEEINHAGAGGIWAELVSNRGFEAGGPHTPSNIDPWSIIGDDSSIFVATDRTSCFSRNIVSLRMEVLCDDCPAGGVGIYNPGFWGMNIED

SEQ ID NO: 48219 - DNA, 692 bp, Panicum virgatum
  misc_feature: Ceres CLONE 2041412
  misc_feature: Encodes the peptide sequence at SEQ ID NO. 48220
gcccacctccccccgccgtcgtctcgtctctctccaccgccgctctcccctcccctcccctctctcccactcctccagaccccccctccctcgcgcgcgcgccgccgccgccgcgagatccgctccgcgcgccgccgccgccgcgagatccgctccgcgcgcgatgtggcgcagctgcgtctcgcggggcctctccagggcgagggcctccgcctccaggctcctctccacggcgccgtcgtcctacacggtggtggaccacacgtacgacgcggtggtggtgggggctggcggcgcggggctccgggcggcgatcggcctctccgagcacggcttcaacacggcgtgcatcaccaagctcttccccacgcgctcgcacactgtcgccgcgcagggaggcataaatgctgcacttggaaacatgactgaagatgattggaggtggcatatgtatgacactgttaagggaagcgattggcttggtgaccaggattctattcaatatatgtgcagagaagcaccaaaagctgttatagagcttgagaactatggattgccattttcaagaaccgaagagggaaagatataccaacgcgcctttggaggacagagcttagattttggaaaaggagggacagcctaccgttgtgcctgtgctgctgacagaacaggacatgctatgctacacacac

SEQ ID NO: 48220 - protein, 176 aa, Panicum virgatum
  misc_feature: Ceres CLONE 2041412
  misc_feature: SWISSPROT Homolog: EC 1.3.5.1 Succinate dehydrogenase (ubiquinone)
MWRSCVSRGLSRARASASRLLSTAPSSYTVVDHTYDAVVVGAGGAGLRAAIGLSEHGFNTACITKLFPTRSHTVAAQGGINAALGNMTEDDWRWHMYDTVKGSDWLGDQDSIQYMCREAPKAVIELENYGLPFSRTEEGKIYQRAFGGQSLDFGKGGTAYRCACAADRTGHAMLHT

SEQ ID NO: 48221 - DNA, 700 bp, Panicum virgatum
  misc_feature: Ceres CLONE 2041413
  misc_feature: Encodes the peptide sequence at SEQ ID NO. 48222
ggaaaggggagaaaaatcctagggtttaggcttcatggagatcgagacgcccgccgcccccgccgccgcggggctcgacagggcagccgtcgacccgcgcttccccctcgccatcctcgccgtcgccgcagggaatggtgatcaaggggtaagagttgctgccgctacgtacttgaagaatttcatccggcgcaatatggaaggcagcatgtcttcatctcagctttacaaggagtttcgtgaccaacttgcccaaactttgctccaagcagaacctgcaattcttcgagtgctgattgaagctttccgccaagttgttgaaaaagattttgtcaaggataacttgtggcctgagcttatccctcagctgaaactagtgatccagagcagtaatcttattagtccaggccagcatcctgagtggaataccattaatgctctcaaagtacttcaatctgttgttaggcccttccagtatttcttgaatccaaaagttgcaaaagagcctgttccacaacaactggagcaaatttcagctgagattcttgtaccattgcaagtgacattccatcattttgctgacaaggttctgttgtcacccgatgagactaagttggaatatgagcagctcttactcatcacatgcaaatgcatgtatttcactgtgaggtcatacatgccatctagggtgaaagcaaat

SEQ ID NO: 48222 - protein, 221 aa, Panicum virgatum
  misc_feature: Ceres CLONE 2041413
  misc_feature (10)..(78): Pfam Name: IBN_N Pfam Description: Importin-beta N-terminal domain
MEIETPAAPAAAGLDRAAVDPRFPLAILAVAAGNGDQGVRVAAATYLKNFIRRNMEGSMSSSQLYKEFRDQLAQTLLQAEPAILRVLIEAFRQVVEKDFVKDNLWPELIPQLKLVIQSSNLISPGQHPEWNTINALKVLQSVVRPFQYFLNPKVAKEPVPQQLEQISAEILVPLQVTFHHFADKVLLSPDETKLEYEQLLLITCKCMYFTVRSYMPSRVKA

SEQ ID NO: 48223 - DNA, 713 bp, Panicum virgatum
  misc_feature: Ceres CLONE 2041415
  misc_feature: Encodes the peptide sequence at SEQ ID NO. 48224
aagccgcgaacagaacagaggcacggcacagatccctctcctctccctttctctctcctcgacccttccgacgcggcaaagcaaaaacacagggaggagagggagagagaaagagggagcaggaggagcccggaatcccaaccccagccccaaatcctggtccaatctctcaatcaggggagcatcggggtctgatcgggtcggaggattcggggggcgcagccatgaacgagaaggcgtccgtatccaaggagctcaacgccaagcacaagaagatattagaaggtcttcttcggctgcctgagaacagagaatgcgcagactgcaagtcaaagggtcctcgatgggcaagtgtgaatctagggatctttatatgcatgacatgttctggaattcatagaagtcttggggtgcacatatctaaggtaagatctgccaccctggatacatggctgccagagcaagttgcatttattcaatcaatgggaaacgaaaaggcaaacagctattgggaagcagagttgcctcctaactatgatagggttggaatagagaatttcatccgtgcaaaatacgaggacaagagatgggtaccaaggaatggaacgtcacgacctttctctggtgctcgagatgagaaaagccaagagtctccggctagtgctaacagaagtggatatggtcacagatcttcatttgagcaaaactgtact

SEQ ID NO: 48224 - protein, 162 aa, Panicum virgatum
  misc_feature: Ceres CLONE 2041415
  misc_feature (16)..(130): Pfam Name: ArfGap Pfam Description: Putative GTPase activating protein for Arf
  misc_feature: Functional homolog of the protein sequence given in SEQ ID NO 51347
  misc_feature: Useful for making plants with altered terpenoid content
  misc_feature: Useful for making plants with modulated nitrogen use efficiency
MNEKASVSKELNAKHKKILEGLLRLPENRECADCKSKGPRWASVNLGIFICMTCSGIHRSLGVHISKVRSATLDTWLPEQVAFIQSMGNEKANSYWEAELPPNYDRVGIENFIRAKYEDKRWVPRNGTSRPFSGARDEKSQESPASANRSGYGHRSSFEQNC

SEQ ID NO: 48225 - DNA, 678 bp, Panicum virgatum
  misc_feature: Ceres CLONE 2041432
  misc_feature: Encodes the peptide sequence at SEQ ID NO. 48226
gagaacaaacttggggagtagcagccggagcccggaggggaggaagctgcaagcgagcgccaaacgagcaagcgagcgagctagctaagcaaaagcacaccggagcaggaagcgggagcacttctcctcgcccgcaactgtttcaggctctcagctccctcccccagccgcacgcgcgcgcgagaaggaagcgacgagagggagggggaaaagtgggaggaggagcggcgaggcgagcgagcatgctccccggcggcggagggacgctgctcgggctccggggacgagaaggaaaagatttcgcctagcttcggcttcggcggcggctttcatctttgggttccgcaatcgcggctcgcggtgaaaaaaaaagaaacggggctagctgcggaaccgggaaagtgatggtttccttcgggaaggcgctgtgatttggcctcaaaaaggaggaatctttcctacgctccccccttgcttcccccgctcttataccgccctcagatcgcggggccggcagtctgattggtccgtcggcaacggggaaggaaaatgaggctctcgtcgtcgtccggcagcgtcctcccggcccaggcggcttcgccggaagctgttgaggagcacaagtgtctgaactcggagttgtggcatgcctgcgccggaccccttgttttcttgccg

SEQ ID NO: 48226 - protein, 42 aa, Panicum virgatum
  misc_feature: Ceres CLONE 2041432
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 696 in the 11/479,226 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
MRLSSSSGSVLPAQAASPEAVEEHKCLNSELWHACAGPLVFL

SEQ ID NO: 48227 - DNA, 653 bp, Panicum virgatum
  misc_feature: Ceres CLONE 2041483
  misc_feature: Encodes the peptide sequence at SEQ ID NO. 48228
aaaaatcgagtctccttctcttcggctcttccttcccacggaagcctccagaacagaaatcccccgagcgcgatggcggcgccggtgcagctgacccccggcggggtgccgctggtctccaatcacgtcaccggcgccgagacggtgcaggcggtgctgcaggtgcttgacgtgcgggttgtcgtccacaagagcaacgacaaccccggcggctccaaccgctaccggatgctgctctccgacggcgtctactcgctgcagtccatgctcgccaccgccgagaaccatcacatccgggacggctacatccagaaggggtccatcatccacctccaggagtacacctgcagcaccatcaagacgcgcaggatcactattgttctcaaacttgatgttctgcaaactgagtgcgagataatcggaagccccaaaccctatgagttggtaaacccacctacggagcaggcccccaacttaccggccaatgctgctcaagttaatagtggagcatattccagtggcccaggcatgctgggatcttctgttgctccaagggtagcacagattgctaatactgtatcacagggtggatcctacggtggtcatccgggtatggtgaaccctccaattggtcgagcagtagatcctggttc

SEQ ID NO: 48228 - protein, 193 aa, Panicum virgatum
  misc_feature: Ceres CLONE 2041483
  misc_feature (6)..(111): Pfam Name: Rep-A_N Pfam Description: Replication factor-A protein 1, N-terminal domain
MAAPVQLTPGGVPLVSNHVTGAETVQAVLQVLDVRVVVHKSNDNPGGSNRYRMLLSDGVYSLQSMLATAENHHIRDGYIQKGSIIHLQEYTCSTIKTRRITIVLKLDVLQTECEIIGSPKPYELVNPPTEQAPNLPANAAQVNSGAYSSGPGMLGSSVAPRVAQIANTVSQGGSYGGHPGMVNPPIGRAVDPG

SEQ ID NO: 48229 - DNA, 660 bp, Panicum virgatum
  misc_feature: Ceres CLONE 2041501
  misc_feature: Encodes the peptide sequence at SEQ ID NO. 48230
ccaccatgcacacacacctctccgccccactggccactgtaccacctcctcctccatgccattgccactagatctaccaccgccaccgccaccgccaccatatctatcccgtcccggaaacattctgaacgcggcagctagcatagcagctgcagaaatcatggcccctacttcccctcttgccagcctactgctgctccagcgcctgttcccgttaacgctgctgctgctgctgttcattggcggcgctccagcgaccgcgcgcgccgccgccgacatgccgatgccggtgaacgaggaggtgctggggctggtggtcttcaagagcgcgctctccgacccgtccggcgcgctggccacgtggaccgagtccgacgccacgccctgcggctggcgctgcgtcgagtgcgacccggccacctcccgggtcctccgcctctccctctccggcctcgcgctatccggccccatgccgcgcggcctcgaccgcctccccgcgctccaggagctcaacctcgcccgcaacaacctctccggcccgctcccgccgggcctctccctgctcacctccctccgctcgctcgacctctcctacaacgccttctccggcccgctccccggcgacgtcgcgctcctcgcctccctgcgctacctcgacct

SEQ ID NO: 48230 - protein, 166 aa, Panicum virgatum
  misc_feature: Ceres CLONE 2041501
  misc_feature (44)..(84): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPTSPLASLLLLQRLFPLTLLLLLFIGGAPATARAAADMPMPVNEEVLGLVVFKSALSDPSGALATWTESDATPCGWRCVECDPATSRVLRLSLSGLALSGPMPRGLDRLPALQELNLARNNLSGPLPPGLSLLTSLRSLDLSYNAFSGPLPGDVALLASLRYLD

SEQ ID NO: 48231 - DNA, 654 bp, Panicum virgatum
  misc_feature: Ceres CLONE 2041512
  misc_feature: Encodes the peptide sequence at SEQ ID NO. 48232
tgatggccgcagccgcccccagtcttgtcttcgtcctcgttcctgctcctgctccctccctctcaggtctcgtcagcaactggagcagtaccaccagctagcacgcaccagagttgacgatggaggaggaggttcgcgcggcgcacaacgtgctggaggcgtgcgcgcagacggacgccatggagagcgtcgtcttcacgtcctccgtcaccgccgtcgtctggaccggcgacgccgacaaggaggacgggcacctcgccgtcgacgagaggtgctggagcgacctcgccttctgcaggaaattcaagctgtggcacgccctggccaagacgctctcggagaagacggcgtgggcgctggccatggaccggggcgtcgacatggtggccatcaacgccggcctgctcacggcgccggggctcaccgccgcgcacccctacctcaagggcgcccccgacatgtacgccgccggcgtcctcgccaccgtcgacgtcgacttcctcgccgacgcgcatgtcgccgcctacgagtgccccaccgcctacggcaggtacctctgcttcaacaacgccgtgtgccggcccgaggatgccgtcaagctcgcgcagatgctctcgccggccgcgccacgctcgccaccaagtgacgagctga

SEQ ID NO: 48232 - protein, 178 aa, Panicum virgatum
  misc_feature: Ceres CLONE 2041512
  misc_feature: SWISSPROT Homolog: EC 1.1.1.219 Dihydrokaempferol 4-reductase
MEEEVRAAHNVLEACAQTDAMESVVFTSSVTAVVWTGDADKEDGHLAVDERCWSDLAFCRKFKLWHALAKTLSEKTAWALAMDRGVDMVAINAGLLTAPGLTAAHPYLKGAPDMYAAGVLATVDVDFLADAHVAAYECPTAYGRYLCFNNAVCRPEDAVKLAQMLSPAAPRSPPSDEL

SEQ ID NO: 48233 - DNA, 585 bp, Panicum virgatum
  misc_feature: Ceres CLONE 2041534
  misc_feature: Encodes the peptide sequence at SEQ ID NO. 48234
aatgccatcaaacaagtctttaaggacccatctgggatcaaaataaatgcaaccaagtccatgataggacactgccttggtgcagcaggtggtttggaagccattgctactgttaaagccataactactggatgggtgcatccaagcataaaccaatttaacccggaggaagcggttgaatttgatactgtacctaatgtaaaaaagcagcatgaagtgaatgttggtatttcaaattcctttggattcggaggtcacaattcggtggttgtatttgcgccatttaagccataaggtgttacttgcttcacaaatcttggtcagaacaacgaaggtcgttctaggaatttcagcattaaattatcatgcattttctttgggggcagatttgttagccggcaatgttacaaatgaactgagtaatgaggtacattacattttagataattccatgttcatttagattgagagcggctgtataacgttgtttgaatcatttgtaagttgtactcttttttcatgtaatggaaggtgttctgtacattggaccaccttagttcaataccatacaaatgtattcgaggg

SEQ ID NO: 48234 - protein, 97 aa, Panicum virgatum
  misc_feature: Ceres CLONE 2041534
  misc_feature: SWISSPROT Homolog: EC 2.3.1.41 Beta-ketoacyl-acyl-carrier-protein synthase I
NAIKQVFKDPSGIKINATKSMIGHCLGAAGGLEAIATVKAITTGWVHPSINQFNPEEAVEFDTVPNVKKQHEVNVGISNSFGFGGHNSVVVFAPFKP

SEQ ID NO: 48235 - DNA, 623 bp, Panicum virgatum
  misc_feature: Ceres CLONE 2041542
  misc_feature: Encodes the peptide sequence at SEQ ID NO. 48236
gacccttctctacctcctcccccgcccccccacccaaatccgacgccggcctacgacccctcagccggcggcggctatggcgttcggcgagcgcatcaccaccttcgaggacagcgagaaggagagcgagtacggatacgtccgcaaggtctctggacctgtggttgtggctgatggaatgggtggtgctgccatgtatgaacttgttcgtgttggtcatgacaacctcattggggaaattattcgtcttgagggtgactcagctacaattcaagtttatgaggaaacagctgggctgatggtaaatgacccagtgttgagaacaagaaagcctctctcagttgaattggggcctggcattcttggcaacatttttgacgggattcagcgccctctaaaaaccattgctattaaatctggggatgtgtatataccacgtggtgtatcagtccctgcccttgacaaagatcagctgtgggaatttcagccaaacaagctaggcgttggagatgccatcacgggtggagatttatatgctactgtatttgagaatacactgatggaacaccatgttgcccttcctcctggttctatggggaaaataagctacattgcccctgctg

SEQ ID NO: 48236 - protein, 182 aa, Panicum virgatum
  misc_feature: Ceres CLONE 2041542
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MAFGERITTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDQLWEFQPNKLGVGDAITGGDLYATVFENTLMEHHVALPPGSMGKISYIAPA

SEQ ID NO: 48237 - DNA, 695 bp, Panicum virgatum
  misc_feature: Ceres CLONE 2041554
  misc_feature: Encodes the peptide sequence at SEQ ID NO. 48238
ggaaccggtacacaccgagctttcttctcccctgctctcgctgctgcggcgaattttcttgcccggcaccggccgccgtgggtagcctgcgccaccgtaccccttccgcccttccgccgtcctcccggaagcgaaagatcttggataattttgaacatgtcgtgtctagcatgctgtggcggcgaagacactcaaagagcacctgatagtggaggtccatacccaggtggctacccagcaaggaatgatgcttatcgcactgctgttccaactcccagaggtgctcaacctgtgaaagtgcagccaattgctgtccctactattcctgtggaagaaatccgggaggtcacacagggttttggtgatgaagctttggttggtgagggttcttttggcagagtgtattatggtgtactgaacaatggcagaagtgtggcgatcaaaaagctagattcaagtaaacagccagaacaagaatttttggcacaggtttccatggtgtcaagacttaagcatgacaatgtcgtggagttgcttggttactgtgttgatggaaacacccgtatccttgcttatgaatttgctactatgggttctcttcatgatatacttcacggccggaaaggtgtgaaaggagctcagccaggtccagtcctgtcttggacacaacgagtgaaaaatgctgttggagcagc

SEQ ID NO: 48238 - protein, 179 aa, Panicum virgatum
  misc_feature: Ceres CLONE 2041554
  misc_feature (58)..(177): Pfam Name: Pkinase_Tyr Pfam Description: Protein tyrosine kinase
  misc_feature: SWISSPROT Homolog: EC 2.7.11.1 Non-specific serine/threonine protein kinase
MSCLACCGGEDTQRAPDSGGPYPGGYPARNDAYRTAVPTPRGAQPVKVQPIAVPTIPVEEIREVTQGFGDEALVGEGSFGRVYYGVLNNGRSVAIKKLDSSKQPEQEFLAQVSMVSRLKHDNVVELLGYCVDGNTRILAYEFATMGSLHDILHGRKGVKGAQPGPVLSWTQRVKNAVGA

SEQ ID NO: 48239 - DNA, 704 bp, Panicum virgatum
  misc_feature: Ceres CLONE 2041580
  misc_feature: Encodes the peptide sequence at SEQ ID NO. 48240
acaaaaagcccccctcgcccattccttcccatcagcccaggccgtctgctactctgcattgttcctactcgctagtccctccgctcccgaaggatttctaaagcataaacacggaggacatggcgacaccgtacaaacctaagaacatcctcatcactggagctgctgggtttatcgcctcccatgtcgcgacccgcatcgtgaagaattaccctgactacaagattgtcgtcctcgacaagcttgactactgctcgaacctgaagaatctgctccccgtgagctcattgccaaacttcaagtttgtcaagggagacatcgcaagcgccgaccttgtcaacttcatccttgtcacagagaacattgacactgtgatgcactttgcagcccagacacatgttgacaattcctttggaaactctttcgagttcaccaagaacaatatttatggtacacatgtccttcttgaggcctgccggcagatcactggtcagatcaagaggttcatccatgtcagcactgatgaggtttatggagagacagatgaggatgcagttgttggcaaccatgagatgtcacagctgctccccacaaacccctacgcagccaccaaagccggagcggagatgcttgtcatggcctatgggagatcctatggtcttccagtcatcactactcgggggcacaatgtctatggccctaac

SEQ ID NO: 48240 - protein, 194 aa, Panicum virgatum
  misc_feature: Ceres CLONE 2041580
  misc_feature (10)..(194): Pfam Name: Epimerase Pfam Description: NAD dependent epimerase/dehydratase family
  misc_feature: SWISSPROT Homolog: EC 4.2.1.46 dTDP-glucose 4,6-dehydratase
  misc_feature: Functional homolog of the protein sequence given in SEQ ID NO 51125
  misc_feature: Useful for making plants with altered carbohydrate content
  misc_feature: Functional homolog of the protein sequence given in SEQ ID NO 51136
  misc_feature: Useful for making plants with altered cell wall content and/or composition
MATPYKPKNILITGAAGFIASHVATRIVKNYPDYKIVVLDKLDYCSNLKNLLPVSSLPNFKFVKGDIASADLVNFILVTENIDTVMHFAAQTHVDNSFGNSFEFTKNNIYGTHVLLEACRQITGQIKRFIHVSTDEVYGETDEDAVVGNHEMSQLLPTNPYAATKAGAEMLVMAYGRSYGLPVITTRGHNVYGP

SEQ ID NO: 48241 - DNA, 710 bp, Panicum virgatum
  misc_feature: Ceres CLONE 2041585
  misc_feature: Encodes the peptide sequence at SEQ ID NO. 48242
atcctcccctgctctctcgcagccctcatctctctctcgaaaccctcgcgccgccgccccctagtcttcgggaaaggttccgccatggccgcggagaccgagaccttcgccttccaggccgagatcaaccagctgctctcgctcatcatcaataccttctactccaacaaggagatcttcctccgtgagctcatctccaactcctccgatgccttggacaagatcaggttcgagagcctcacagacaagaccaagctggatgctcagccagagctgttcatccacatcgtccctgacaaggccaccaacaccctgacgatcattgacagtggcattggtatgaccaagtcggatctcgtgaacaaccttggtaccattgcacgttcagggacaaaggagttcatggaggctctggctgctggtgctgatgtgtctatgatcggtcagtttggtgttggcttctactctgcttaccttgttgctgagaaggtcgttgtgaccaccaagcacaatgatgatgagcagtatgtgtgggagtctcaggctggtgggtccttcaccgtcactcgtgatacatctggagagccccttggcaggggtaccaagatgaccctctatctcaaggatgatcagttggagtaccttgaggagcgtcgccctcaggatctggtcaaaaagcattctgagtttatcagctaccccatctctct

SEQ ID NO: 48242 - protein, 208 aa, Panicum virgatum
  misc_feature: Ceres CLONE 2041585
  misc_feature (28)..(182): Pfam Name: HATPase_c Pfam Description: Histidine kinase-, DNA gyrase B-, and HSP90-like ATPase
MAAETETFAFQAEINQLLSLIINTFYSNKEIFLRELISNSSDALDKIRFESLTDKTKLDAQPELFIHIVPDKATNTLTIIDSGIGMTKSDLVNNLGTIARSGTKEFMEALAAGADVSMIGQFGVGFYSAYLVAEKVVVTTKHNDDEQYVWESQAGGSFTVTRDTSGEPLGRGTKMTLYLKDDQLEYLEERRPQDLVKKHSEFISYPIS

SEQ ID NO: 48243 - DNA, 708 bp, Panicum virgatum
  misc_feature: Ceres CLONE 2041596
  misc_feature: Encodes the peptide sequence at SEQ ID NO. 48244
ctcccggcagggcaacgaggcgctggacaggatgctgctgcggcaggggaagccggaggggaagaagagcatgctggtggtgtccgagttcatcgggtgttcaccctccctgagcggggcggtgagggtgaacccatggaacatcgaggccgtggccgacgccatggagagcgcgctcgtgctgcccgagagcgagaagaggctgcgccacgacaagcacttccgctacgtgaacacccacgacatggggtactgggccaacagcttcctggtggacctcgagaggacctgcgtggaccacgacaagcgccggtgctggggcatcggcttcggcctgcgcttcagagtggtctcgctcgacctgagcttcaagaagctctccctggagagcatcctcatggcgtaccggagggccaagaagcgtgcggttctgctggactacgatggcacgctgatgccgcaggcgattaacaagagcccgtccgcggagtcggtgaggatactcaacagcctgtgccgggacaagagcaacgaggtgtacctctgcagcgggtatgaccggcgcactctgcacgagtggttcccttgtgagaaccttggcatagcggcagagcatggctatttcgtgaggtgtaggagggacgcagagtggcagacctgcatcactgctgccgattgcagctggaagcagatcgcaaagccggtgat

SEQ ID NO: 48244 - protein, 235 aa, Panicum virgatum
  misc_feature: Ceres CLONE 2041596
  misc_feature (120)..(230): SWISSPROT Homolog: EC 3.1.3.12 Trehalose-phosphatase
  misc_feature (25)..(95): SWISSPROT Homolog: EC 2.4.1.15 Alpha,alpha-trehalose-phosphate synthase (UDP-forming)
  misc_feature: Functional homolog of the protein sequence given in SEQ ID NO 50801
  misc_feature: Useful for making plants with altered carbohydrate content
SRQGNEALDRMLLRQGKPEGKKSMLVVSEFIGCSPSLSGAVRVNPWNIEAVADAMESALVLPESEKRLRHDKHFRYVNTHDMGYWANSFLVDLERTCVDHDKRRCWGIGFGLRFRVVSLDLSFKKLSLESILMAYRRAKKRAVLLDYDGTLMPQAINKSPSAESVRILNSLCRDKSNEVYLCSGYDRRTLHEWFPCENLGIAAEHGYFVRCRRDAEWQTCITAADCSWKQIAKPV

SEQ ID NO: 48245 - DNA, 715 bp, Panicum virgatum
  misc_feature: Ceres CLONE 2041608
  misc_feature: Encodes the peptide sequence at SEQ ID NO. 48246
aaagcttcctcagagcgctcgcgcgaaaccagccgagaggtctcgaggagaacgaacgaagcagccagattcccaagccgatttgggacgccggccggccacctcgccgtagttgccacacactcccaccccccacccccccacccccacccctactctgctcctgctcgtctctgaatcttcctccctcgcggggactttccgcggtttcctcgggattccttgcccggccgggaacggcggcgggcgctcacgaggggaaaggaaagaaaagctccgatttttctttccctgccgagttcgcttccgattcattcccactatcttgagcagcagcctgcgcgcggccagcctcgccgcgggagtttttcttggcttttttgctcggccagaattagccattccctggagctaaaggccgagctcggccggggctaaacttcgcatcttctccgcggcggccgcgggggaattcgttcttctcccgtcagtcgccgccgtatctcgctcgccggccgggggagcggcgggggcggcaggcatggggctcggcttggtggcgcacctggtgcgcctgggcgtgctgggctccacctccgaccacgcgccggtggtgtccatcaacctgttcgtggcgctgctctgcgcctgcatcgtcctcggccacctcctcgaggagaaccggtgggtcaacgagtccatcaccgcgctcatc

SEQ ID NO: 48246 - protein, 57 aa, Panicum virgatum
  misc_feature: Ceres CLONE 2041608
  misc_feature: The sequence is a functional homolog of SEQ ID NO 2 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 4 in US patent 7250560
MGLGLVAHLVRLGVLGSTSDHAPVVSINLFVALLCACIVLGHLLEENRWVNESITAL

SEQ ID NO: 48247 - DNA, 397 bp, Panicum virgatum
  misc_feature: Ceres CLONE 2041615
  misc_feature: Encodes the peptide sequence at SEQ ID NO. 48248
atcatgctgctgctgcaaaaatccgattcataattttctataatcccagggcaaatatatttgaatttgttatctccctttcaaagtacatcaaggctgttttccacgccctgatatcggttgggatgctattctcgatgttgtatgacaccgaagaatctctcgcccgcaggtacctgtagacgataactgaattaattgatgcctacccagtgcgctggcctaattcctattgtagatcggcaaaggtagattgggatgaatcaacagcaggagaaaggcctcctagagtttctctgtgggaaattgaacccttgacaacctttccaatgtatccatctctgttccaactgcgagttaatcatccttggtattctggagttgctgctcttcatgg

SEQ ID NO: 48248 - protein, 59 aa, Panicum virgatum
  misc_feature: Ceres CLONE 2041615
  misc_feature (1)..(59): Pfam Name: Auxin_resp Pfam Description: Auxin response factor
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 100 in the 10/666,642 US patent application
  misc_feature: Functional homolog of the protein sequence given in SEQ ID NO 50498
  misc_feature: Useful for making plants with modulated light quality sensitivity
HAAAAKIRFIIFYNPRANIFEFVISLSKYIKAVFHALISVGMLFSMLYDTEESLARRYL

SEQ ID NO: 48249 - DNA, 667 bp, Panicum virgatum
  misc_feature: Ceres CLONE 2041625
  misc_feature: Encodes the peptide sequence at SEQ ID NO. 48250
aagcgtcccgtcccgtcccgtccagacttgaaaggatcagcaccagcaggcagcagcgtgcagtacgcgccacggcaatctggggccaagcagtcgcatctcatcggagtggactaaccgaccaacgcccccgtccgatccgaggggcgacgcggcgggagggccccccatggacttgtcgtcgtcgtcgtcggggcagcggcgccggcgccgtcggagggcgcacacggctgaggaggcggcggagactctgcggaaggcgtggtgccggctgcgcctctcggcgcgggacccggcgcgcgtgccgccctgggacgccgtcgtgctcacggccgccagccccgagcaggcagcgctctacaaccgccagctcgagcgtgcccggagcctcggtcgcttccccgcctccactacggccatcgccgtcccggacccagacggcgcccgaatcggctccggcgctgccacgctacacgccgtcgcctccctcgttcgccacctcgccgcccaggcttccaaggaagatatagctgaattccttcccgaagcaaatggctgttctggggatgactccgcacttgccgcagcagcgagcttcatggcgaagaagcacgtgctcttacttcacgccgggggtgacagcaagagggttccatgggcgaacccc

SEQ ID NO: 48250 - protein, 165 aa, Panicum virgatum
  misc_feature: Ceres CLONE 2041625
  misc_feature: SWISSPROT Homolog: EC 2.7.7.30 Fucose-1-phosphate guanylyltransferase
MDLSSSSSGQRRRRRRRAHTAEEAAETLRKAWCRLRLSARDPARVPPWDAVVLTAASPEQAALYNRQLERARSLGRFPASTTAIAVPDPDGARIGSGAATLHAVASLVRHLAAQASKEDIAEFLPEANGCSGDDSALAAAASFMAKKHVLLLHAGGDSKRVPWAN

SEQ ID NO: 48251 - DNA, 699 bp, Panicum virgatum
  misc_feature: Ceres CLONE 2041647
  misc_feature: Encodes the peptide sequence at SEQ ID NO. 48252
cacgcgaaccctctcgcagctggagtcacgcaaccgccgtctcctcgccggcacgctccgccgctgccgctcctctcctcgtcgccacgactcgccgcccgcacgcgcagaaagaaaggcggaaaagaaaaggagcagagaaactgcaagctcttcactcttcgtcccccgccgcaatcgcccccgcccacccgtccgccgccgcttctccccggcgtccttttcctcctccggcccggcggcccccatgccgtccatgccaagcaacctaaatcgctccgcgcgttcttgatctcgtcgtcctttcctcgaattcctctcccgcaacatatcggttcttcggcaccgaaagatggtcggcggcggcaatgagttccggttcttcttgtcctgcgacatcagcctcccgctcaccttccgcgtcctccacgcagaacatatcctgttgacccagcaaaaaactccagagctctttgttgagtgcaagctatacatcgatgggatactatttgggttgccagtaaagacaaggttggaaccttcaggaccgatgtactgttggaatgagctgataacacttagtaccaagtacagggacctaacttccctctcacaacttgcttttacggtgtgggatgtgtcatctggtgaggaacctgagattgtcggtggagctaccatattcctttttcacagcaa

SEQ ID NO: 48252 - protein, 115 aa, Panicum virgatum
  misc_feature: Ceres CLONE 2041647
  misc_feature: SWISSPROT Homolog: EC 2.7.1.137 Phosphatidylinositol 3-kinase
MVGGGNEFRFFLSCDISLPLTFRVLHAEHILLTQQKTPELFVECKLYIDGILFGLPVKTRLEPSGPMYCWNELITLSTKYRDLTSLSQLAFTVWDVSSGEEPEIVGGATIFLFHS

SEQ ID NO: 48253 - DNA, 679 bp, Panicum virgatum
  misc_feature: Ceres CLONE 2041686
  misc_feature: Encodes the peptide sequence at SEQ ID NO. 48254
gtggaagctttcgcctcttcctcttcctcttcctcgccctccgtcgtcttccttcccaatagccccctctctctccagtcgccaaagcttaacacacccgcgcacgccgccccatcccccacccccccccccacccccgcctcgccgcccttccatctctctctctcgccgtctcgccgcccttccatctctctctctcgccgtctcgccgccctcgccccccgccgcgatccagggagccagcgagcggccggccatggccgcgggggcgatccggatcaccatggaggtgggcgccgacggcgtcgcgctcatcaccatcgccaacccgcccgtcaacgcgctccaccccatcatcatcgccgggctcaaggacaagtacgcggaggccgcgcgccgcgacgacgtcaaggccatcgtgctcaccggtgctggaggcaagttctgcgggggatttgatatcaatgttttcacgaaggttcatcagactggggatgtgtcgcttatgccagacgtatccgttgagcttgtgtcaaacatgatggaagagggcaaaaaaccttctgttgcagctattcaaggccttgctctgggtggtgggctagaattggctatgggttgtcatgctcggatatctacccctgaagctcagcttggattacagagctgacgctgggca

SEQ ID NO: 48254 - protein, 137 aa, Panicum virgatum
  misc_feature: Ceres CLONE 2041686
  misc_feature (18)..(137): Pfam Name: ECH Pfam Description: Enoyl-CoA hydratase/isomerase family
  misc_feature: SWISSPROT Homolog: EC 4.1.3.36 Naphthoate synthase
MAAGAIRITMEVGADGVALITIANPPVNALHPIIIAGLKDKYAEAARRDDVKAIVLTGAGGKFCGGFDINVFTKVHQTGDVSLMPDVSVELVSNMMEEGKKPSVAAIQGLALGGGLELAMGCHARISTPEAQLGLQS

SEQ ID NO: 48255 - DNA, 683 bp, Panicum virgatum
  misc_feature: Ceres CLONE 2041706
  misc_feature: Encodes the peptide sequence at SEQ ID NO. 48256
tttgatttctgcggcgcacgatggggagcaggagggaggaggagaggaacgagaagatcatccgcggcctcatgaagttgccgcccaaccgcaagtgtatcaattgcaacagtgtgggcccgcaatatgtatgtaccaatttctggaccttcatttgcctgtcatgtagtggaattcaccgtgagttcactcaccgtgttaaatcagtgtcaatgtccaaatttacaacccaggaagtgcggactcttgaacaggggggtaatcagcgagctcgcgacatctacctaaaggactgggattggcaatgaatgaggttgcctgtcaataccaatccggataagataagggaatttatcaggactgtttatgtggacaagaagtatgctggtgggtcctcttacaagccagcaacagataatgagagtgtaaaaagcaatgaaaatgaaatgagaagacctaactcctatcactcatactcccaaagcccaccttatgattttcagtatgaagatagaagatatggtaagcaagttgacacgcttgctcgaaggccttcagatagggcactcttcgatgggaagctcggcaactttctattcagtccaggtcgtttgcgagatcagatgaatgaagaccgatttgctaatgaaagttcagggtcaaagttttctgacttttcagcc

SEQ ID NO: 48256 - protein, 95 aa, Panicum virgatum
  misc_feature: Ceres CLONE 2041706
  misc_feature (11)..(95): Pfam Name: ArfGap Pfam Description: Putative GTPase activating protein for Arf
MGSRREEERNEKIIRGLMKLPPNRKCINCNSVGPQYVCTNFWTFICLSCSGIHREFTHRVKSVSMSKFTTQEVRTLEQGGNQRARDIYLKDWDWQ

SEQ ID NO: 48257 - DNA, 719 bp, Panicum virgatum
  misc_feature: Ceres CLONE 2041708
  misc_feature: Encodes the peptide sequence at SEQ ID NO. 48258
ccgtttacatctctctgactgtcttccttccctggcggcgacgagtgggagagcggcggcgctattagtcacgtcttcgcccagcgctttgccggcgacgagcatccaccagaaagtaccactgacccccagagttgtgtagaagatgggtatccttgagaggatcaaggagattgaggccgagatggctcggacgcagaaaaataaagcaacagaatatcatcttggacaactgaaggcaaagttagcaaagctgaggacacaactattggagcctccgaagggttccagtggaggaggagatggttttgaagtcacaaagtttgggcatggtcgtgttgcactgattggatttcccagtgttggaaagtcaactcttttaactatgttgaccgggacacactctgaagctgcatcatatgagttcacaaccctgacttgcattcctggaattattcactacaatgataccaaaatccagcttcttgatcttcctggtattattgaaggagcctctgaaggcaaggggcgtggtaggcaggttattgccgttgcgaagtcatcagaccttgtactgatggttctggatgcctcaaaggttattggttaactgaatattctttgctaaattgcttttgcattccttcctattactctttctttagaacacctaagtttttgaagcacagttaagattttatgttaggagagcgggggag

SEQ ID NO: 48258 - protein, 154 aa, Panicum virgatum
  misc_feature: Ceres CLONE 2041708
  misc_feature (63)..(154): Pfam Name: MMR_HSR1 Pfam Description: GTPase of unknown function
MGILERIKEIEAEMARTQKNKATEYHLGQLKAKLAKLRTQLLEPPKGSSGGGDGFEVTKFGHGRVALIGFPSVGKSTLLTMLTGTHSEAASYEFTTLTCIPGIIHYNDTKIQLLDLPGIIEGASEGKGRGRQVIAVAKSSDLVLMVLDASKVIG

SEQ ID NO: 48259 - DNA, 503 bp, Panicum virgatum
  misc_feature: Ceres CLONE 2041727
  misc_feature: Encodes the peptide sequence at SEQ ID NO. 48260
acagctcggcagctcacacccgagcagcagcgcagcgcacagccggcgcatgtgagcgggccggcgccgcgaggggcacacgcattctttctccgccgggaaacgaggtccggcggcgatggaggcgagcgcggggctggtggccggctcgcacaaccggaacgagctggtggtgatccgccgcgagcccggcggcggggggcccggggcggcggcgcggctggcggcggaggcgccgtgccagatatgcggggacgacgtcggggtgggcttcgacggggagcccttcgtggcctgcaacgagtgcgccttcccggtctgccgcgcctgctacgagtacgagcgccgcgagggctcgcaggcgtgcccgcagtgccggacgcggtacaggcgcctgaaagggtgcccccgcgtcgccggcgacgaggacgaggacggcgtcgacgacctcgagggcgagttcggcctgcgccacggcggggacggggacgggcgggggacgg

SEQ ID NO: 48260 - protein, 128 aa, Panicum virgatum
  misc_feature: Ceres CLONE 2041727
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Functional homolog of the protein sequence given in SEQ ID NO 50499
  misc_feature: Useful for making plants with altered cell wall content and/or composition
  misc_feature: Useful for making plants with modulated biomass
MEASAGLVAGSHNRNELVVIRREPGGGGPGAAARLAAEAPCQICGDDVGVGFDGEPFVACNECAFPVCRACYEYERREGSQACPQCRTRYRRLKGCPRVAGDEDEDGVDDLEGEFGLRHGGDGDGRGT

SEQ ID NO: 48261 - DNA, 672 bp, Panicum virgatum
  misc_feature: Ceres CLONE 2041731
  misc_feature: Encodes the peptide sequence at SEQ ID NO. 48262
attacttttgatgaggcgcgcaaagcacgctttatgttctcgttcagtaaaaaggcccaatccctcaccttcccgtcgccgccgccgccccccctccacccacccacccccaccgacggacgcggaagcgcggcgactagggttcggccctgcccgccgccggccgtacccacccaacctccgtgcgcctctcaaaggggcgcgaatcgggccgcctttctcccgcagcaggaagtccgcccacacctagccaggctgtctcctcccataccctgcttcaccaccacagacgccggctcacctcctcgcggacgcgagccatccacggcgtggacccgtttgctgcctccggattccgcccccacgacgcaatcctcttgccccaagccgaggagttcaccatgtatgacttggagtccgtggctgcccttatggagtcgacaagctctaagatagagcagcttcagcaggcttttgctgagctcgaggggcagagtgctgtctccatgaacctcaagtggaagcagcttgacgaccactttcgtggctttgagcagtcgctcaagaaaaaatttgatgagttaaaagagcaggagaaggagttccaggagacggttgcgaaatcggagaagatgctggagcagcgggaggcagctgttgtggccaaggaac

SEQ ID NO: 48262 - protein, 90 aa, Panicum virgatum
  misc_feature: Ceres CLONE 2041731
  misc_feature: Functional homolog of the protein sequence given in SEQ ID NO 51747
  misc_feature: Useful for making plants with altered carbohydrate content
  misc_feature: Functional homolog of the protein sequence given in SEQ ID NO 51748
  misc_feature: Useful for making plants with altered alkaloid content
MYDLESVAALMESTSSKIEQLQQAFAELEGQSAVSMNLKWKQLDDHFRGFEQSLKKKFDELKEQEKEFQETVAKSEKMLEQREAAVVAKE

SEQ ID NO: 48263 - DNA, 586 bp, Panicum virgatum
  misc_feature: Ceres CLONE 2041757
  misc_feature: Encodes the peptide sequence at SEQ ID NO. 48264
tatttaaaatgcatggttgtagggaggaagttccatgatattgttggcagtgcctattatgttgcaccagaagtattaaaacgacgatctggtcctgagtctgatgtttggagcataggagttataacctacattttgctctgtgggaggcgaccattttgggataagacagaagatggtatattcaaggaggtaagttgagaacttttgcataccatgtgcttccatgtaaaatatgcttagtgggagtgccataccaggtattttcagcgcgctgacaatgttttctgcaatttgttttgacatcatacctgttaactatttgtcagtgtctgcaatataattatacaactttaaacatgtaaggcaattatctatttggcgaggctgtccttcagtgatttttgtactaggtgccagaatacgactgtaacaaagtaagaatacccaccatctttcatatgtgtgatgtgcagtgttgcacagatttcattatgatgcgcctaagatgagttagtagctgaattgcctttcagtcctccgcttgtagttaacttgaagtctggagacaacctgtggcctcagg

SEQ ID NO: 48264 - protein, 66 aa, Panicum virgatum
  misc_feature: Ceres CLONE 2041757
  misc_feature: SWISSPROT Homolog: EC 2.7.11.1 Non-specific serine/threonine protein kinase
  misc_feature: The sequence is a functional homolog of SEQ ID NO 2 in US patent 7084323
YLKCMVVGRKFHDIVGSAYYVAPEVLKRRSGPESDVWSIGVITYILLCGRRPFWDKTEDGIFKEVS

SEQ ID NO: 48265 - DNA, 649 bp, Panicum virgatum
  misc_feature: Ceres CLONE 2041784
  misc_feature: Encodes the peptide sequence at SEQ ID NO. 48266
gaaggcgaaacacgcacacaacacgagagacacaacccacagagataagagagaatgtcatctcctttagtgaccggcgggtgctttgctcttaagtctaagattaatggaaaatacttgcactactcgcctgagaaagagaaaatccttgaggtgagtggggaagatgtcctcagtccctacactaggttttgtgcagaaccatccaaggagcacgacggccacattcacatcagatgctgctacaacaagtactgggtcgcccgtgaggttaaccagcagtggtgcctcatgggtgatgcaaatgagccccaagaggacctatcagatccttcttgcacggtgctccggcatgaacccagcagtgttcacgtcgatgatgtcaaaatcaagggtacgggcagccaagtgagcggcctgtgccagatctatggcggttggggcgaggaactccaccaggataccgatgtgatggcggaggggaagcagcccttgaagaacactggagaagtgggctacctgatgagcacgagcgcctcctgcatgccatgtcactgtgaacgccctccctaatccctagtctcggtcacggtcagtagttatacatggcaatcctatccccatttccttgttgagttccttgaaactt

SEQ ID NO: 48266 - protein, 172 aa, Panicum virgatum
  misc_feature: Ceres CLONE 2041784
  misc_feature (10)..(152): Pfam Name: Agglutinin Pfam Description: Agglutinin
MSSPLVTGGCFALKSKINGKYLHYSPEKEKILEVSGEDVLSPYTRFCAEPSKEHDGHIHIRCCYNKYWVAREVNQQWCLMGDANEPQEDLSDPSCTVLRHEPSSVHVDDVKIKGTGSQVSGLCQIYGGWGEELHQDTDVMAEGKQPLKNTGEVGYLMSTSASCMPCHCERPP

SEQ ID NO: 48267 - DNA, 634 bp, Panicum virgatum
  misc_feature: Ceres CLONE 2041789
  misc_feature: Encodes the peptide sequence at SEQ ID NO. 48268
gcgtcgtcgtcgaaaccgagctcccaaatcgcggaaaccctagcccccaaatcataccgcagcagcagctggtactgaaccctatcctctcgccgaggcctcgactccctcccccacccaaaaacccagaaccccccctctaatccgattctttctttgcagccgccgccgctccaatcccccttacttccccagctccgctcgctagatccattcatgatgggagaggccaaggagaacgacgtatacgaggaggagctcctggactacgaggaggacgacgacaagacagtcgatggctccgccgccaagcccaccggagaggtcgcgaagaagggctacgtcggcatccacagttccgggttcagagacttcctcctcaagccagagctgcttcgtgctatccaggactgcggttttgagcatccatccgaagtgcaacacgagtgcatccctcaagcaattcttgggatggatgtcatatgtcaagcaaaatctgggatggggaagactgcagtttttgtcctatcatccctccaacagattgatcctgttgcgggtcaggtagcagcacttgtattgtgccacacaagggaactcgcctaccagatctgccatgagtttgagaggttca

SEQ ID NO: 48268 - protein, 139 aa, Panicum virgatum
  misc_feature: Ceres CLONE 2041789
  misc_feature: Functional homolog of the protein sequence given in SEQ ID NO 50368
  misc_feature: Useful for biocontainment applications
  misc_feature: Useful for making plants with modulated biomass
  misc_feature: Useful for making plants with modulated cold sensitivity
MMGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERF

SEQ ID NO: 48269 - DNA, 660 bp, Panicum virgatum
  misc_feature: Ceres CLONE 2041790
  misc_feature: Encodes the peptide sequence at SEQ ID NO. 48270
ggccggcgagtcgacagggaaaatctccgaggggaggagaccgcgagatgtccttcttcttccgcatggcgtcgcggctgcggccgtcgacgccggaggaggtcgtccgctccatcaaggactccttcctcgcgctcaacaccaggacccacaccaaggctctggaagaggttgagaaaaacattgcatccttgagattgttgatctctggtgatggagaggtggaaccaaatcaagagcaggtcctgcaaataactattgagatttgcaaggaggacatcatttccctcttcgtccagaatctaccttccttgggttggacagtaagaaaagatctggttcactgctggtgcattttgctgaggcagaaaaatgttgaaagttattgctgtgtgcagtatattgaaaatcatttggagcttttggatttccttgttggttgctacaagaacttggatattgcattgaactgtgggaatatgttaagagaatgcataaagtacccaactctagcaaagtaagggttcaaatttcccattcaattttgattcccatttgtttgcagttcataggacattcgcaaccaagcataccttaataaatatagtactacatgcatcaaagagagaacaaattgcaatgatctatgtgtttgggtgt

SEQ ID NO: 48270 - protein, 157 aa, Panicum virgatum
  misc_feature: Ceres CLONE 2041790
  misc_feature (1)..(157): Pfam Name: Mo25 Pfam Description: Mo25-like
MSFFFRMASRLRPSTPEEVVRSIKDSFLALNTRTHTKALEEVEKNIASLRLLISGDGEVEPNQEQVLQITIEICKEDIISLFVQNLPSLGWTVRKDLVHCWCILLRQKNVESYCCVQYIENHLELLDFLVGCYKNLDIALNCGNMLRECIKYPTLAK

SEQ ID NO: 48271 - DNA, 661 bp, Panicum virgatum
  misc_feature: Ceres CLONE 2041797
  misc_feature: Encodes the peptide sequence at SEQ ID NO. 48272
acgaaccattatctctctggcctggctgctagcaagtagcaacgcataactgcctcggtcatttctttcagtctcaccaatggcttcgacagtgctactgcttctcatggtcgtggccatccacggcggcagtgactggagcttcgcgtcggacaccatctccgccgactcccccatctccggtgaccaaaccgtcgtgtcgagaggcggaaaattcgagctcggcttcttcagtcccgctggtggcggcggcagcaactactacgtggggatctggtacaagaaggtcgtgtcgcagcgcacgccggtgtgggtcgccaacagggccgtgccggtcgccgacccggcgtcctctcggctcgccgtggcggcgaacggcaacatcgtgctcaccaacgaagttggcaaggtcgtctggtcctcgaacgtcagctccgccagtggctcgaccgctgccgccgtggcggtgatcttggacaccggcaacctcgtgctccggcgcgagagcggcggcgaggttctgtggcagagcgcggagcacccaaccgacacgtgtctccctggagtccaccttggcatgaacaagatcaccggcgacatgcagccgctggtatcttggaagaacgccggcgacccggctcccggcatgttcaccatgggg

SEQ ID NO: 48272 - protein, 193 aa, Panicum virgatum
  misc_feature: Ceres CLONE 2041797
  misc_feature (73)..(187): Pfam Name: B_lectin Pfam Description: D-mannose binding lectin
MASTVLLLLMVVAIHGGSDWSFASDTISADSPISGDQTVVSRGGKFELGFFSPAGGGGSNYYVGIWYKKVVSQRTPVWVANRAVPVADPASSRLAVAANGNIVLTNEVGKVVWSSNVSSASGSTAAAVAVILDTGNLVLRRESGGEVLWQSAEHPTDTCLPGVHLGMNKITGDMQPLVSWKNAGDPAPGMFTM

SEQ ID NO: 48273 - DNA, 658 bp, Panicum virgatum
  misc_feature: Ceres CLONE 2041799
  misc_feature: Encodes the peptide sequence at SEQ ID NO. 48274
accataccaccactccctcccgatccctccaccgccaccgcctcctccgcctcacccctcttctcgcctcgtgcgtcgaccggcggccgatcgtctgcggcccagacatggggctcttcactgtcacgaagcaggccaccacgcccttcgacggccagaagcccggcacctccggcctccgcaagaaggttactgtattccagcagcctcattatctgcagaactttgtccaatcaacattcaatgcccttcctgctgatcaagtaaaaggtgcgaccattgttgtctctggtgatggccgctatttctcgaaagatgctgttcagatcataacaaaaatggctgctgccaacggagtaagacgtgtttgggttggactaaacagtctcatgtcaacccctgctgtatctgctgttatccgtgaaagaaccggtgcagatggatcaaaggctaccggtgccttcatcctgacagcaagccataacccaggtggtccgactgaggattttgggatcaaatacaatatgggaaatggtgggcctgcacctgaatccgttactgatagtattttctctaatacaaagacaatctctgaatacctcatcgctgaagaccttccagatgttgatatttctgttgctggtgtcactagctacag

SEQ ID NO: 48274 - protein, 183 aa, Panicum virgatum
  misc_feature: Ceres CLONE 2041799
  misc_feature (16)..(165): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKQATTPFDGQKPGTSGLRKKVTVFQQPHYLQNFVQSTFNALPADQVKGATIVVSGDGRYFSKDAVQIITKMAAANGVRRVWVGLNSLMSTPAVSAVIRERTGADGSKATGAFILTASHNPGGPTEDFGIKYNMGNGGPAPESVTDSIFSNTKTISEYLIAEDLPDVDISVAGVTSY

SEQ ID NO: 48275 - DNA, 557 bp, Panicum virgatum
  misc_feature: Ceres CLONE 2041801
  misc_feature: Encodes the peptide sequence at SEQ ID NO. 48276
tactcatccaaaaatggggcagatcttcagctgcatcaaccgctgtttcaatagtggatgctattagatcccttgtaactcccaccccagaaggcgattggttctcttcaggggtttatactactggaaatccttatggcatagcagaggacaccgtgttcagtatgccatgcagatcaaagggtgatggtgactatgaactagctactgatgtgttaatggacgattttctctgggaacgtattaaaaagactgaagctgagttgattgctgagaagaaatgtgttgcccatcttacaggagaggggattgcattttgtgatcttccagaagataccatgctaccaggagagatgtaagttagtaacagcagcacgaccgggcgaatgcgcacttatgttaatacagtttccggcggaaacaaagacgatagttgagagatgcagctgcttacagatgcagcagctatctatatgtatattcagtaagtgtgccataggaatttgcctatgatgcgaagtttgtacactaataaagtaacaaacatgatgcggagc

SEQ ID NO: 48276 - protein, 118 aa, Panicum virgatum
  misc_feature: Ceres CLONE 2041801
  misc_feature (1)..(99): Pfam Name: Ldh_1_C Pfam Description: lactate/malate dehydrogenase, alpha/beta C-terminal domain
  misc_feature: SWISSPROT Homolog: EC 1.1.1.82 Malate dehydrogenase (NADP(+))
LIQKWGRSSAASTAVSIVDAIRSLVTPTPEGDWFSSGVYTTGNPYGIAEDTVFSMPCRSKGDGDYELATDVLMDDFLWERIKKTEAELIAEKKCVAHLTGEGIAFCDLPEDTMLPGEM

SEQ ID NO: 48277 - DNA, 692 bp, Panicum virgatum
  misc_feature: Ceres CLONE 2041813
  misc_feature: Encodes the peptide sequence at SEQ ID NO. 48278
ctttatggcaagcctgatgctacaatggccgaggttgaggctgctgctacttcagctaatgcccatagcttcattgttctgcttcctaatggctacaacactcatgtgggtgagagggggcttcagctctctggtggtcagaagcaacgtattgccattgctcgtgcaatgctgaagaatccaaagattctgctcctagatgaggccactagtgcactcgatgctggttcagagagtattgttcaggaagcgcttgatcgcttgatggtcggcaggactaccgttgtggttgcacacaggttatcaaccataaggtgtgtcgacatgattgccgtgatccagcaagggcaggttgtggagaccggtactcatgatgaactcctcgccaagggtagctcaggagcttacgctgctctcataagatttcaagagacatctagaaaccgtgcatgcccatcaacccgcaagtcccggtcatcccgcttgagcaactccctgtccacccgctccttgagcctcaggtcaggaagcttgaggaacctgagctactcatacagcacgggcgccgacggtcgcattgagatggtttccaacgccgacaatgaccggaagtacccagcgccaaggggttacttcttcaagctcctcaagctgaacgcaccggagtggccctacaccatactgggtgccat

SEQ ID NO: 48278 - protein, 230 aa, Panicum virgatum
  misc_feature: Ceres CLONE 2041813
  misc_feature (1)..(116): Pfam Name: ABC_tran Pfam Description: ABC transporter
  misc_feature: SWISSPROT Homolog: EC 3.6.3.44 Xenobiotic-transporting ATPase
  misc_feature: The sequence is a functional homolog of SEQ ID NO 3 in US patent 7041874
LYGKPDATMAEVEAAATSANAHSFIVLLPNGYNTHVGERGLQLSGGQKQRIAIARAMLKNPKILLLDEATSALDAGSESIVQEALDRLMVGRTTVVVAHRLSTIRCVDMIAVIQQGQVVETGTHDELLAKGSSGAYAALIRFQETSRNRACPSTRKSRSSRLSNSLSTRSLSLRSGSLRNLSYSYSTGADGRIEMVSNADNDRKYPAPRGYFFKLLKLNAPEWPYTILGA

SEQ ID NO: 48279 - DNA, 677 bp, Panicum virgatum
  misc_feature: Ceres CLONE 2041814
  misc_feature: Encodes the peptide sequence at SEQ ID NO. 48280
aatcagatcgaagaacacaaggcatgtgtaatagaggcaagcgagaggcgcaagaggtataatttttttgaggcgacttccataactaatacttctgttgttgacccacggctgccagcgctctatgtggagatagataagcttatcggcattgatggtccaaaaatggatatcattgagtggttaaccgcagaaacgaaagattcttcaaaagaacttaaagtgctatcacttgttggttgtggaggtattggtaagactactcttgcaaatcaagtctaccgaagtgttaaaagccagttttcctgtgcggcgtttgtgtcagtttctcgaaatcctgacatcaagaagattctaagagatatggctaaaggactcgggatcactgataatacactggattatgatgagcagcaactcattaataaactgagggaacatctcatgaataaaaggtaccttcttgtagttgatgtatgggacgcaaaaccatgggaaaccatcaagcttccattagtgaatgaaaattgcgggagcagaataatccctacgacacgtagcattgcagttgcatcatgcttgtcttccgaaagcaataatgtttataaaatgaagcctctgagttttgatgactccagaaggttgctttttaaaagagcatttggttctgaaaacat

SEQ ID NO: 48280 - protein, 225 aa, Panicum virgatum
  misc_feature: Ceres CLONE 2041814
  misc_feature (33)..(225): Pfam Name: NB-ARC Pfam Description: NB-ARC domain
NQIEEHKACVIEASERRKRYNFFEATSITNTSVVDPRLPALYVEIDKLIGIDGPKMDIIEWLTAETKDSSKELKVLSLVGCGGIGKTTLANQVYRSVKSQFSCAAFVSVSRNPDIKKILRDMAKGLGITDNTLDYDEQQLINKLREHLMNKRYLLVVDVWDAKPWETIKLPLVNENCGSRIIPTTRSIAVASCLSSESNNVYKMKPLSFDDSRRLLFKRAFGSEN

SEQ ID NO: 48281 - DNA, 690 bp, Panicum virgatum
  misc_feature: Ceres CLONE 2041837
  misc_feature: Encodes the peptide sequence at SEQ ID NO. 48282
acgcctcgctccctcttctttctcctcctccatctcttgccccagcgcagcgtcgccgtcgagagcgaggtacacgagctagtttcccacaacaaccgcagcagctaatcacagctgttgatcgcacgccgagctgcattcttgcacgctagctagacccctgcctccaacaatggcgctccaggcatcgacgccttccgtgttccgcgcggtcccggccaccgcccacgctccctgccggcggcagcagtttcaggtgcgcgcgagcgcggcggcccagagcgccggcggcagcagcggcggcgccgacgggaagatggtcgtccccaaggagccgaggccgagctcggccccgtggaaggtggagttctccggcgagaagccggcgacgccgctgctcgacaaggtcaactacccggtccacatgaagaacctctcgaccccggagctggagcagctggcggcggagctccgcgcggagatcgtgcacacggtgtccaagaccggcggccacctgagctccagcctgggcgtggtggagctcgccgtggcgctgcaccacgtgttcgacacccccgaggacaagatcatctgggacgtcggccaccaggcgtacccgcacaagatcctcaccggccggcgctcccagatgcacaccatccggcagacctccgggctggcgggcttccc

SEQ ID NO: 48282 - protein, 172 aa, Panicum virgatum
  misc_feature: Ceres CLONE 2041837
  misc_feature: SWISSPROT Homolog: EC 2.2.1.7 1-deoxy-D-xylulose-5-phosphate synthase
MALQASTPSVFRAVPATAHAPCRRQQFQVRASAAAQSAGGSSGGADGKMVVPKEPRPSSAPWKVEFSGEKPATPLLDKVNYPVHMKNLSTPELEQLAAELRAEIVHTVSKTGGHLSSSLGVVELAVALHHVFDTPEDKIIWDVGHQAYPHKILTGRRSQMHTIRQTSGLAGF

SEQ ID NO: 48283 - DNA, 714 bp, Panicum virgatum
  misc_feature: Ceres CLONE 2041869
  misc_feature: Encodes the peptide sequence at SEQ ID NO. 48284
gcccgagtcagatcagatcaaagcggcgccacacgggagggcctcccatttcgcggatcaagaagaggctagggttcccgcgtagcgagccgccgaccccgcttcagccatgatgtcgaggtcgtacaccaacctactcgacctcgccgcggggaacttcgcggcgctgggcccgtccggcggcgggaggcggcggtcggggtcgttcgggatgaagcggatgccccgggtcatgacggtgcccgggccgctgtccgacctggacgacgacgacgacgagcaggcggcgaccagcagcgtcgcctccgacgtgccctcgtcggccgtcggggagcgcctcatcgtggtggccaaccagctccccgtcgtcgcgcgccgccgcgccgacggccgcggctgggtcttctcctgggacgaggactcgctcctcctcaggctccgcgacggcgtccccgacgagatggaggtgttcttcgtcggctcgctccgcgccgacgtgccgcctgccgagcaggacgaggtctcgcagaccctcatcgacggcttccgctgcgcccccgtgttcctgtcgcccgaactcaacgagcggttctaccaccacttctgcaaggggtacctctggccgctgtttcactacatgctccccttcgccgcccagttgtccccggcgacggaggcggccccatccagcgatggggggcaggtttgaccgca

SEQ ID NO: 48284 - protein, 199 aa, Panicum virgatum
  misc_feature: Ceres CLONE 2041869
  misc_feature: SWISSPROT Homolog: EC 2.4.1.15 Alpha,alpha-trehalose-phosphate synthase (UDP-forming)
  misc_feature: Functional homolog of the protein sequence given in SEQ ID NO 50801
  misc_feature: Useful for making plants with altered carbohydrate content
MMSRSYTNLLDLAAGNFAALGPSGGGRRRSGSFGMKRMPRVMTVPGPLSDLDDDDDEQAATSSVASDVPSSAVGERLIVVANQLPVVARRRADGRGWVFSWDEDSLLLRLRDGVPDEMEVFFVGSLRADVPPAEQDEVSQTLIDGFRCAPVFLSPELNERFYHHFCKGYLWPLFHYMLPFAAQLSPATEAAPSSDGGQV

SEQ ID NO: 48285 - DNA, 641 bp, Panicum virgatum
  misc_feature: Ceres CLONE 2041900
  misc_feature: Encodes the peptide sequence at SEQ ID NO. 48286
acctatctcctcacttccggcggcggcggcaagcagcagcagcagcagcgccgccaaccccccgccacgatgaggccgatcctgatgaaggggcacgagcgcccgctcacgttcctgcgctacaaccgcgacggcgacctcctcttctcctgcgccaaggaccacacccccacggtctggtacgccgacaacggcgaccgcctcgggacctaccgcggccacaacggcgccgtctggtcctgcgacgtctcccgcgactcggcgcgcctcatcacgggctccgccgaccagaccgccaagctctgggaggtcagcacggggcgggagctcttcagcttccgcttcgacgcgcccgccaggtccgtcgagttcgccatcggggacgcgctagcggtcatcaccaccgacaacttcatggaccacgtccccaccgtccagatcaagcacatcgccgaggacctcgacgaccagacggatgaatccgcgcttgtgatcactggcatcaaggggaggatcaacagggcggtttggggcccgctcaacaggacaatcatcactgctggcgaggatgctaccattcgcatctgggactccgagaccggtaaactgctgaaagagtcagataaggaatctggacatca

SEQ ID NO: 48286 - protein, 190 aa, Panicum virgatum
  misc_feature: Ceres CLONE 2041900
  misc_feature (42)..(80): Pfam Name: WD40 Pfam Description: WD domain, G-beta repeat
  misc_feature (136)..(174): Pfam Name: WD40 Pfam Description: WD domain, G-beta repeat
  misc_feature: SWISSPROT Homolog: EC 2.7.11.7 [Myosin heavy-chain] kinase
MRPILMKGHERPLTFLRYNRDGDLLFSCAKDHTPTVWYADNGDRLGTYRGHNGAVWSCDVSRDSARLITGSADQTAKLWEVSTGRELFSFRFDAPARSVEFAIGDALAVITTDNFMDHVPTVQIKHIAEDLDDQTDESALVITGIKGRINRAVWGPLNRTIITAGEDATIRIWDSETGKLLKESDKESGH

SEQ ID NO: 48287 - DNA, 750 bp, Panicum virgatum
  misc_feature: Ceres CLONE 2041904
  misc_feature: Encodes the peptide sequence at SEQ ID NO. 48288
gtctttccttcgactcgcgctctaaatccgccgccccgaggttccaaaccctagcttcttcccatcgtccacgaaccctagatcccaaaccaccgcccgtcatcccctgatcgccgtacctgacccttctctttgcagtcgattctaccccgacgattctaccccgatccgctcgtttctcttttcctccgtccccgagatcacgaggcaagatggtggaggcgaaggacaacgaggtgtacgaggaggatctcgtcgactacgaggaggtggagaatgtcgccgacggcgccacaaccaacggctccgccgatgtcgtcaagaaggggtacgtggggatccgcagctcggggttcagagacttcctgctcaaaccggagcttctccgtgccatccaggactgcggatttgagcatccttccgaaggtacaaattcttctgacatttccttctggaggagaatatggtataacttttcattaacggacacagaaggttgatttttttcttactggggtgctgctgctccaactttgtttggttccacatcagtgcaacatgaatgcatccctcaagccattcttggaatagatgttatctgtcaagcaaagtcagggatgggtaagactgcggtttttgtcctatcaactcttcagcagattgatcctgttgctggccaagtagctgcacttgtgttgtgccacacagagagttagctttacagattgccatgaatttgagagatttagc

SEQ ID NO: 48288 - protein, 95 aa, Panicum virgatum
  misc_feature: Ceres CLONE 2041904
  misc_feature: Functional homolog of the protein sequence given in SEQ ID NO 50368
  misc_feature: Useful for biocontainment applications
  misc_feature: Useful for making plants with modulated biomass
  misc_feature: Useful for making plants with modulated cold sensitivity
MVEAKDNEVYEEDLVDYEEVENVADGATTNGSADVVKKGYVGIRSSGFRDFLLKPELLRAIQDCGFEHPSEGTNSSDISFWRRIWYNFSLTDTEG

SEQ ID NO: 48289 - DNA, 623 bp, Panicum virgatum
  misc_feature: Ceres CLONE 2041908
  misc_feature: Encodes the peptide sequence at SEQ ID NO. 48290
aggcgagcagagcagcgccaccaaatttccggccaccatttgcggagatcgctttaactgaggacggcgcgatggggtccgtgcctgaggaggtggctgctcctcccgcggcggtggcggcggaggtgctgttccgctccaagctcccggacatcgagatcccgcgggacctcaccctgcaggcctactgcttcgagcgtcttcccgaggtgggcgcccggccctgcatcatcgacgggcagacgggcgccgtgcacacctacgccgacgtggagcggctgtcgcggaaggtggcggcggcgctgcgcgggctgggcgtgggcaggggcgacgtggtcatgaacctgctccgcaactgccccgagttcgccttcgtcttcctcggcgcggccaggctcggcgccgccaccaccacggccaaccccttctacacgccgcacgagatccaccgacaggccgccgccgcgggggccaaggtgatcgtcaccgaggcctgcgccgtcgacaaggtgcgcgcgttcgccgccgagaagggcgtccccgtcgtcgccgtcgacggggacttcgagggctgcctccggttcggggacctcgtggacgccgccgagccgcttgacgccgac

SEQ ID NO: 48290 - protein, 183 aa, Panicum virgatum
  misc_feature: Ceres CLONE 2041908
  misc_feature: SWISSPROT Homolog: EC 6.2.1.12 4-coumarate--CoA ligase
  misc_feature: Functional homolog of the protein sequence given in SEQ ID NO 50495
  misc_feature: Useful for making plants with altered carbohydrate content
  misc_feature: Functional homolog of the protein sequence given in SEQ ID NO 50497
  misc_feature: Useful for making plants with altered cell wall content and/or composition
MGSVPEEVAAPPAAVAAEVLFRSKLPDIEIPRDLTLQAYCFERLPEVGARPCIIDGQTGAVHTYADVERLSRKVAAALRGLGVGRGDVVMNLLRNCPEFAFVFLGAARLGAATTTANPFYTPHEIHRQAAAAGAKVIVTEACAVDKVRAFAAEKGVPVVAVDGDFEGCLRFGDLVDAAEPLDA

SEQ ID NO: 48291 - DNA, 727 bp, Panicum virgatum
  misc_feature: Ceres CLONE 2041912
  misc_feature: Encodes the peptide sequence at SEQ ID NO. 48292
gtctgcttccggagggatgtctgcgccccgaaccaaaaccctaggtatcccagttctcgaaggtcgaggggaggagatggcggcggcggatgggcgcagcagcgacggtggcggtggtcggatccaccggctggaggtggagaacttcaagtcgtacaagggtacgcagacgattggacccttcttcgatttcacggccatcatcggccccaacggcgccggcaagtcgaatcttatggacgccatcagcttcgtgcttggcatgcgcacagcgcaactccgcggcgcgcagctcaaggacctcatctacgccctcgacgaccgcgacaaggaggctaagggccgcagggcttccgtcggcctcgtctaccgccaacccaaccaggaggagctccacttcacccgcaccatcaccggcgcaggcggcagtgagtaccgcatcgacggccgccttgtcacctgggacgagtataacgccaagctcagatccctcggcatcctcgtcaaggcccgcaatttcctcgtcttccagggtgatgtggaatccatcgcctccaagaaccccaaggagctcactgcgcttctggagcagatctcaggctccgatgagcttaggagggagtatgacgagctcgaggagcagaaagccagggccgaagagaactctgcgcttgtctatcaagagaaaaggaccattgtcatggagcggaagcagaagaaggcgcaa

SEQ ID NO: 48292 - protein, 216 aa, Panicum virgatum
  misc_feature: Ceres CLONE 2041912
  misc_feature (15)..(208): Pfam Name: SMC_N Pfam Description: RecF/RecN/SMC N terminal domain
  misc_feature: SWISSPROT Homolog: EC 3.6.3.27 Phosphate-transporting ATPase
MAAADGRSSDGGGGRIHRLEVENFKSYKGTQTIGPFFDFTAIIGPNGAGKSNLMDAISFVLGMRTAQLRGAQLKDLIYALDDRDKEAKGRRASVGLVYRQPNQEELHFTRTITGAGGSEYRIDGRLVTWDEYNAKLRSLGILVKARNFLVFQGDVESIASKNPKELTALLEQISGSDELRREYDELEEQKARAEENSALVYQEKRTIVMERKQKKA

SEQ ID NO: 48293 - DNA, 722 bp, Panicum virgatum
  misc_feature: Ceres CLONE 2041923
  misc_feature: Encodes the peptide sequence at SEQ ID NO. 48294
acctattgttaggaagccacccaaagcacctggcccaccaccgactgtacactaccactaccagcatgcctcatcaatgggtgcagttgaaactcggaaggggaagatgatggttgcatcaggaactgccagcttgctacagattgtttctcagcttgatgatcacttccttagagcttcagagagtgcacatgatgtgtcaaaaaagctggaggccacccgaatgcattaccattccaaccatgctgacagccgaggtcatattgatcactctacaaaaattatgaatgttatcacgtggaaccgctccttcaagaatttacccgaccacgatgacctgcatgataattttgagattgatgatagatttgaaactcatgctgcggttctagatagaatgcttgcttgggagaaaaaactgtatgatgaagtgaaggctggggaacttatgaaaatcgattatcagaagaaggtgactctattgcagaagcaaaagaaacagggtgttaaacttgaaaccctggagaagacaaaagctgccgttagccacttacacacaaggtacatcgtagatatgcagtccatggattcaacggtttcagaaataaattggcttcgggatagacagctattcccaaagttagtggagcttgttgatggaatggccaaatgtggagtgctatgcaccgtcatcatagaaatcaattcatgatcatttcagg

SEQ ID NO: 48294 - protein, 236 aa, Panicum virgatum
  misc_feature: Ceres CLONE 2041923
  misc_feature: The sequence is a functional homolog of SEQ ID NO 230 in the 10/374,780 US patent application
  misc_feature: The sequence is a functional homolog of SEQ ID NO 260 in the 10/225,066 US patent application
  misc_feature: The sequence is a functional homolog of SEQ ID NO 66 in the 10/225,068 US patent application
  misc_feature: The sequence is a functional homolog of SEQ ID NO 732 in the 10/412,699 US patent application
PIVRKPPKAPGPPPTVHYHYQHASSMGAVETRKGKMMVASGTASLLQIVSQLDDHFLRASESAHDVSKKLEATRMHYHSNHADSRGHIDHSTKIMNVITWNRSFKNLPDHDDLHDNFEIDDRFETHAAVLDRMLAWEKKLYDEVKAGELMKIDYQKKVTLLQKQKKQGVKLETLEKTKAAVSHLHTRYIVDMQSMDSTVSEINWLRDRQLFPKLVELVDGMAKCGVLCTVIIEINS

SEQ ID NO: 48295 - DNA, 660 bp, Panicum virgatum
  misc_feature: Ceres CLONE 2041926
  misc_feature: Encodes the peptide sequence at SEQ ID NO. 48296
atcgcccactctctccacttccggtcactggtaacgcgcccactcactccctcgcatcacactctccacctcctccataacttcccccgcgcgcatgggcgatccccgggcccgcccgtccgccgcggccgccggcgagctgcggccgccggagccgccgctggacccgctcgagttcctctcccggtcctggagcgcgtccgggcacgcgttcgcgccgccgccgcccacgccgcccccggccgcgctcgtcagccccatcgacgaggacgccgcgtgcgagctcgaggactgcggggccgccgccgcggccgggagctccttctccttcgcgtccgcggccacgtcgcagctcatcatggaacggatcctcgcgcaatcccaggaagtggcgccactcacctccggccggctctcgcacagcagcggccccctcaacggcggcggctccctctccgacagcccgccggtctcgccggagatcgatgacgcaaagtactgtagagcagtgagcacgccgaagcctcaggcgtaccggcccggcaacaagacggtgggcaggtggctcaaggatcggaaggagaagaagagagaggagacgcgggcgcacaacgcgcaggtccacgccgccgtctcggtcgcggcagtggcagctgcggt

SEQ ID NO: 48296 - protein, 188 aa, Panicum virgatum
  misc_feature: Ceres CLONE 2041926
  misc_feature: The sequence is a functional homolog of SEQ ID NO 224 in the 10/225,066 US patent application
  misc_feature: The sequence is a functional homolog of SEQ ID NO 2372 in the 10/374,780 US patent application
  misc_feature: The sequence is a functional homolog of SEQ ID NO 929 in the 11/479,226 US patent application
MGDPRARPSAAAAGELRPPEPPLDPLEFLSRSWSASGHAFAPPPPTPPPAALVSPIDEDAACELEDCGAAAAAGSSFSFASAATSQLIMERILAQSQEVAPLTSGRLSHSSGPLNGGGSLSDSPPVSPEIDDAKYCRAVSTPKPQAYRPGNKTVGRWLKDRKEKKREETRAHNAQVHAAVSVAAVAAA

SEQ ID NO: 48297 - DNA, 634 bp, Panicum virgatum
  misc_feature: Ceres CLONE 2041946
  misc_feature: Encodes the peptide sequence at SEQ ID NO. 48298
gaacactctcctctttcacaatcgctcccaccccacgcgcactccccgccctctccatgagagcctagacgccgccgcggccgccaaagttgacacgaccgcgagcaaaaggggggcggctcttctctctccgccatacactcccctccctcccgggcgcccgcgatgccgccgtcgcggtcgctgttcctgctgctcatgctcgcgctcgccgcggcgcaggcgcagccgccccccgcgccgccggtgccgcggacggccggggtgcgggcggagatcgacgcgctcctcgcgttccgccgcgggctgcgcgacccctacggcgccatgtccgggtgggacgcggcgtcgccctcggcgccctgctcctggcgcggcgtcgcgtgcgcgcccggcggcggcggcggccgcgtcgtcgagctgcagctcccgcggctccgcctctcgggccccatctcgccggagctcggctcgctgccgtacctcgagcggctcagcctccgctccaacgacctctccggcgccgtcccggcgacgctggcccgcgtcacctcgctccgcgccgtctccctccagtccaactcgctctccggccccattccccagtccttcctcgccaacctcaccaacctcg

SEQ ID NO: 48298 - protein, 156 aa, Panicum virgatum
  misc_feature: Ceres CLONE 2041946
  misc_feature (34)..(75): Pfam Name: LRRNT_2 Pfam Description: Leucine rich repeat N-terminal domain
  misc_feature: SWISSPROT Homolog: EC 2.7.11.1 Non-specific serine/threonine protein kinase
MPPSRSLFLLLMLALAAAQAQPPPAPPVPRTAGVRAEIDALLAFRRGLRDPYGAMSGWDAASPSAPCSWRGVACAPGGGGGRVVELQLPRLRLSGPISPELGSLPYLERLSLRSNDLSGAVPATLARVTSLRAVSLQSNSLSGPIPQSFLANLTNL

SEQ ID NO: 48299 - DNA, 711 bp, Panicum virgatum
  misc_feature: Ceres CLONE 2041961
  misc_feature: Encodes the peptide sequence at SEQ ID NO. 48300
atcaaaacatgtgtacccaactaccaccgccgccaactcagaagtccaaactccccacctcacagccctggctgctcctccaagctcccatccatggctccgttcttcctcctcctcctaatcagccagatcctactctgcgcagccgtcgacaccatcaactcctccgcgccgttgtccggtgtgcagcagattgtatccaagggaaacaagttcactttgggcttctacacaccgcctcaaggtaaaaccacctccagctccagcaactactacatcgccatatggtacagcaacatacctcagaagacaaccgtgtggacggccaactccgacgcgcctgtgacggacccaactaccgcagccttgaccatcggcagcgacggcaaccttgtcctccttgatcaatccaagaatcggcagctgtggtcgaccaacatgagcatcggatccaactccaccatcgccgtcctccaggatgacggtagcctcgacctcattgatgccaccaattcatcaaatgtttactggcgaagcatagatcatcccacaaacacatggcttccggggggcaagcttgggctgaacaagaccacaggggtcagtcagcgtcttgttccatggaggaacacagccaacccatctcctggcttgttctcgctggagctggacccaaacggctcaacacagtacttcatccagtggaaggat

SEQ ID NO: 48300 - protein, 205 aa, Panicum virgatum
  misc_feature: Ceres CLONE 2041961
  misc_feature (71)..(184): Pfam Name: B_lectin Pfam Description: D-mannose binding lectin
MAPFFLLLLISQILLCAAVDTINSSAPLSGVQQIVSKGNKFTLGFYTPPQGKTTSSSSNYYIAIWYSNIPQKTTVWTANSDAPVTDPTTAALTIGSDGNLVLLDQSKNRQLWSTNMSIGSNSTIAVLQDDGSLDLIDATNSSNVYWRSIDHPTNTWLPGGKLGLNKTTGVSQRLVPWRNTANPSPGLFSLELDPNGSTQYFIQWK

SEQ ID NO: 48301 - DNA, 708 bp, Panicum virgatum
  misc_feature: Ceres CLONE 2041986
  misc_feature: Encodes the peptide sequence at SEQ ID NO. 48302
ggcagcgggtgcgcgagttgcagatgaggacagaattcggggccttggggagcgagaggtagatggattgaggaacccagctctgctctgctctgctccgccgcccgccgatcgctgagcccctccgccacacccgcttctcctccacccgcaacataccaccgcatggcgtgatccgatgatagcaacaagagcgcgccttcccctctccctgacggcgtcggccaccccgcacggcgcgcgcaccaagaagaggaagaagccatgtcccccaacctggacagcgccatcaagacccaggtgccggcgctgctcctgaggcgcctcttcggagtcggccgccgggatgaggccaagcagctggcgccggtggggcgccgccgtgtgttcgtgcagacggagaccggatgcgtgctcggcatggacctggatcggggggacaacgcgcacaccgtcaagcgcaggctgcagctcgcgctcaacgtgcccaccggcgagacctcgctcacgttcggcgaccgcgtcctggagaacgacctctccttcatacgcccggactcgcctctgctcctcacccggaacagcatgaaccggagttgctccaccccgtgcctctgcccggtctccaaggacttccagcaaaaggattccagcaaccgggttgagatacttgggtgctccagcagctgtccccgtgtcaggagcctc

SEQ ID NO: 48302 - protein, 147 aa, Panicum virgatum
  misc_feature: Ceres CLONE 2041986
  misc_feature: Functional homolog of the protein sequence given in SEQ ID NO 51154
  misc_feature: Useful for making plants with altered protein content
MSPNLDSAIKTQVPALLLRRLFGVGRRDEAKQLAPVGRRRVFVQTETGCVLGMDLDRGDNAHTVKRRLQLALNVPTGETSLTFGDRVLENDLSFIRPDSPLLLTRNSMNRSCSTPCLCPVSKDFQQKDSSNRVEILGCSSSCPRVRS

SEQ ID NO: 48303 - DNA, 657 bp, Panicum virgatum
  misc_feature: Ceres CLONE 2042007
  misc_feature: Encodes the peptide sequence at SEQ ID NO. 48304
aatctccgtcgccgtctccccttcttatccactgaccctcctccccctccccctccccctcacccgtccccgacccctcctcccgaccgcgagagctgccgccccatccctccctgccctcgctagggctccgttgcggcgccggcgtagcgtccggctcaggcttcattgacacttggctagggattctttgaccggttcaatatggagggggctctagttcagtctgcgattgttcccaccgtattacaccggagcagctctggtcgatctcgtgtgcgcgcgagggccacgatgttgcgcagtacgccgacgcggacgcttactcttggaggcttccaagggctgcggcagacaaattttcttgacacgaggtctgtgatcaagcgtgacttcggatctatcgtagcaagtcagattttgcggccacggggttcagcatcaagaggtgtggttcgggccatgtttgagcgcttcactgaaaaggccatcaaggtgattatgcttgcgcaggaggaggccagacgtctaggccacaactttgttgggacagagcagattttactaggtcttattggtgagggaactgggattgcagcgaaggttctgaaatatatgggaattaatctaaaggatgcccgagtggaagttgagaag

SEQ ID NO: 48304 - protein, 150 aa, Panicum virgatum
  misc_feature: Ceres CLONE 2042007
  misc_feature (102)..(150): Pfam Name: Clp_N Pfam Description: Clp amino terminal domain
MEGALVQSAIVPTVLHRSSSGRSRVRARATMLRSTPTRTLTLGGFQGLRQTNFLDTRSVIKRDFGSIVASQILRPRGSASRGVVRAMFERFTEKAIKVIMLAQEEARRLGHNFVGTEQILLGLIGEGTGIAAKVLKYMGINLKDARVEVE

SEQ ID NO: 48305 - DNA, 776 bp, Panicum virgatum
  misc_feature: Ceres CLONE 2042017
  misc_feature: Encodes the peptide sequence at SEQ ID NO. 48306
atccctcaaaaaccccatccccccacacactccgatcgaccctcttccttcctcctcctccccctcctccctagggtttcgcaaaccttcccctttggtcaggcaacctcctccttcctcggtttcaccgccgtcggccatggcgaccactaccttccccacgtcgacccccttcttcgcggcccaccacgggccccgccggagccgcccctcagtatccgccgcggtctacagccggagccgccggtggcgcccgctgcgggtgtcgtgcgagaaggtggtgggaatcgacctgggcaccaccaactccgcggtggccgccatggagggcggcaagcctacgatcgtcaccaacgcggagggggcgcggaccacgccctccgtcgtggcgtacaccaagtccggggaccgactcgtgggacagatcgccaagcgccaggccgtcgtgaacccggagaacacgttcttctccgtcaagcgcttcatcggccgcaagatgaacgaggtcgacgaggagtccaagcaggtctcctaccgcgtcttgagggatgacaatggcaacgtcaagctcgactgcccggcgattggcaagcagttcgctgccgaggagatctctgcgcaggtgctgagaaagttggtggatgacgcatcaaagtttttgaatgaaaaggtcacaaaggcagtgatcacggttcctgcttacttcaatgaatccaaaaggacagaaacaaaaaatgctgggccgaattgccggggtgggaggttctgcgaattat

SEQ ID NO: 48306 - protein, 212 aa, Panicum virgatum
  misc_feature: Ceres CLONE 2042017
  misc_feature (47)..(211): Pfam Name: HSP70 Pfam Description: Hsp70 protein
MATTTFPTSTPFFAAHHGPRRSRPSVSAAVYSRSRRWRPLRVSCEKVVGIDLGTTNSAVAAMEGGKPTIVTNAEGARTTPSVVAYTKSGDRLVGQIAKRQAVVNPENTFFSVKRFIGRKMNEVDEESKQVSYRVLRDDNGNVKLDCPAIGKQFAAEEISAQVLRKLVDDASKFLNEKVTKAVITVPAYFNESKRTETKNAGPNCRGGRFCEL

SEQ ID NO: 48307 - DNA, 673 bp, Panicum virgatum
  misc_feature: Ceres CLONE 2042030
  misc_feature: Encodes the peptide sequence at SEQ ID NO. 48308
accattcgacccataagcttttgcgatccctcccactcccgccgccgcatcgcattctccgatccggagctctctgctcgcagccatggcgaagtgctacccgaccgtgagcgccgagtaccaggatgccgtcgagaaggccaggcgcaagctccgcgccctcatcgccgagaagagctgcgcccctctcatgctccgtctcgcgtggcactcggcggggacgttcgacgtgtcctctaagaccggcggccccttcggtacgatgaagaacccggcggagcaggcgcacggcgccaacgcgggtctggacatcgccgtgcggatgctcgagcccgtcaaggaggagttccccatcctctcctacgccgatctgtaccagcttgcgggagttgtggccgtggaggtgaccggtggacctgaggtccccttccaccccggtagggaggtgagacttttcatcccttttctactgcctttggggttttgcctgggtttaaggccttgattcgaaatacccaagagggtttgaaggtagttgggcgagatcgtggttgtttactccaattcgtgcccccctgatttatgagcgtattatcatcggttcatggcacgttatcctatcatttaagggtacacctttttcaccattgaaatatcggtttgtgttcacgcc

SEQ ID NO: 48308 - protein, 139 aa, Panicum virgatum
  misc_feature: Ceres CLONE 2042030
  misc_feature (19)..(139): Pfam Name: peroxidase Pfam Description: Peroxidase
  misc_feature: SWISSPROT Homolog: EC 1.11.1.11 L-ascorbate peroxidase
  misc_feature: Functional homolog of the protein sequence given in SEQ ID NO 50942
  misc_feature: Useful for making plants with modulated heat sensitivity
  misc_feature: Functional homolog of the protein sequence given in SEQ ID NO 50943
  misc_feature: Useful for making plants with modulated water use efficiency
  misc_feature: Functional homolog of the protein sequence given in SEQ ID NO 50852
  misc_feature: Useful for making plants with altered carbohydrate content
  misc_feature: Functional homolog of the protein sequence given in SEQ ID NO 50941
  misc_feature: Useful for making plants with altered cell wall content and/or composition
MAKCYPTVSAEYQDAVEKARRKLRALIAEKSCAPLMLRLAWHSAGTFDVSSKTGGPFGTMKNPAEQAHGANAGLDIAVRMLEPVKEEFPILSYADLYQLAGVVAVEVTGGPEVPFHPGREVRLFIPFLLPLGFCLGLRP

SEQ ID NO: 48309 - DNA, 719 bp, Panicum virgatum
  misc_feature: Ceres CLONE 2042037
  misc_feature: Encodes the peptide sequence at SEQ ID NO. 48310
caaccgatacctcaccactcccctcctcctgctcgatcgccatggacgccggcggcctcgcggcggggtcgcacatgcggggcgagctgcacgtcgtgcgcggccgcgacgcggaggccgcccggagcggcgcggacgtgaggacgtgccgcgtgtgcggggacgaggtcggggcgcgggaggacgggcagcccttcgtggcgtgcgccgagtgcggcttccccgtgtgccggccctgctacgagtacgagcgcagcgacggcacgcagcgctgcccgcagtgcaacacccgctacaagcgccagaaagggtgcccgagggtggaaggggacgaggacgacggcccggagatggacgacctggaggaggagttccccgccgccaagagccctagtaataagaagccccacgagcccgtcgccttcgacgtctactcggagaacggggagcacccgccgcagcggtggcggacgggaggccagacgctctcctccttcaccggaagcgtggccggcaaggacctggaggccgagagggagatggaggccgggagcatggagtggaaggaccgcatcgacaagtggaagaccaagcaggagaagaggggcaagctcaaccacgacgacagcgacgacgacgacgaaaagaacgacgacgagtacatgctgctggccgaggccgggcagcctctgtggcgcaaggtcccgatcccgtcgagc

SEQ ID NO: 48310 - protein, 225 aa, Panicum virgatum
  misc_feature: Ceres CLONE 2042037
  misc_feature: SWISSPROT Homolog: EC 2.4.1.12 Cellulose synthase (UDP-forming)
MDAGGLAAGSHMRGELHVVRGRDAEAARSGADVRTCRVCGDEVGAREDGQPFVACAECGFPVCRPCYEYERSDGTQRCPQCNTRYKRQKGCPRVEGDEDDGPEMDDLEEEFPAAKSPSNKKPHEPVAFDVYSENGEHPPQRWRTGGQTLSSFTGSVAGKDLEAEREMEAGSMEWKDRIDKWKTKQEKRGKLNHDDSDDDDEKNDDEYMLLAEAGQPLWRKVPIPS

SEQ ID NO: 48311 - DNA, 706 bp, Panicum virgatum
  misc_feature: Ceres CLONE 2042051
  misc_feature: Encodes the peptide sequence at SEQ ID NO. 48312
gttttccgccgtcttatccctccgtccacgctgccgccgcccaaaccctagcgaccccgacccgccgccgtccgtcaccatggctgacgaccactactccaagcgcaagtacgacgacccctcgccgccgccgcggcgcacggggttctcctccggcccgccgcctgcctctccgcccgccggcgccccgtcgtacaacagcgtgccgccgccccccgacgagatccagctcgcgaagcagcgcgcgcaggagatcgcggcgcggatcttcaacgccgccgaggccaagcgcccccgcgtcgacaacggcgacgatgacgtcggcggctacgggggaggaggctcccatggcggcggcggcggcggcggcggtggaggtgggcgcatcggcggcggggggctcggctactcgtcctctgccggtggtgggcatggttcttctatcgcgctgttatcttcacagagcggtgtgtctcagtactcttcatatggtggatatcagggtacaagcaaaaagattgaaataccaaatggaagggttggtgttattattggaaaagctggggaaactatcaggtatctccaacttcagtcaggagcaaagattcaagtaacaagagacaatgaagctgaaccaggtgcaccaacaagaccagttgagctttcaggcactcctgagcagataagcaaagctgagcagctgatc

SEQ ID NO: 48312 - protein, 208 aa, Panicum virgatum
  misc_feature: Ceres CLONE 2042051
  misc_feature (144)..(208): Pfam Name: KH_1 Pfam Description: KH domain
MADDHYSKRKYDDPSPPPRRTGFSSGPPPASPPAGAPSYNSVPPPPDEIQLAKQRAQEIAARIFNAAEAKRPRVDNGDDDVGGYGGGGSHGGGGGGGGGGGRIGGGGLGYSSSAGGGHGSSIALLSSQSGVSQYSSYGGYQGTSKKIEIPNGRVGVIIGKAGETIRYLQLQSGAKIQVTRDNEAEPGAPTRPVELSGTPEQISKAEQL

SEQ ID NO: 48313 - DNA, 731 bp, Panicum virgatum
  misc_feature: Ceres CLONE 2042077
  misc_feature: Encodes the peptide sequence at SEQ ID NO. 48314
aacccaccaccatacatagcagagcaagagaagagcgagccgccgatgccgacgccgacgcttcggcttcggcttctctaacaaccaaaactcagccaccatgtccatggccgcctccttcctccccctccccctcctcctcctcctgctccccatcccggcgcacgccttgagccaggacggcctccacctgctcgacgccaagcgcgcgctcaccgtccccgcgcccgcgctcgccgactggaacccgcgcgacgccacgccctgcaactgggccggcgtctcctgccacgaccccgacgccgtcaccgccgtctccctccccggcctcaacctcgccggctccttccccgccgcgctctgccgcatcccgcgcctgcgctccatcgacctctccgacaactacatcggccccgacctcgacgtcgcccgctgcgccgccctccagcgcctcgacctctccaccaacgccctcgtcggcccgctccccgacgccctcgccgacctcccggacctcctctacctcaacctccagggcaacaacttctccggccccatcccggactccttcgcccgcttccccaagctccagtcgctctccctcgtctacaacctgctcggcggccaggtcccgcccttcctcgggcgcgtcgccacgctccgggagctcaacctctctacaatccttcgcgccgggcccgtcccgcccagctcgccgccctctcggcgct

SEQ ID NO: 48314 - protein, 210 aa, Panicum virgatum
  misc_feature: Ceres CLONE 2042077
  misc_feature (24)..(64): Pfam Name: LRRNT_2 Pfam Description: Leucine rich repeat N-terminal domain
  misc_feature: SWISSPROT Homolog: EC 2.7.11.1 Non-specific serine/threonine protein kinase
MSMAASFLPLPLLLLLLPIPAHALSQDGLHLLDAKRALTVPAPALADWNPRDATPCNWAGVSCHDPDAVTAVSLPGLNLAGSFPAALCRIPRLRSIDLSDNYIGPDLDVARCAALQRLDLSTNALVGPLPDALADLPDLLYLNLQGNNFSGPIPDSFARFPKLQSLSLVYNLLGGQVPPFLGRVATLRELNLSTILRAGPVPPSSPPSRR

SEQ ID NO: 48315 - DNA, 691 bp, Panicum virgatum
  misc_feature: Ceres CLONE 2042082
  misc_feature: Encodes the peptide sequence at SEQ ID NO. 48316
aacaagagccgccagttcgacaaaccccggccccgcagcaaggatttctgcgccgaatccgtaggttctcctcttcgatgttctcgccaatcggcggaggagccgattgtgctgtctgtttagtgtctagactaggataaaagatttatcttctttttttccttggatttttcagcttcgggacccaatgggagaggcctcgccgtcgatcgccagggatgtcaccgagttgatcgggaacacgccgctggtgtacctcaacaaggtgacagatgggtgcgtcggccgcgtcgccgccaagctcgagtccatggagccctgctccagcgtcaaggataggattggctacagcatgatcactgacgcagaggagaagggcctgatcactccaggcacggtgggtgaatgaacctttccgagcatttcctttgttgtttgaaggaaaataacttgtgtcttgatttcaagtgtccgctgccttagttcagacatatatgttcaattggaatattaagtcttatatttccatcaaatccagaagcatgtgcttgctgccatttttcgttttagaggatctagtctgcataagaaaattatctaatgtgctggtctgcatgttccatatctggtggttgttatttttgtggagttgactacagaattaatttattctacattcttttgtgcctag

SEQ ID NO: 48316 - protein, 73 aa, Panicum virgatum
  misc_feature: Ceres CLONE 2042082
  misc_feature: SWISSPROT Homolog: EC 2.5.1.47 Cysteine synthase
  misc_feature: Functional homolog of the protein sequence given in SEQ ID NO 51108
  misc_feature: Useful for making plants with modulated cold sensitivity
MGEASPSIARDVTELIGNTPLVYLNKVTDGCVGRVAAKLESMEPCSSVKDRIGYSMITDAEEKGLITPGTVGE

SEQ ID NO: 48317 - DNA, 752 bp, Panicum virgatum
  misc_feature: Ceres CLONE 2042090
  misc_feature: Encodes the peptide sequence at SEQ ID NO. 48318
gcgtctccgaagttccgagtccccatacggtccccccacctcctctctctctcgaagcctccaagcctcgggcactcttctccccacctcctctcgcgcggcgaggtgtcgatccgcccggcgatctgggccctcaggccggcgcccgcgccagggaggcttctccttacccgccgcgagggcggagatgctctcgctgcagcagcagcaacagcacggcggcgccgtcgccgtcggcgacgcgcgccaccacgcgccgcagccggcggtgctaggcggcggcggcggggactggctagggttcgtgggccgcgcggacctggaggagcccgcgaggaatgccccgtcgcccgccacgttcctgctgccgcccgcgccgctcgacgacagggcggctgagcccgagcccaagcccaagcccggccagctcgcaggagctgttgatgaagaacggcatttggcacttgctcatcagaactacaggtcagggaagtacagagaggccttagagcatggcaatgttgtttacgagaagaacccacgtcgaactgataacctccttctccttggagctatctattatcagatccgtaattatgacatgtgcattgcaaaaaatgaggaggctcttgctatagatccacactttgctgaatgctatggcaatatggcgaatgcttggaaggagaaaggcgatattgatctcgcgattcgttactatcttactgccattcagctgcgaccaaacttct

SEQ ID NO: 48318 - protein, 188 aa, Panicum virgatum
  misc_feature: Ceres CLONE 2042090
  misc_feature (155)..(188): Pfam Name: TPR_2 Pfam Description: Tetratricopeptide repeat
MLSLQQQQQHGGAVAVGDARHHAPQPAVLGGGGGDWLGFVGRADLEEPARNAPSPATFLLPPAPLDDRAAEPEPKPKPGQLAGAVDEERHLALAHQNYRSGKYREALEHGNVVYEKNPRRTDNLLLLGAIYYQIRNYDMCIAKNEEALAIDPHFAECYGNMANAWKEKGDIDLAIRYYLTAIQLRPNF

SEQ ID NO: 48319 - DNA, 665 bp, Panicum virgatum
  misc_feature: Ceres CLONE 2042101
  misc_feature: Encodes the peptide sequence at SEQ ID NO. 48320
tgaacacagagctgcagatacactgcaagctcagccatgcctcggctattgcttctgctcttgctcttgccattcctcttcgcggtgtcaaccgcgaagccagaaaagatcatctcaaggagccagttccccaatagcttcttcttcggcacagcgtcgtcggcctaccagtatgaaggggctgtaagggagggcggcagagggccaagcatctgggacacctacactcacactaacccagatcagagcctgaggaccaccaatctacgagtctgcgacaaaagcacatagaaacaaaaggcgcaaacaaaaagatgagaatctgaaaagatgcagtagctagttgcatgaacactttcaattgctctatgtcgaacaacaaacaacacaaaggacaacgacaggtctattttaaggtcaaaagttaacccaatccgtggatgtctcatcaattcaaaggaaaaaggcaggtctattttaaggtcagaagttaacccaatccatggatttctcatgtctgccagaagtcaaaaggtccaaacagttcactgcagcacatgaggcagtgaaataagacacgtttccgaaaacaatgctccgtctaactatcgaagaaaaatcaaaacggagaacagagcagcttgtttacatctgatctacagccc

SEQ ID NO: 48320 - protein, 84 aa, Panicum virgatum
  misc_feature: Ceres CLONE 2042101
  misc_feature: SWISSPROT Homolog: EC 3.2.1.21 Beta-glucosidase
  misc_feature: Functional homolog of the protein sequence given in SEQ ID NO 51132
  misc_feature: Useful for making plants with altered cell wall content and/or composition
  misc_feature: Functional homolog of the protein sequence given in SEQ ID NO 50255
  misc_feature: Useful for making plants with altered carbohydrate content
MPRLLLLLLLLPFLFAVSTAKPEKIISRSQFPNSFFFGTASSAYQYEGAVREGGRGPSIWDTYTHTNPDQSLRTTNLRVCDKST

SEQ ID NO: 48321 - DNA, 651 bp, Panicum virgatum
  misc_feature: Ceres CLONE 2042119
  misc_feature: Encodes the peptide sequence at SEQ ID NO. 48322
acgcactacttgtgctctccctaggccaaagccaaacccacccgcgccacccctcctcttccccttctccatccccatcgccgccgtccccgatctcctccggcctctcgggaatgggcagcctggcgtcggagaggacggtgatggggtgggccgcccgggacgccaccgggcacctctccccctacacctacaccgtcaggtacgaacccgctggccatggccatctcgatcgaccgctccgccgccgccacccttcgatcccttcctgctcgattacctaccacatctgctgttctagtcactggcacgcaccactaagctcgaatcaggctgagaaagcagaaaataaagccacaaccttcgttttcattcagtacatataggttctacagtgcaatatattaatatggcagacagggagcatcccatcgactgcatatttacactcctttttcaggaggagttcccatgtttacattccttcgatcgagagaagaatcttgctaacgctttccttttttttgttaaaaaaacaagaaagctaacgctgttcttatgccgccgtgactcgtgagccattggccgtgtttggttggttttcatgaaatttttttccagctttgaccactaatttagagtatcaaatga

SEQ ID NO: 48322 - protein, 90 aa, Panicum virgatum
  misc_feature: Ceres CLONE 2042119
  misc_feature: SWISSPROT Homolog: EC 1.1.1.195 Cinnamyl-alcohol dehydrogenase
MGSLASERTVMGWAARDATGHLSPYTYTVRYEPAGHGHLDRPLRRRHPSIPSCSITYHICCSSHWHAPLSSNQAEKAENKATTFVFIQYI

SEQ ID NO: 48323 - DNA, 729 bp, Panicum virgatum
  misc_feature: Ceres CLONE 2042121
  misc_feature: Encodes the peptide sequence at SEQ ID NO. 48324
aaaatcgtaaaccctagccgtgccccagcgcgagggcacccaacgccgcagccatgggcgccagtcggaagctgcagggcgagatcgaccgtgtcctcaagaaggtccaggagggtgtcgacgtcttcgacagcatctggaacaaggtctacgacaccgagaatgcgaaccagaaggagaagttcgaggcggacctcaagaaggagatcaagaagttgcagcggtaccgggaccagatcaagacgtggatccaatccagcgagatcaaggacaagaaggttagtgcctcttatgagcaggctctgatggatgctcggaagcagattgaacgagagatggaacggtttaaagtttgtgagaaagaaacaaaaaccaaggccttctcaaaagaagggttaggtcagcaaccaaaaactgatcccaaagagaaggccaaagctgaaacgagggactggcttaataatgtggttagtgatttggaaagccagattgataactttgaagcagaggttgaagggctttcaattaaaaaaggaaaacaaagaccacctcgacttgtacatttagagaagtctattacgcgacataaagctcatataaagaaattggagtcaatcttgagacttttggataacgatgagttgagtcctgagcaagtcaatgatgttaaagattttctttgagactatgttgaacgtaatcaggaagactttgatgaattcagtgatg

SEQ ID NO: 48324 - protein, 209 aa, Panicum virgatum
  misc_feature: Ceres CLONE 2042121
  misc_feature (2)..(209): Pfam Name: Not3 Pfam Description: Not1 N-terminal domain, CCR4-Not complex component
MGASRKLQGEIDRVLKKVQEGVDVFDSIWNKVYDTENANQKEKFEADLKKEIKKLQRYRDQIKTWIQSSEIKDKKVSASYEQALMDARKQIEREMERFKVCEKETKTKAFSKEGLGQQPKTDPKEKAKAETRDWLNNVVSDLESQIDNFEAEVEGLSIKKGKQRPPRLVHLEKSITRHKAHIKKLESILRLLDNDELSPEQVNDVKDFL

SEQ ID NO: 48325 - DNA, 676 bp, Panicum virgatum
  misc_feature: Ceres CLONE 2042134
  misc_feature: Encodes the peptide sequence at SEQ ID NO. 48326
gcgtttcgagcagacaccgccgccgcaacaggccgagttcctcgtcgtctcctcccaaatcgccctagcatcaaagctccgccgccgccgccgccatgggtaaggttcacggatcgctggcccgcgctgggaaggtgcgtgggcagacgccgaaggtggcgaagcaggacaagaagaagaagccccgcggccgcgcctacaagcgcatgcagtacaaccgccgcttcgtcaccgccgtcgtcggattcggcaagaagcgcggccccaactcctccgagaagtagatctagctaggccagccgcctgattcatacgcttgtgttcttggcaccttcatcttcttttttccaggtagttttgttcgagtaatcaacgttttggtaatgtactgatgacaagttgaagaccaatgctatgttgctgcaatcctatcaagtatgatatgcatcgtttactgcatggcaatgagtgtctctaaaaaaaaaaaaattattccttcccattcgcttcgcttattccccactccctcccccgcaccctcgcctcgctcccaccaccaccacccgccgccgccgccgcgtcctgggccggggagggtcgccggctcggctcggctctgctgcgaggcgaggcgaggcgctctcgggcgtggcgggtggtcttatctgtgtgtgcg

SEQ ID NO: 48326 - protein, 62 aa, Panicum virgatum; identical to SEQ ID NO: 10043
  misc_feature: Ceres CLONE 2042134
  misc_feature (3)..(61): Pfam Name: Ribosomal_S30 Pfam Description: Ribosomal protein S30

SEQ ID NO: 48327 - DNA, 712 bp, Panicum virgatum
  misc_feature: Ceres CLONE 2042139
  misc_feature: Encodes the peptide sequence at SEQ ID NO. 48328
atcccaacaatccactcgatcagtgacaacctcctcaaccgagctcccagcacttcgcgaactctcgctagctagagctgctgctgcctccaacgatcagctgagaagaagatgaggtcgttggcggtcgccgtcgcggcgatggcctgcctggcggcggtggcgcgggccggcaacttctaccaggacacggagatgacctggggcggcgggcgcggcaaggtcgtggacggcgggcgcgggctcgacctcacgctggaccgcacctccggctccgggttccagtccaagagcgagtacctcttcggcaagatcgacatgcagatcaagctggtccccggcaactccgccggcaccgtcaccaccttctacctctcgtcgcaggggagcacccacgacgagatcgacttcgagttcctgggcaacgtcaccggcgagccctacacgctgcacaccaacgtgttcacgcaggggcaggggcagggccagcgcgagcagcagttccgcctctggttcgaccccaccacggcctaccacacctactccatcgtctggaacccgcagcacatcatgtgagtatcaatcatcttctttccacagaccacatcaccattgttaggcatggacgcatggtcgctgacaggcaggtttggtttcctcgtgttgtgcagcttcgcggtggacggcaccccgatcggtgacttcaagaacc

SEQ ID NO: 48328 - protein, 154 aa, Panicum virgatum
  misc_feature: Ceres CLONE 2042139
  misc_feature (23)..(154): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature: Functional homolog of the protein sequence given in SEQ ID NO 50724
  misc_feature: Useful for making plants with altered carbohydrate content
  misc_feature: Functional homolog of the protein sequence given in SEQ ID NO 50385
  misc_feature: Useful for making plants with altered cell wall content and/or composition
MRSLAVAVAAMACLAAVARAGNFYQDTEMTWGGGRGKVVDGGRGLDLTLDRTSGSGFQSKSEYLFGKIDMQIKLVPGNSAGTVTTFYLSSQGSTHDEIDFEFLGNVTGEPYTLHTNVFTQGQGQGQREQQFRLWFDPTTAYHTYSIVWNPQHIM

SEQ ID NO: 48329 - DNA, 468 bp, Panicum virgatum
  misc_feature: Ceres CLONE 2042141
  misc_feature: Encodes the peptide sequence at SEQ ID NO. 48330
cacgtattggcatttgatttcgcagcccaccaattccggtctcttccaactcccaaagttccaaagttccaagtggcgagcgcgaagagggagagaagtggttgtcggaatccactccggcgaggagcgaggaggcgggaatgggggaaggagcgggtgaggcggtgaaggtggtggatttggaggacggggagtgggaggaggaggctcttcccactgccctcccgtctttcatcgggaagctaatgtacgaagctgggatctggtacgttcccagcagcaccttctcatactatgaccgtgtccttgttccgatggccatgcgcggcgctgtcccagagccatactctcggaccggatgtgagattggcctgctcacctatttctcaatggccaggggaaatgccgctgttcctgctatggagatgaccaagtggtttgacacaagctatcacttcattgtccctg

SEQ ID NO: 48330 - protein, 109 aa, Panicum virgatum
  misc_feature: Ceres CLONE 2042141
  misc_feature: SWISSPROT Homolog: EC 2.1.1.14 5-methyltetrahydropteroyltriglutamate--homocysteine S-methyltransferase
  misc_feature: Functional homolog of the protein sequence given in SEQ ID NO 51318
  misc_feature: Useful for making plants with altered cell wall content and/or composition
MGEGAGEAVKVVDLEDGEWEEEALPTALPSFIGKLMYEAGIWYVPSSTFSYYDRVLVPMAMRGAVPEPYSRTGCEIGLLTYFSMARGNAAVPAMEMTKWFDTSYHFIVP

SEQ ID NO: 48331 - DNA, 750 bp, Panicum virgatum
  misc_feature: Ceres CLONE 2042148
  misc_feature: Encodes the peptide sequence at SEQ ID NO. 48332
aagccgagcaccgcagagaaaggcgtcttcgtactcgcctctctccgcgactcaaagctttcaccctcctactcccattccccaccgccgccgccgcctcactcttccgacgacaccatgagggagtgcatctcgatccacatcggccaggccggtatccaggtcggaaacgcgtgctgggagctctactgcctcgagcatggcattcaggctgatggccagatgcccggtgacaagaccattggaggaggtgatgatgctttcaacaccttcttcagtgagactggggctgggaagcatgtcccccgtgctgtgtttgttgaccttgagcccactgtgattgatgaggtgaggactggcacttaccgccagctcttccaccctgagcagctcatcagcggcaaggaggatgctgccaacaactttgcccgtggtcactacacgattggcaaggagattgttgacctgtgccttgaccgcatcaggaagcttgccgacaactgtactggtctccagggcttccttgtcttcaatgctgttggtggaggaacggggtctggccttggttccctcctccttgagcgcctgtcggttgactatggcaagaagtccaagcttgggttcactgtatacccatctccccaggtctccacctcagtggttgagccatacaacagtgtcctgtccacccactccctccttgagcacactgatgttgctgtcctgctcgacaatgaggccatctatgac

SEQ ID NO: 48332 - protein, 210 aa, Panicum virgatum
  misc_feature: Ceres CLONE 2042148
  misc_feature (49)..(210): Pfam Name: Tubulin Pfam Description: Tubulin/FtsZ family, GTPase domain
  misc_feature: Functional homolog of the protein sequence given in SEQ ID NO 50141
  misc_feature: Useful for making plants with altered cell wall content and/or composition
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIY

SEQ ID NO: 48333 - DNA, 620 bp, Panicum virgatum
  misc_feature: Ceres CLONE 2042168
  misc_feature: Encodes the peptide sequence at SEQ ID NO. 48334
aaccaaccaaacatggcgaaaacaaacgccgcgcctccaggccccggccgccgagcccgcgcgctcccgttcctccaccacaggaccacgcaccgcttcctccgcctcctcggcgccactaccacgaaaaccgcccgccgccgccgccgaacggccaggcccacccacaatcgcagggtagcgagaccggcggagccgaaggagagggccgttggggcggcggagcccgatggaccgcgggaccccggtgccgccgccgacgcggccgtggtggtggggaagtactgggcgcaccgccacagcctcttctccctgtacgaccgcggcgtgcgcatggacggcgagggctggtactccgccaccccggaggccatcgcggcgtctcaggccgcccgcgccgcgcccggcgacctcgtcgtcgacgcgttcgccgggtgcggcggcaactccatccagttcgccgccaggggttgcttcgtggtcgccgtggagatcgacccccgcaaggtggagctggcggcgcacaacgcgagggtctacggcgtcgaggacaggatccagttcgtcgtcggcgacttcttccgcctcgcacctttcctcaaggctgatttggtgttcct

SEQ ID NO: 48334 - protein, 206 aa, Panicum virgatum
  misc_feature: Ceres CLONE 2042168
  misc_feature: SWISSPROT Homolog: EC 2.1.1.41 Sterol 24-C-methyltransferase
NQPNMAKTNAAPPGPGRRARALPFLHHRTTHRFLRLLGATTTKTARRRRRTARPTHNRRVARPAEPKERAVGAAEPDGPRDPGAAADAAVVVGKYWAHRHSLFSLYDRGVRMDGEGWYSATPEAIAASQAARAAPGDLVVDAFAGCGGNSIQFAARGCFVVAVEIDPRKVELAAHNARVYGVEDRIQFVVGDFFRLAPFLKADLVF

SEQ ID NO: 48335 - DNA, 721 bp, Panicum virgatum
  misc_feature: Ceres CLONE 2042170
  misc_feature: Encodes the peptide sequence at SEQ ID NO. 48336
acacgaagatggcggtggctgcggcggttgcgggactgggagtgaccacgacccaccgttcctgctgcctcgcctccgctcaccggagggctcagcatcgccgccggcgtcctgctactccgcgcgcttcgggagcagtggaggtgagggtctgcacgaaccgcacgtgcgcgcggcagggcgggcgcgaggtcctcgctgcgctagcgggcctcgcgcccccgcgcgtcgtcgtggactcctgcgggtgcctcggccgctgcggcgcggggcccaacgtcgccgcctccgtcggcgggagcgccgcggtgtttggtcacgtgggcacggcggcgcgcggcgcgcagctcctggagcacttcctcggcgctgcggagttcgacgcggctgcggggctctccgcgctcgccgcgcgggagaaggccgaggctgcccttgagaagggaagcgcggctgaagcggaaggcctcctgaatgaggttattgggctcaacgcttgtggtggtatgcatttggtgtacaggagcaggtctaaggcgagactagcaataggggatatctctggtgcgcttgaggatgccgaggaagcaataagaatatcccccaaatttactcaggctcacttgttacgaggggatgcgcttcttgcaatgggtgaatattgtgctgcagaaaatgcttatgaagatgcgttggatcttgatccctctattcgccggtc

SEQ ID NO: 48336 - protein, 237 aa, Panicum virgatum
  misc_feature: Ceres CLONE 2042170
  misc_feature (202)..(235): Pfam Name: TPR_1 Pfam Description: Tetratricopeptide repeat
  misc_feature: SWISSPROT Homolog: EC 3.1.3.16 Phosphoprotein phosphatase
MAVAAAVAGLGVTTTHRSCCLASAHRRAQHRRRRPATPRASGAVEVRVCTNRTCARQGGREVLAALAGLAPPRVVVDSCGCLGRCGAGPNVAASVGGSAAVFGHVGTAARGAQLLEHFLGAAEFDAAAGLSALAAREKAEAALEKGSAAEAEGLLNEVIGLNACGGMHLVYRSRSKARLAIGDISGALEDAEEAIRISPKFTQAHLLRGDALLAMGEYCAAENAYEDALDLDPSIRR

SEQ ID NO: 48337 - DNA, 712 bp, Panicum virgatum
  misc_feature: Ceres CLONE 2042197
  misc_feature: Encodes the peptide sequence at SEQ ID NO. 48338
gaacacgtcctctcgctccgagaggtcaatgccgctgccgccgcctgctccgcagctacagtgccccaaatactcactctcctcgagatcccacacctatcactagtgcaaatttatgccggcggttggagctgttcttcttcgccctgcccatctttctttcctgctccgatccaagaagtggggtttggttaaatcgttcgaggtcttgggaaaattttggggctgaactgaagaagggaggtcgcaatgccgaagatgtttgggttctctcggcgccgcatgaagctggggaggttaaagggtcatctacacgatcctttccatggctctcggagcccttctcggcacaccaagcgttttagtcaccccaatggagaagatccagtgactacctcagttagtggtcgtgctgatgaccttgcttggcgctgctcatctgatacttttgatctcaatgggcgtgcttttgagagctcagagaactgggcggtgctgtcaacagagggcgacaaaccgactcctcgttttgatcatgcagcagccattgtagggagtaaaatggtagtattcggtggtgattctggtcatcacttgctagatgatacaaagatattgagcttagacaagcttacctgggattccgtgtctcctaatgttcgaccatcatcaaatggacgttctttgaagttgcctccgtgcaaaggtcatt

SEQ ID NO: 48338 - protein, 154 aa, Panicum virgatum
  misc_feature: Ceres CLONE 2042197
  misc_feature: SWISSPROT Homolog: EC 3.1.3.16 Phosphoprotein phosphatase
MPKMFGFSRRRMKLGRLKGHLHDPFHGSRSPSRHTKRFSHPNGEDPVTTSVSGRADDLAWRCSSDTFDLNGRAFESSENWAVLSTEGDKPTPRFDHAAAIVGSKMVVFGGDSGHHLLDDTKILSLDKLTWDSVSPNVRPSSNGRSLKLPPCKGH

SEQ ID NO: 48339 - DNA, 732 bp, Panicum virgatum
  misc_feature: Ceres CLONE 2042206
  misc_feature: Encodes the peptide sequence at SEQ ID NO. 48340
attacccccccccccccccctctcgccgcgacccgccgccgccatggcaccaggcctctacgccgacatcggcaagaagaccagagatctgctgtacaaggactacaacacgcaccagaagttctccgtcaccacctgctccccccacggcgtcgcgatcacagctacaggaacaaggaaaaatgagtccatatttggcgagcttcacacccagattaagaacaagaagttgacagttgatgtcaaagcaaactcagagtcagatcttttgacaacaatcactgtggatgagtttggaacgccagggctcaaatcgattctcagcttggttgttccagaccagagatcagggaagcttgaactccagtacttgcatgcatttgctggtgtgaatgcaagcattgggcttaatccgaaccctatggttaacttctctggtgtctttggaagcaaagcactttcagttggtgttgatgtttcatttgatacggcaactagcaatttcaccaagtacaatgcggcactgagccttaccaatccagatcttattgcttccctccatttgaataaccatggtgataccttggttgcatcatactaccacttggtaaagcatcattcaggcaccgctgtgggggctgagctgtcacacagcttctctagaaatgagagcacactgatctttggttctcagcattcattggatccccacaccatcgtaaaggcacgctt

SEQ ID NO: 48340 - protein, 229 aa, Panicum virgatum
  misc_feature: Ceres CLONE 2042206
  misc_feature (2)..(229): Pfam Name: Porin_3 Pfam Description: Eukaryotic porin
  misc_feature: Functional homolog of the protein sequence given in SEQ ID NO 50463
  misc_feature: Useful for making plants with modulated drought sensitivity
MAPGLYADIGKKTRDLLYKDYNTHQKFSVTTCSPHGVAITATGTRKNESIFGELHTQIKNKKLTVDVKANSESDLLTTITVDEFGTPGLKSILSLVVPDQRSGKLELQYLHAFAGVNASIGLNPNPMVNFSGVFGSKALSVGVDVSFDTATSNFTKYNAALSLTNPDLIASLHLNNHGDTLVASYYHLVKHHSGTAVGAELSHSFSRNESTLIFGSQHSLDPHTIVKAR

SEQ ID NO: 48341 - DNA, 711 bp, Panicum virgatum
  misc_feature: Ceres CLONE 2042210
  misc_feature: Encodes the peptide sequence at SEQ ID NO. 48342
ctggcgctcccagcgctccagcagcagctggccgccttatccactccactctgcccagtccaggttccaactcaagctgctcctctcaaatctcaagcaccacagctacgactcgagctcgagcagagaggtgcggcctctgctcgtcctttgctgtggcaagggtggaacggcggaatcgatctctgcatcgcggaagagctcgcagccttatccactccactctgtccagtgaccgccgccgccgcctcctagctgggtggaagaagcatgtcgagaatggcgcctccgtcctctcccctgtccatgaagcccccgacgctgcccttctcgcctcccaagaagccggcgccgatgccggtgtacaaggacctgcacttcaaccgcgacctcgccgctaccaagaagctccaggccggggtggacctggtggcgcggttggtgggggtcaccatgggccccaaggggaggaacgtggtgcttggcaacaagtatggccctcccaagattgtcaatgatggggagaccgtcctcaaggagatcgaattggaggatccattagaaaatcttggagtgaagctggtcaggcaggctggtgcaaggaccaatgatattgcaggagatggttgtaccacttccataatccttgctcgaggcctgattgctgaaggaatgaaagttctcgcagctggaatcaacccagttcaggtt

SEQ ID NO: 48342 - protein, 143 aa, Panicum virgatum
  misc_feature: Ceres CLONE 2042210
  misc_feature: Functional homolog of the protein sequence given in SEQ ID NO 50704
  misc_feature: Useful for making plants with modulated nitrogen use efficiency
MAPPSSPLSMKPPTLPFSPPKKPAPMPVYKDLHFNRDLAATKKLQAGVDLVARLVGVTMGPKGRNVVLGNKYGPPKIVNDGETVLKEIELEDPLENLGVKLVRQAGARTNDIAGDGCTTSIILARGLIAEGMKVLAAGINPVQ

SEQ ID NO: 48343 - DNA, 673 bp, Panicum virgatum
  misc_feature: Ceres CLONE 2042220
  misc_feature: Encodes the peptide sequence at SEQ ID NO. 48344
attcgcattcgcatccaccaccgtccgcgatgacgccggcccgccgctccggggccgaagcgccgccagcgcttctggtggtgctgctgctgctgctgacgacgacggcgagcggcggcgcggcgcgcgcgtcgtccccgcgggtccccgcggtgatcgtgttcggggactcgacggtggacacgggcaacaacaaccagatccccaccccgctgcgcgccgacttcccgccctacgggcgcgacatgcccggcggcgcccgcgcgacggggcggttcggcaacgggcggctgccgccggacctcatctccgaggcgctgggcctgccgccgctcgtgccggcctacctcgacccggcctacggcatcgacgacttcgcccgcggcgtgtgtttcgcgtccgccggcaccggcatcgacgacgccaccgccggcgtcctggtaagcaagcgcctcgcccgcccgcccccgtgcactgtctattccttgtggatccgtcgagcgatgagctgaccagctgacgcgtaaggtgcactgaccgtctcacagtcacacgtacacttgggaggagagtgtgcgattgattgttcacacacaaacatccatgtaccaccaggcatgaagctaaacttcgtaaagtttactcagattgggccatcacgtacggtggtcgc

SEQ ID NO: 48344 - protein, 160 aa, Panicum virgatum
  misc_feature: Ceres CLONE 2042220
  misc_feature: SWISSPROT Homolog: EC 3.2.1.51 Alpha-L-fucosidase
MTPARRSGAEAPPALLVVLLLLLTTTASGGAARASSPRVPAVIVFGDSTVDTGNNNQIPTPLRADFPPYGRDMPGGARATGRFGNGRLPPDLISEALGLPPLVPAYLDPAYGIDDFARGVCFASAGTGIDDATAGVLVSKRLARPPPCTVYSLWIRRAMS

SEQ ID NO: 48345 - DNA, 632 bp, Panicum virgatum
  misc_feature: Ceres CLONE 2042239
  misc_feature: Encodes the peptide sequence at SEQ ID NO. 48346
acggctggcccggctctacctcactccgctcatcgcccaccgttccgcgctagctagcccagctagctctctcgccggcgccgcggaccatcgatcggcggtcggccgccatggcggcggcacttctcctgctggtggtgctggcagcggcgctcgcggttacggaggcgtcggcgccggcgttcgcggcggcgtcaaacaacgcgacggcgccgccgccgccgccgacggtggtggcgggcaagctgaacgtgcacctggtgccgcactcgcacgacgacgtcggctggctcaagaccgtcgaccagtactacgtcggctccaacaacaccatccagggcgcctgcgtcatgaacacgctcgactccgtcgtcgacgcgctcgccagggaccccgcccgcaagttcgtcgtcgtcgagcaggctttcttccaaaggtggtgggcagagaaaagcccgacaatccaagccatagtccacaagctggtcgatacgggtcagctagagttcataaatggtgggtggtgtatgcatgatgaagctgctgtacattacattgacatgattgatcagaccacacttggtcaccggatgattaagaaacagttcaacaagactccaagagctggctgg

SEQ ID NO: 48346 - protein, 173 aa, Panicum virgatum
  misc_feature: Ceres CLONE 2042239
  misc_feature (47)..(173): Pfam Name: Glyco_hydro_38 Pfam Description: Glycosyl hydrolases family 38 N-terminal domain
  misc_feature: SWISSPROT Homolog: EC 3.2.1.24 Alpha-mannosidase
MAAALLLLVVLAAALAVTEASAPAFAAASNNATAPPPPPTVVAGKLNVHLVPHSHDDVGWLKTVDQYYVGSNNTIQGACVMNTLDSVVDALARDPARKFVVVEQAFFQRWWAEKSPTIQAIVHKLVDTGQLEFINGGWCMHDEAAVHYIDMIDQTTLGHRMIKKQFNKTPRAG

SEQ ID NO: 48347 - DNA, 563 bp, Panicum virgatum
  misc_feature: Ceres CLONE 2042250
  misc_feature: Encodes the peptide sequence at SEQ ID NO. 48348
gaagctttttcccgttcacctgtttagccctctccccctttcgtggccttccttttcctggcggcgacgactgggcgagcagcagcgcgctacgcccgtcttcgctgggctcttcgccgttgacgagcagagcacccaccagggtaattttggacatggcgttcctgcagaaggttggcaatcttgtcaagcggtccacgggtgccagctcgtcgctctaccaggcggttcgatgcatgtcctcctccaagctcttcataggaggaatctcgtatggcacagatgagcacagcctcagggatgcttttgcaagctatggccaagtcattgaagctaggataataatggaccgggaaaccggaagatcgagggggtttggttttgtgacatacacatctacggaggaggcagctgctgccattactggcatggatgggaaggatttgcagggtcggatagtgaaggtgacttatgctcatgaccgtggtagccgtcttggtggaggtggcagtggtggatatggtggaggcggctatggtggtggtggtggatatgggtggagg

SEQ ID NO: 48348 - protein, 135 aa, Panicum virgatum
  misc_feature: Ceres CLONE 2042250
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50182
  misc_feature: Useful for making plants with modulated biomass
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
MAFLQKVGNLVKRSTGASSSLYQAVRCMSSSKLFIGGISYGTDEHSLRDAFASYGQVIEARIIMDRETGRSRGFGFVTYTSTEEAAAAITGMDGKDLQGRIVKVTYAHDRGSRLGGGGSGGYGGGGYGGGGGYGW

SEQ ID NO: 48349 - DNA, 690 bp, Panicum virgatum
  misc_feature: Ceres CLONE 2042301
  misc_feature: Encodes the peptide sequence at SEQ ID NO. 48350
ggatcggcttccctcacctcgcctcgcttccttttctaccccgcgtctccctcccagcgcggcccttctcgccatcaccatcaccatcatcacgagacggccgcgctgcccgcccgcaacggaaccggcaggggactggtggtaggctgaccgcgaggagggagccatggctcagatcttgctccacggcacgctccacgccaccatcttcgaggcggagtcgctctccaacccgcaccgcgcatccggcggcgcccccaagttcatccgcaagcttgtggaggggatcgaggacaccgtgggtgtcggcaaaggcaccaccaagatatatgccaccattgatctagagaaagcccgggtcgggcgtacccggatgatctccaacgagcccgtcaatcctcgatggtacgagtcgttccacatttactgcgcccacctcgccgccgatgtcatcttcaccgtcaagatcgataaccccattggggcgtccctcattgggagggcttacctgcctgtcaaggacctcctggatggtgaggagatcgataagtggcttcaaatctgtgatgacaaccgtgagcctgttggtgacagcaagatccatgtcaagcttcagtactttgatgttgccatggaccgcaactgggcgagaggtgtccggagcaccaagtatcctggtgttccttacac

SEQ ID NO: 48350 - protein, 174 aa, Panicum virgatum
  misc_feature: Ceres CLONE 2042301
  misc_feature (10)..(114): Pfam Name: C2 Pfam Description: C2 domain
  misc_feature: SWISSPROT Homolog: EC 3.1.4.4 Phospholipase D
MAQILLHGTLHATIFEAESLSNPHRASGGAPKFIRKLVEGIEDTVGVGKGTTKIYATIDLEKARVGRTRMISNEPVNPRWYESFHIYCAHLAADVIFTVKIDNPIGASLIGRAYLPVKDLLDGEEIDKWLQICDDNREPVGDSKIHVKLQYFDVAMDRNWARGVRSTKYPGVPY

SEQ ID NO: 48351 - DNA, 738 bp, Panicum virgatum
  misc_feature: Ceres CLONE 2042320
  misc_feature: Encodes the peptide sequence at SEQ ID NO. 48352
aaaagcccacagaacaggggaggcgacttgcttcgtactgctcacctagccgtttcacccacctaatctctctcccctccacgtcgccggcgatcgccggagcccgcactgctgcggggacccgccctcgccatggctttgcacgggaagaagcttatcaatgatccagacgatgtggtgacggaattcatcgaggggctggtggagacctacccgggccttcagtatctggatgggttccctcagattaaggttgttattcgtgctgatgtcgttcgtggtgcctatgaaaaggttgcggtcatatcaggtggtggaagcggccatgaaccagcccatgctggatttgttgggccagggatgttgactgctgctgtttctggagacgtctttgcttctccgccagttgattcaattttagctgctattcgagctgtaactggtcccatgggatgccttctaatagtaaagaactacactggtgatagacttaattttgggttagctgctgagcaggcaaaatctgaaggctacaagattgagatggttattgttggggatgactgtgcccttccaccacctcgtgggatagctggcagaagaggtttagctggaacaattcttgtgcataaggttgctggggctgctgcagatgctggtttatctcttgcagatgttgcagcaaaagcaaaacatgcatcttgaggttgtgggtacaatgggagttgcactttctgt

SEQ ID NO: 48352 - protein, 190 aa, Panicum virgatum
  misc_feature: Ceres CLONE 2042320
  misc_feature (22)..(190): Pfam Name: Dak1 Pfam Description: Dak1 domain
  misc_feature: SWISSPROT Homolog: EC 2.7.1.29 Glycerone kinase
MALHGKKLINDPDDVVTEFIEGLVETYPGLQYLDGFPQIKVVIRADVVRGAYEKVAVISGGGSGHEPAHAGFVGPGMLTAAVSGDVFASPPVDSILAAIRAVTGPMGCLLIVKNYTGDRLNFGLAAEQAKSEGYKIEMVIVGDDCALPPPRGIAGRRGLAGTILVHKVAGAAADAGLSLADVAAKAKHAS

SEQ ID NO: 48353 - DNA, 694 bp, Panicum virgatum
  misc_feature: Ceres CLONE 2042333
  misc_feature: Encodes the peptide sequence at SEQ ID NO. 48354
agagacacacaccgctgcttgaagaaaccctctctcccctctaccccttttcctctaacctttagctttcctccctccttccctctcctctcctctcttcttcccttcctctaacaagaactagtcctagccattcagatcctaagttgctggccttgctgcttcttgttggagaaagatttgttggttccaagttggaagtatcatgagtccaccgagtgtgatggggcagtttggagacacaacctacaccaaggttttcgttgggggactcgcatgggaaacccagaaggagaccatgaggaagtacttcgagcagtttggggagatcctggaggccgttgtcatcactgacaagaataccggcagatccaagggctacggatttgttaccttccgggaccccgatgcagcgatgagagcttgcgttgatcctgcgcctgtgatagacgggaggagggccaactgtaatctggcctcacttggggttcaaagatctaggcctccaacaccccagcacggaggatctaggagctttagggtgatgaaatccttcagccagcaggcagggatccagggtggactgggcgcagcttttccttctcatgccaccttccctcattatgccatcccacaaggcctcccctaccatgtctatggggactctccctatactccagactacgggtatcca

SEQ ID NO: 48354 - protein, 156 aa, Panicum virgatum
  misc_feature: Ceres CLONE 2042333
  misc_feature (12)..(82): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50671
  misc_feature: Useful for making plants with modulated biomass
MGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGSRSFRVMKSFSQQAGIQGGLGAAFPSHATFPHYAIPQGLPYHVYGDSPYTPDYGY

SEQ ID NO: 48355 - DNA, 711 bp, Panicum virgatum
  misc_feature: Ceres CLONE 2042374
  misc_feature: Encodes the peptide sequence at SEQ ID NO. 48356
cctcctcccgatctccaccctccacgcccacgcttcgccccgctgctcgtcgcggcaggcgtcatctcatcaccgccaccggccgtggtccccgcccgcctgcccgcgctcgccagccgcctcgtcccccgacgaggcgcgcgcgaccgcccccttcggctccgcgacaggctcttctccccccggctcggctcggttcggttctgccgccaccgcggcgctcccggatctcggcgaccgcttctcgtccactgattagcagacaaagatggcgacctacgagcccaagaacattctcataactggcgctgctggtttcattgcatcacatgtggcaaaccgcctggttaggaactatccacactacaagattgttgtcctcgacaagcttgactactgctccagcctaaagaacctcaacccttcacggccttcaccaaatttcaagtttgtcaagggtgacattgcaagtgctgatctggtcaactaccttctgatcacagagtcgattgacaccatcatgcattttgctgctcagactcatgtggataattccttcggcaattcatttgagttcacaaagaacaatatatatggtacccacgtcctgctggaggcttgcaaggttactggtcagatcaggaggtttattcatgtcagtactgatgaggtgtatggagaaactgatgaggatgctgtggttggtaacca

SEQ ID NO: 48356 - protein, 147 aa, Panicum virgatum
  misc_feature: Ceres CLONE 2042374
  misc_feature (9)..(147): Pfam Name: Epimerase Pfam Description: NAD dependent epimerase/dehydratase family
  misc_feature: SWISSPROT Homolog: EC 4.2.1.46 dTDP-glucose 4,6-dehydratase
  misc_feature: Functional homolog of the protein sequence given in SEQ ID NO 51136
  misc_feature: Useful for making plants with altered cell wall content and/or composition
  misc_feature: Functional homolog of the protein sequence given in SEQ ID NO 51125
  misc_feature: Useful for making plants with altered carbohydrate content
MATYEPKNILITGAAGFIASHVANRLVRNYPHYKIVVLDKLDYCSSLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGN

SEQ ID NO: 48357 - DNA, 626 bp, Panicum virgatum
  misc_feature: Ceres CLONE 2042401
  misc_feature: Encodes the peptide sequence at SEQ ID NO. 48358
gaaaaccccccacgaaccccaccaacccaatggcgacgccaccgctctcgccggcggacgcggaggaggaggaggcgcgggagctcctctacgaggcgtacaacgagctgcaggcgctggcggccgagctgggcggcgccgcgggggcgccggccgtcgtcgtggtgggccatcagacggacggcaagagcgcgctggtcgaggcgctcatggggttccagttcaaccacgtcgggggcggcaccaagacgcgccgccccgtcgctctccacctccgcttcaacccgcgctgcgacgcgccgcagtgccgcctgctcgctggccccggggacgaagatgaagacgccggggtcgcgggtcgccccatgccgctcgccgacatccaggcatatattgaagctgaaaacatgaggctggagagtgacccttgccaattttcagacaaggaaatcatagtaaaggtagaatacaagcattgccccaatctcaccattattgacactccaggtctcattcttccagctcctggccgtaaaaaccgagttttgcagagccaggcttctgctgttgagagccttgttcgtgctaaaatccagcataaagagaccattatactgtgccttgaa

SEQ ID NO: 48358 - protein, 198 aa, Panicum virgatum
  misc_feature: Ceres CLONE 2042401
  misc_feature (43)..(195): Pfam Name: Dynamin_N Pfam Description: Dynamin family
  misc_feature: SWISSPROT Homolog: EC 3.6.5.5 Dynamin GTPase
MATPPLSPADAEEEEARELLYEAYNELQALAAELGGAAGAPAVVVVGHQTDGKSALVEALMGFQFNHVGGGTKTRRPVALHLRFNPRCDAPQCRLLAGPGDEDEDAGVAGRPMPLADIQAYIEAENMRLESDPCQFSDKEIIVKVEYKHCPNLTIIDTPGLILPAPGRKNRVLQSQASAVESLVRAKIQHKETIILCL

SEQ ID NO: 48359 - DNA, 686 bp, Panicum virgatum
  misc_feature: Ceres CLONE 2042412
  misc_feature: Encodes the peptide sequence at SEQ ID NO. 48360
aaccatactcaagcagctcaaaacctctagcctgctaccaagaaatggctctggttgcttctcccctgataagtcacactgcccatcgtcctggcctaagaagccacataggacccaatggtggcaatttgtcatggcacgagaagagtaaaagaaggtgtgaccttattagtgttagatcactaccctggagcggcgagcctgtagaatatttgacgccttcagaaatcccaaggagggactggttcagcgacgagttcgtctttggctccgccacttcagcataccaaattgaaggtgcttggaatgagcatggcaaggggccaagcacttgggaccacttctgccacacttatcctgagaggatagttgatggaagcaatggggatgttgcagtgaactcctaccatatgtatgaagaggatgtcaagttgctgaagcaaatgggcatggacgcctataggttctcaatctcttggtcgagaatactgccaaaggggacgctcgaaggtgggataaactataatggcctccagtactacagaaacctgatcaacacgttgaaagagaatggcatagagccatatgtaacaattttccactgggacactcctcaagcactggaggacaagtatcacctcctcagatacgaggatagtaaaaaactacacacacactgtcacagg

SEQ ID NO: 48360 - protein, 213 aa, Panicum virgatum
  misc_feature: Ceres CLONE 2042412
  misc_feature (64)..(212): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51621
  misc_feature: Useful for making plants with altered cell wall content and/or composition
MALVASPLISHTAHRPGLRSHIGPNGGNLSWHEKSKRRCDLISVRSLPWSGEPVEYLTPSEIPRRDWFSDEFVFGSATSAYQIEGAWNEHGKGPSTWDHFCHTYPERIVDGSNGDVAVNSYHMYEEDVKLLKQMGMDAYRFSISWSRILPKGTLEGGINYNGLQYYRNLINTLKENGIEPYVTIFHWDTPQALEDKYHLLRYEDSKKLHTHCH

SEQ ID NO: 48361 - DNA, 703 bp, Panicum virgatum
  misc_feature: Ceres CLONE 2042430
  misc_feature: Encodes the peptide sequence at SEQ ID NO. 48362
acccattcactccattgcctcatcatctcattgtctagcagctactagcagcagccaacaataacacctcgcccatggcgatggccgccgcctcctcgtgcacggacgccacgtggtgggcgtacgcgctcccggcgcttctcggcgcggacaccctgtgcgcgcacccggccctcctggccgccgcgctcctcctggccaccgtctcggcggcgctgctcgcctgggccgcgtcgccgggcgggccggcttgggtgcacggccgcggccgcctcggtgccacgcccatcgtcggcccacgcggcctgcccgtgttcggcagcatcttcgcgctgtccggcgggctgccgcaccgcgcgctcgccgccatggcgcgcgccgcggggccccgggccagggagctcatggcgttctccgtcggggacacgcccgccgtggtgtcgtcctgcccggccacggcgcgcgaggtgctcgcgcacccgtcctttgccgaccgccccgtcaagcggtcggcgagggagctcatgttcgcgcgcgccatcgggttcgcgcccagcggcgagtactggcgccgcctccgccgcatcgcctccacgcacctcttctctccgcgccgcgtcgccgctcacgagcccgggcgccaggctgacgccggcgccatgctccgggccatcgccgccgagcagtctgcctccggcgcccg

SEQ ID NO: 48362 - protein, 209 aa, Panicum virgatum
  misc_feature: Ceres CLONE 2042430
  misc_feature: SWISSPROT Homolog: EC 1.14.13.68 4-hydroxyphenylacetaldehyde oxime monooxygenase
MAMAAASSCTDATWWAYALPALLGADTLCAHPALLAAALLLATVSAALLAWAASPGGPAWVHGRGRLGATPIVGPRGLPVFGSIFALSGGLPHRALAAMARAAGPRARELMAFSVGDTPAVVSSCPATAREVLAHPSFADRPVKRSARELMFARAIGFAPSGEYWRRLRRIASTHLFSPRRVAAHEPGRQADAGAMLRAIAAEQSASGA

SEQ ID NO: 48363 - DNA, 563 bp, Panicum virgatum
  misc_feature: Ceres CLONE 2042440
  misc_feature: Encodes the peptide sequence at SEQ ID NO. 48364
atttcggccgctgcgtcgcgttgggagcaggactccgctttgcttgcgtcccgaccagcggaaagaagaggcgagggagggagggaggtagaaaaggggaggaaaggaggcgccgagcgagagcagccatagggggagaggcggatgaatggggaataagagctgtagaggaagggggaagcaaatcttgtatgggcgtcgtgagattcctgcggtggaggaggaaacgcgagcggagggtagtgaggtagctcaatacatctaccactgcttatgtgtagccccgtctgggtactagaacagctgcagctcaagctttggtgctgataagttgcacgatcacctgaacgagctgatgattatagatgataaagaagttgaagctaccatgattaatgggaaagggaccgatactgggcacattattgtgactactactggtggcaagaatggtcaaccaaagcacacggtgagctacatggctgagcgcattgtgcgtcaaggttcttttgggattgtcttccaggctgaatgcttggagacgggtgagactgttgccataa

SEQ ID NO: 48364 - protein, 69 aa, Panicum virgatum
  misc_feature: Ceres CLONE 2042440
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
MIIDDKEVEATMINGKGTDTGHIIVTTTGGKNGQPKHTVSYMAERIVRQGSFGIVFQAECLETGETVAI

SEQ ID NO: 48365 - DNA, 702 bp, Panicum virgatum
  misc_feature: Ceres CLONE 2042441
  misc_feature: Encodes the peptide sequence at SEQ ID NO. 48366
gaatatatcgatgaaacagcaatcacttttcgtgtgattaacagtctttatgccggtattacgactgtcgaactagataatctggctgcgaagaccgccgccacaatgaccaccaatcatccggactacgctatacttgccgctcgtattgcgatcagtaatctacataaggaaactaagaaaaacttctctgacaccatgaaagatttgtacgaaatgcagaatgataaaaatggccttaaaacaccgatgatcagcgacgatgtttacgagataattatgaaaaataaagatctatttgattcatcgattatttatgatcgtgatttcggctacaattactttggttttaagacgcttgaacgctcttatttactcaagatcaacggtaaggtcgtcgagagaccacagcatatgcttatgagagtcgctatcggtattcacaaagaagatgttcaagctgcaattgaaacttacaatcttatgagtgaacgttggtttacgcacgcatcgcctacattattcaattccggtacacctaaaccacaattgtctagttgttttctacttacaatgaaagatgatagtatcgaaggtatttatgatacgcttaaacaaacggctctaatttcgaaatcggccggtggtatcggtgtaaatgttcattgtatacgtgcaactggtagctacatttctggtaca

SEQ ID NO: 48366 - protein, 233 aa, Panicum virgatum
  misc_feature: Ceres CLONE 2042441
  misc_feature (110)..(182): Pfam Name: Ribonuc_red_lgN Pfam Description: Ribonucleotide reductase, all-alpha domain
  misc_feature: SWISSPROT Homolog: EC 1.17.4.1 Ribonucleoside-diphosphate reductase
EYIDETAITFRVINSLYAGITTVELDNLAAKTAATMTTNHPDYAILAARIAISNLHKETKKNFSDTMKDLYEMQNDKNGLKTPMISDDVYEIIMKNKDLFDSSIIYDRDFGYNYFGFKTLERSYLLKINGKVVERPQHMLMRVAIGIHKEDVQAAIETYNLMSERWFTHASPTLFNSGTPKPQLSSCFLLTMKDDSIEGIYDTLKQTALISKSAGGIGVNVHCIRATGSYISG

SEQ ID NO: 48367 - DNA, 691 bp, Panicum virgatum
  misc_feature: Ceres CLONE 2042512
  misc_feature: Encodes the peptide sequence at SEQ ID NO. 48368
acgcctcccaacccctctcctcctctgctcccaagatctcctcatctcccggcccggcagcagcgcgcggggtgggcagagagatcgagatccggaggaggcgcggcacctcgcggcaccagcaatggcgggcacggtgacggtcccggggggaacgtcccctccacgccgctgctcaaggacgagctcgacatcgtgatcccgacgatccgcaacctcgacttcctggagatgtggcggcccttcttccagccgtaccacctcatcatcgtgcaggacggcgacccgaccaagaccatcaaggtgcccgagggcttcgactacgagctctacaaccgcaacgacatcaaccgcatcctcggccccaaggcatcctgcatctccttcaaggactccgcctgccgctgcttcggctacatggtctccaagaagaagtacatctacaccatcgacgacgactgcttcgtatgacctctttctcctattctgctcccgttcctgttaaaattgactcttggatccgacggaaaggcgggatcttggcgccggatctgggtccaattcgcccagatccggcccgatcagatctggatctcggcttgcgcggtcaattccgttgatccttagcgtcggtggtggtttcgcattgcggatctcggatctgtagcaccaggctatgctcagtagctgg

SEQ ID NO: 48368 - protein, 156 aa, Panicum virgatum
  misc_feature: Ceres CLONE 2042512
  misc_feature (54)..(156): Pfam Name: RGP Pfam Description: Reversibly glycosylated polypeptide
TPPNPSPPLLPRSPHLPARQQRAGWAERSRSGGGAAPRGTSNGGHGDGPGGNVPSTPLLKDELDIVIPTIRNLDFLEMWRPFFQPYHLIIVQDGDPTKTIKVPEGFDYELYNRNDINRILGPKASCISFKDSACRCFGYMVSKKKYIYTIDDDCFV

SEQ ID NO: 48369 - DNA, 685 bp, Panicum virgatum
  misc_feature: Ceres CLONE 2042516
  misc_feature: Encodes the peptide sequence at SEQ ID NO. 48370
attgcaattgcaggtggctgtcaagtgcaggccattgaccgacaccgagcagcggcgctcgcggcatatcatccaggtcatcgatgataagactgtggttgtgctggaccccgatctgtcaaaggattacctggacctaatacagaaccggacgaaggagaggagatacacatttgatcacgtgtacgcacctggatgctccaattcggacgtgtacaagaatatatcctctacaatttctggtgtagtccaaggccttaatgccacagtctttgcttatggttgtactggaagtggcaagacttacactatggttggaacccatagtgatcctggccttatggttcttagcttttgtacaatttttgagctgataaaaaaggacggaggtccagatacatttgaagtctcatgttcatatctggaagtgtacaatgaggttatctacgatttgcttgagaaatcctctggacacctggagcttcgagaagatcctcagcatggcatattagttgctgggttgagaagcattaaggttcattctgcagatagaattcttgagctgttgaacataggcaacagtagacgcaagacagagagcacagaagcaaatgctacctcttcacggtcacatgctgtacttgagattactgtaaagcgaaagcagaaaggtcaatatgggaaa

SEQ ID NO: 48370 - protein, 227 aa, Panicum virgatum
  misc_feature: Ceres CLONE 2042516
  misc_feature (8)..(227): Pfam Name: Kinesin Pfam Description: Kinesin motor domain
LQLQVAVKCRPLTDTEQRRSRHIIQVIDDKTVVVLDPDLSKDYLDLIQNRTKERRYTFDHVYAPGCSNSDVYKNISSTISGVVQGLNATVFAYGCTGSGKTYTMVGTHSDPGLMVLSFCTIFELIKKDGGPDTFEVSCSYLEVYNEVIYDLLEKSSGHLELREDPQHGILVAGLRSIKVHSADRILELLNIGNSRRKTESTEANATSSRSHAVLEITVKRKQKGQYG

SEQ ID NO: 48371 - DNA, 627 bp, Panicum virgatum
  misc_feature: Ceres CLONE 2042521
  misc_feature: Encodes the peptide sequence at SEQ ID NO. 48372
agccggatcctccccacgccgccgcggcgccgctctccgctctccgccgcccgggtcgtgcagagccgatccctcaacgccatccttcgttagctaaacaatgaggcagcagactggtaaacgtccccgccaacatagggaatatgaaagagaagaaaggaaggaccaaaacaagaggccatttgcccatgctcaggaaagctataataatgatgggctggtggtttaccgtatactttgtccagacagtgtaattggtagtgtcataggaaagaatggcaatgtgataaatgctatcaggcaacaagcaaatgccaaagtcaaggttgttgacccctaccctggtgcagacaaaagggtcatcttggtatattgctatgtcaagcatagagaccttgatgctgatgagggtgatgacaatgaacctgtttgcccagctcaagatgcattacttagggtgcataatgcaattgttgatgcactagatacgctacataagaatcgtagagactctgaaaagaagaaaatagaagctaacatccttgtaccagctagtcaggctgcaagtgttataggaaaatctggtgttgtcatcaagtatctccggtcaacatctaaagcattcat

SEQ ID NO: 48372 - protein, 175 aa, Panicum virgatum
  misc_feature: Ceres CLONE 2042521
  misc_feature (42)..(94): Pfam Name: KH_1 Pfam Description: KH domain
MRQQTGKRPRQHREYEREERKDQNKRPFAHAQESYNNDGLVVYRILCPDSVIGSVIGKNGNVINAIRQQANAKVKVVDPYPGADKRVILVYCYVKHRDLDADEGDDNEPVCPAQDALLRVHNAIVDALDTLHKNRRDSEKKKIEANILVPASQAASVIGKSGVVIKYLRSTSKAF

SEQ ID NO: 48373 - DNA, 724 bp, Panicum virgatum
  misc_feature: Ceres CLONE 2042530
  misc_feature: Encodes the peptide sequence at SEQ ID NO. 48374
acggctccacgccatctcttcttcctcctcctctcatcgtcgtcgcggggctcctcctcctccttccggccttacaaacccaccgccccgccggacccacttgctggctcggcgccgcctcgaggctcccccgcggccgctgcatttgcgggtgacctcttctacgagagccgcgagcggctgcggctgcgagacgggaggtgtgcggtccttggttgcggcttctgccctgtccgctgcggcgagctgctccgcgcgggcgggcctgagactgaaaattcttgcatatattcatcccattattggtactccggttgctgttgagtgattgggaaagctgtttggccggaaagcattcttagtcatgggaagcaatgaccctagcacaccctccaaggctccaaaggcatcagaacaagatcaaccttcagccactacatctggggcaacagcttcagtttaccctgaatggcccagctttcaggcttactcagcaattccaccacatggattctttccccctactgttgctgcaaatccacaggctcatccatacatgtggggagctcagcccatggtaccaccgtacgggacgccgccatcaccttatgtgatgtatccacctggaacagtatatgcccatccctctacagcacctggtatgcatccatttagtcattatcctatgccaacaaatggacatgctgaaactcctggagctgcg

SEQ ID NO: 48374 - protein, 119 aa, Panicum virgatum
  misc_feature: Ceres CLONE 2042530
  misc_feature (1)..(119): Pfam Name: MFMR Pfam Description: G-box binding protein MFMR
  misc_feature: SWISSPROT Homolog: EC 2.7.11.1 Non-specific serine/threonine protein kinase
  misc_feature: Functional homolog of the protein sequence given in SEQ ID NO 51160
  misc_feature: Useful for biocontainment applications
  misc_feature: Useful for making plants with altered alkaloid content
  misc_feature: Useful for making plants with altered lignin content
  misc_feature: Useful for making plants with altered terpenoid content
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MGSNDPSTPSKAPKASEQDQPSATTSGATASVYPEWPSFQAYSAIPPHGFFPPTVAANPQAHPYMWGAQPMVPPYGTPPSPYVMYPPGTVYAHPSTAPGMHPFSHYPMPTNGHAETPGA

SEQ ID NO: 48375 - DNA, 575 bp, Panicum virgatum
  misc_feature: Ceres CLONE 2042595
  misc_feature: Encodes the peptide sequence at SEQ ID NO. 48376
ccgatgcttcggccgccgcgatcctaagagcggggggtggagcatccgcgtggagtgggttgggctgctggttgatctccgtgagcaccggcgcctgcgcgctgggaggtgaggaggtggttgcgcgaggtttatggagaagtccctgagggagggggcctccccggggccgtcgtgggcgccgagcgagttcacggctttccgggggtatgctgcggcggtgggggagcgggcgggggcgtcgccgtccgccccgggcaatggggttcccgcccgctcaagcaacctccgcgccgtcgggaagaggccttttgttgcaagattaaccacagacatcatccaaatttttgaaaaatgcaatcctgagtttaaatactcggagtcactaaaccccaagcggtttctcaccaaccctgctgttcctgttcacaacgatggtcttgacaatgcaaattctgacctcatcttgtatgtcaacctggaactggttaatagaaagtcagacaggaggtatgttgtccaagaaatgcttgggcaaggtacctttggacaggttgcaaaatgctgggatgctg

SEQ ID NO: 48376 - protein, 147 aa, Panicum virgatum
  misc_feature: Ceres CLONE 2042595
  misc_feature: SWISSPROT Homolog: EC 2.7.12.1 Dual-specificity kinase
MEKSLREGASPGPSWAPSEFTAFRGYAAAVGERAGASPSAPGNGVPARSSNLRAVGKRPFVARLTTDIIQIFEKCNPEFKYSESLNPKRFLTNPAVPVHNDGLDNANSDLILYVNLELVNRKSDRRYVVQEMLGQGTFGQVAKCWDA

SEQ ID NO: 48377 - DNA, 682 bp, Panicum virgatum
  misc_feature: Ceres CLONE 2042609
  misc_feature: Encodes the peptide sequence at SEQ ID NO. 48378
aaaatctccaatactgaatccacccatatgcctgacgcttccttccatggcatccaagtaagcgtcgtccgacactcctacaccggagggagagtattcgtgcttcgagcccgcaaatccatccgtgaccggtcaacaactccctggctttggtcgtttcttcagataaacatcagagagctgcaattcattcgttgaagtgggtgtggagtttaccttgtcgttacagattattacctgtttactaggttctcatcaggactgtttgacataaacagtgcactaccagaagtaccaattaggataaattaaagaaaagaaaccataaagaccaaggttctgatttttcttgcatcgatcatcttcttaaggctatttgtcatttatatgaacttcaccgtttccgcaggagttactccacaaacaacaccatggaatttattcaagaaagtgatagatctaagtggaaggcgcatagtaatcatagcataaaatgcttcactaaaggtgacatggatagaatgaccaacagctatcaaactagtcttggaagaggtgccttcggagaagtgtacaaaggggttcttgaggatggaagtatgattgcagtgaaaaggtttatccacaatgtgaaagaaaacttcgctaaagagctgatcgtccatcgtgaaatcaaccacaa

SEQ ID NO: 48378 - protein, 83 aa, Panicum virgatum
  misc_feature: Ceres CLONE 2042609
  misc_feature: SWISSPROT Homolog: EC 2.7.11.1 Non-specific serine/threonine protein kinase
MEFIQESDRSKWKAHSNHSIKCFTKGDMDRMTNSYQTSLGRGAFGEVYKGVLEDGSMIAVKRFIHNVKENFAKELIVHREINH

SEQ ID NO: 48379 - DNA, 598 bp, Panicum virgatum
  misc_feature: Ceres CLONE 2042673
  misc_feature: Encodes the peptide sequence at SEQ ID NO. 48380
gcattcaccccaatccgaacggcctccctccattaaaacctcctcctccaccagcaccaccacccccaattccacacccgcacgcctggtgcttgcgctagtgtgctgctgccccgcttgtgctggtagccatggggacgtcggggtccaagagcatcgacggcctcggcgccgaggcggcgggcggcggggcggcgggcggcggcggggaggcgggcgagggcggcgccgccgcggaggcgtggcacggcggggcgcagctctacgtgtcgctcaagatggagaacgcgcggatcagtggcgacctcgtcccgcacgtcttcggctccgagcccatcatcggctcctgggaccccgcccgcgccctcgcgatggagagggagctagcgtccatgtggcagctcagcttcgtcgtgccgccggatcatgaaacgttggacttcaaattcttgctgaagcccaaagacgcagcaaccccgtgcatcattgaggaagggccaacacgcctcctcactggaggcatgctcgagggtgatgtgagggtagcacttttcaagctcaatggggatgacgaggtgctcgagttcagggtgctcaa

SEQ ID NO: 48380 - protein, 155 aa, Panicum virgatum
  misc_feature: Ceres CLONE 2042673
  misc_feature: SWISSPROT Homolog: EC 3.2.1.1 Alpha-amylase
MGTSGSKSIDGLGAEAAGGGAAGGGGEAGEGGAAAEAWHGGAQLYVSLKMENARISGDLVPHVFGSEPIIGSWDPARALAMERELASMWQLSFVVPPDHETLDFKFLLKPKDAATPCIIEEGPTRLLTGGMLEGDVRVALFKLNGDDEVLEFRVL

SEQ ID NO: 48381 - DNA, 744 bp, Panicum virgatum
  misc_feature: Ceres CLONE 2042683
  misc_feature: Encodes the peptide sequence at SEQ ID NO. 48382
gacacaatttaaaaaaaaagtatttctatcagattcaggtacagttgagggggcggcaggcgaacagccgatagagatagagagctcggcccggtgacagcccagtccttccgcttccgccttccgcaccttgtagtctccgccgaccgggaccacgcgcgcacacccctccggtccgatcccatctccggcgaaccccaggtgtagcggcgcgaggcgagggatccaatggcggcgtcggaggggcagtgggtgctcatggcaacggggcggtcgccgaccaacatcgcggttatcaagtactgggggaagcgcgacgaggccctcatcctccccgtcaacgacagcatcagcgtcacactcgaccccaaccacctctccgccaccaccaccgtcgccgtcagcccctcattcccctccgaccgcatgtggcttaacggcaaggagatctcgctgtcaggaggaaggtttcagagctgcctgagagagatccgaaagcgggcctgtgagtttgaggatgagaagaaggggatcaagatcaagaaagaggactgggagaacttgcatgtccacatagcctcctacaacaacttccccaccgctgctggtttagcctcttcggctgctggcttcgcttgtctcgttttcaccctcggaaagctgatgaatgtgaaagaagattatggagaactttcttcaatagcaaggcagggatctgggagtgcatgccgcagtttatatggt

SEQ ID NO: 48382 - protein, 171 aa, Panicum virgatum
  misc_feature: Ceres CLONE 2042683
  misc_feature (115)..(170): Pfam Name: GHMP_kinases_N Pfam Description: GHMP kinases N terminal domain
  misc_feature: SWISSPROT Homolog: EC 4.1.1.33 Diphosphomevalonate decarboxylase
MAASEGQWVLMATGRSPTNIAVIKYWGKRDEALILPVNDSISVTLDPNHLSATTTVAVSPSFPSDRMWLNGKEISLSGGRFQSCLREIRKRACEFEDEKKGIKIKKEDWENLHVHIASYNNFPTAAGLASSAAGFACLVFTLGKLMNVKEDYGELSSIARQGSGSACRSLY

SEQ ID NO: 48383 - DNA, 642 bp, Panicum virgatum
  misc_feature: Ceres CLONE 2042688
  misc_feature: Encodes the peptide sequence at SEQ ID NO. 48384
gcctcgtccccctccgtccttcgatacgcccgataaaacccccaggaggccaggacgccccttctccagctggtcgtcccatcctttccacccccgactcttcgtcccctccgaaggaagccgcgcgcgccgccgattgaggaagcccaatccatggcgctctcctgcatgaggtgccccgcgggcgccgccgcccgacgcgccgcggcgccgccgccgtccccgatggccgccgtctccttcgccagatgcggcttcgggaggtcaactgccgccgccggatgttggcgcatccaggccgtcgcccctcagggagtgaaagctcccatggatcccaatgtgaagaatgcagtcacacctacgaccccatcaaaggtggaaaacggctccccttcagaaatcacgctagatgaatttgaagacttgaatgctctatccaagaatgacgattctactgttagcatcactgtagttggagcatctggtgatcttgccaagaagaagatatttcctgctctttttgctctctactatgaagattgccttcccaagcatttcaccatctttggctatgcacggagcaagatgacagatgctgaactgaggaacatggtcagcaaaacactgacttgcagaatagat

SEQ ID NO: 48384 - protein, 162 aa, Panicum virgatum
  misc_feature: Ceres CLONE 2042688
  misc_feature (105)..(162): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MALSCMRCPAGAAARRAAAPPPSPMAAVSFARCGFGRSTAAAGCWRIQAVAPQGVKAPMDPNVKNAVTPTTPSKVENGSPSEITLDEFEDLNALSKNDDSTVSITVVGASGDLAKKKIFPALFALYYEDCLPKHFTIFGYARSKMTDAELRNMVSKTLTCRI

SEQ ID NO: 48385 - DNA, 724 bp, Panicum virgatum
  misc_feature: Ceres CLONE 2042689
  misc_feature: Encodes the peptide sequence at SEQ ID NO. 48386
aacccactcaacttctatcgacgagaaccctcctcaccgacgcaccccagccgccgccgcgacgctcgtcctcctcctccctccgcgaagaagagcggcagaagtgggaagagtggtaaccagccggcctcacttccccgccgccgcctcctcctcgtcgttttcgtcagggactcaggcgtcttctctcgctgtttcgaagatggctcgccgaggattgatggagcaggacttaagcaagcttgacgtgaccaagcttcacccgttgtcacctgaagtcatctcacgccaagcaaccatcaatattggtacgattggccatgtggctcatggaaagtctactgttgtgaaagctatatctggagttcagactgttcggttcaagaatgagctggagcgtaacatcactatcaagctgggttatgcgaatgcaaaaatctacaaatgtgaggatgacagatgtccacggcctatgtgctataaggcctacggaagcggaaaagaagatagtccactctgtgatgttcctgggttcgaaaacactaggatgaaacttttgagacatgtttctttcgttgattgcccgggtcatgacattcttatggctaccatgcttaatggagcggcaattatggatggagcactacttttgatagcggcaaatgaaagtttgcccacaccccagacatctgagcatcttgcagctgttgaaattatgcgtctc

SEQ ID NO: 48386 - protein, 173 aa, Panicum virgatum
  misc_feature: Ceres CLONE 2042689
  misc_feature (30)..(173): Pfam Name: GTP_EFTU Pfam Description: Elongation factor Tu GTP binding domain
  misc_feature: SWISSPROT Homolog: EC 2.1.1.43 Histone-lysine N-methyltransferase
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAANESLPTPQTSEHLAAVEIMR

SEQ ID NO: 48387 - DNA, 705 bp, Panicum virgatum
  misc_feature: Ceres CLONE 2042699
  misc_feature: Encodes the peptide sequence at SEQ ID NO. 48388
accaacacagcagcagagcagagcagccggcgccgggagctggcgaacagagcaaagcgccaggaagcacagagcgcaaagctcttttttgtttctccgcagctcactcccgttccccaacaagaatcacctctcgctcgtagcactactcgatcgatcgcgatggacgccatggagagaggcgagcgcgaggcgctcctgcccgagagccacgggccaagcatccaagaagatagcctgcaggtaccgctcctgaaggataaaaagcgcagccgcagcaaggcaccggcggttgttcttgggttcgaatgcctggagagcacagcgttcaatggcatcgcaacgaatctggtggtgtacctggagaccgttctccacagcagcagcctggcgagcgcgtccagcgtcacgacgtggatgggcaccagctacctaactccgatcttcggtgccatcgtcgccgacaccttctggggcaactacaataccatcctcgtctccctcgccgtctaccttctcgggatgatgctggtgaccttctcggcgttcctgccgacggccacggtgctcgccggctcgtcggtgtttggtgcacagaccgttgcgttcgccggattgtacctcgtcgcggtcgggtgcggcggggtgcgctcctcgctgctgccgttcggcgcggagcagttcgacgacgacaacgcggcggac

SEQ ID NO: 48388 - protein, 180 aa, Panicum virgatum
  misc_feature: Ceres CLONE 2042699
  misc_feature: Functional homolog of the protein sequence given in SEQ ID NO 51565
  misc_feature: Useful for making plants with modulated nitrogen use efficiency
MDAMERGEREALLPESHGPSIQEDSLQVPLLKDKKRSRSKAPAVVLGFECLESTAFNGIATNLVVYLETVLHSSSLASASSVTTWMGTSYLTPIFGAIVADTFWGNYNTILVSLAVYLLGMMLVTFSAFLPTATVLAGSSVFGAQTVAFAGLYLVAVGCGGVRSSLLPFGAEQFDDDNAA

SEQ ID NO: 48389 - DNA, 716 bp, Panicum virgatum
  misc_feature: Ceres CLONE 2042708
  misc_feature: Encodes the peptide sequence at SEQ ID NO. 48390
acccaacccgccgcctcggcctcggctccctcccaccccagctcccaccctccctccctcccaccgtctccctcgccgcgctcccccggcgctgccgccagatcccgctcgccggtggtggccccccgccgctcggcgccggagcaagggggcggaacacgcccaaaccctagtgattgtgattgagtgaccgcccgcccgcggcccgccgagatccggcggcgatgggggacttcaacctggcgctggtgatcgtggcggtggtggtcagcgtgctcgtgctgctcgtcagcgtctacctgctcgtcaactaccagcaccccgacgacgccaaccaggcctacttccccaagctcgtcgtcgtgctcggcctcaccgtcgccgtcctctccatcctcatgctccccgccgacgtcgccaaccgccaggcctgccggaaggccgtctacaacggcgcctgcagcctcacgctccccatgaagacgctctggctcgtcgtctacatcgtcgacgccgtcctcgtcttcctcgtcatacccttcgcgatgttctactacgagggcgaccaggacaagtctgtggggaagaggctcaggaccgcgctcatatgggtcgttgcgtccgcggtggtttgtggccttgtacttggcatcctatacggacttgttggtaaagtggacttcaccgtcaggcacctatcttcatcagtcgagacg

SEQ ID NO: 48390 - protein, 163 aa, Panicum virgatum
  misc_feature: Ceres CLONE 2042708
  misc_feature: Functional homolog of the protein sequence given in SEQ ID NO 51749
  misc_feature: Useful for making plants with altered cell wall content and/or composition
MGDFNLALVIVAVVVSVLVLLVSVYLLVNYQHPDDANQAYFPKLVVVLGLTVAVLSILMLPADVANRQACRKAVYNGACSLTLPMKTLWLVVYIVDAVLVFLVIPFAMFYYEGDQDKSVGKRLRTALIWVVASAVVCGLVLGILYGLVGKVDFTVRHLSSSVE

SEQ ID NO: 48391 - DNA, 483 bp, Panicum virgatum
  misc_feature: Ceres CLONE 2042711
  misc_feature: Encodes the peptide sequence at SEQ ID NO. 48392
accctagacggcgccggaccactcgtcgccctcctctcctccgcgagcgctcgcttcggaagcaagggattcgagatggccaagtctaagaaccacaccgcgctcaaccagtcgtacaaggcgcacaacaacggcatcaagaagcccaagcgccaccgccagacctccaccaaggggatggaccccaagttcctgacgaacctgaggtactcaacgaagaacaacaagaagagcggtgaggctgaagcggaggagtacgatggaagtttatgctcttacaaaagcaaagatgtgtttacccttcctagctccgttttacctttaggatttggattttctttaaggatggagtttgaatggtgttatgtatgaggggaaggaccctcttttgctgcttaagtgttactatgatattatgtgttaagctcatgctacctttgaatagtaaaaaaaaaaaacaacagcgaacaacaatccaaccac

SEQ ID NO: 48392 - protein, 98 aa, Panicum virgatum
  misc_feature: Ceres CLONE 2042711
  misc_feature (3)..(42): Pfam Name: Ribosomal_L29e Pfam Description: Ribosomal L29e protein family
MAKSKNHTALNQSYKAHNNGIKKPKRHRQTSTKGMDPKFLTNLRYSTKNNKKSGEAEAEEYDGSLCSYKSKDVFTLPSSVLPLGFGFSLRMEFEWCYV

SEQ ID NO: 48393 - DNA, 630 bp, Panicum virgatum
  misc_feature: Ceres CLONE 2042715
  misc_feature: Encodes the peptide sequence at SEQ ID NO. 48394
caatggacagtgtccgcactggaccctatgggcagatcttccgccctgacaactttgtgtttgggcaatctggagctggtaacaactgggctaagggccattacactgaaggtgctgagctcatcgactctgttctggatgttgtgaggaaggaagctgagaactgtgactgcttgcaaggaacttggcaaatgtgaggccctccacgcgcaaatatacgcgctatcggcgacttggcatcggcgtctccgcgactcggcgcacgcgaagcccggccgtcgccctccatctcccgcgcgcgcgaaggccgtcggcctccttctcccgcgcgcgccgtgcgcccgtcggcctccttctccttctctgctaggttcacgtatgtctcctgctcctcctgcccccccccccacccccactcccacccccacccgccgctggccatgctccatccggcgcggatcctcgccagtcttcctcgcacgtcagttttaatcctgctcggacacgcccccctacttcccctcaatccgggtaggccatggcgatccttgtagcaaccagaaccagcacctgcagtccacccaccgcacaggcgcagagaaggggcggtagtggccaggccgattcagg

SEQ ID NO: 48394 - protein, 64 aa, Panicum virgatum
  misc_feature: Ceres CLONE 2042715
  misc_feature: Functional homolog of the protein sequence given in SEQ ID NO 50258
  misc_feature: Useful for making plants with modulated flowering time
  misc_feature: Functional homolog of the protein sequence given in SEQ ID NO 50141
  misc_feature: Useful for making plants with altered cell wall content and/or composition
MDSVRTGPYGQIFRPDNFVFGQSGAGNNWAKGHYTEGAELIDSVLDVVRKEAENCDCLQGTWQM

SEQ ID NO: 48395 - DNA, 707 bp, Panicum virgatum
  misc_feature: Ceres CLONE 2042759
  misc_feature: Encodes the peptide sequence at SEQ ID NO. 48396
caatctgagtgtcgcttgtttcaaatacatcccttgcttcccctccccgcttcctcgtaccaaatctagggtttccgatcgaaatcttccgcctccgccgccaccgccggtgataatgtcggccagcgccgagctcgagaaggacgccgcggccgcggccgccgacggcgacgaggacgcggaggtgaagggcagcgcctccggctgggagctgctgtactgtggcgggacgagcttcgacaatatgggccggaaggtggtgggcggggggcagggcaacctggtgtccccgacgcgattgcggccgctgatgggcgtcgacatccgcttcgtcggctctggctgcactgcttgccactgtgttgctttggatgctgaaggcagatgttatacatggggtcgcaatgagaagggacagctagggcacggggatactcttctgcgtaacctgcctactgttgtttcacaactatcaaaatacaaaatcatcaaagcaagcgttggaagaaatcatacagtggttgtaactgatgatgggaaatccttctcttttggccacaataagcatgggcagttagggacgggctccttgcggaatggttggtacccttcacttcttactgtctctgattagtcacagaagtgcctgtacatatcttttctcgaacattgcaggagaactgcgcgtcatttcatttaagataggg

SEQ ID NO: 48396 - protein, 172 aa, Panicum virgatum
  misc_feature: Ceres CLONE 2042759
  misc_feature (88)..(137): Pfam Name: RCC1 Pfam Description: Regulator of chromosome condensation (RCC1)
  misc_feature: SWISSPROT Homolog: EC 2.7.11.1 Non-specific serine/threonine protein kinase
MSASAELEKDAAAAAADGDEDAEVKGSASGWELLYCGGTSFDNMGRKVVGGGQGNLVSPTRLRPLMGVDIRFVGSGCTACHCVALDAEGRCYTWGRNEKGQLGHGDTLLRNLPTVVSQLSKYKIIKASVGRNHTVVVTDDGKSFSFGHNKHGQLGTGSLRNGWYPSLLTVSD

SEQ ID NO: 48397 - DNA, 715 bp, Panicum virgatum
  misc_feature: Ceres CLONE 2042761
  misc_feature: Encodes the peptide sequence at SEQ ID NO. 48398
actacgtgcacccggcacgcccagcgcttgtgaccaacccgcccaccttccagtcctcccagtccaacacctcgcacgccctggtctgaaccctctccctcgccatcgccatggcgcgcaagaagatccgggagtacgactccaagcgcctcctcaaggagaacctcaagcgcctcgccggcatcgacctcaccatcctctccgcccaggtcacacaatcaacagacttcgcagagcttgtgagccagcagccatggctgtcaaccacaaagttggtcgtgaagcctgatatgctgtttgggaagcgtggcaagagtggcctggtggccctcaaccttgattttgatcaagtcaaggagttcgtcaaggagcgattgggagtcgaggttgagatgggtggctgcaaggctccaattacaaccttcattgttgagccatttgtgccccacgatcaagagtattacttatcgattgtgtcggagaggctgggcagcacaatcagcttctcagagtgtggagggattgagatcgaggagaactgggacaaggctaagacggtttttcttccaactgagaagccaatgacaccagatgcatgtgctcccttgattgctacccttccactggaggcacgcggaaaaattggtgacttcatcgaaggagtgtttgctgtattccaagacctggacttctcatttatggagatgaacccatt

SEQ ID NO: 48398 - protein, 201 aa, Panicum virgatum
  misc_feature: Ceres CLONE 2042761
  misc_feature (5)..(201): Pfam Name: ATP-grasp_2 Pfam Description: ATP-grasp domain
  misc_feature: SWISSPROT Homolog: EC 2.3.3.8 ATP citrate synthase
  misc_feature: Functional homolog of the protein sequence given in SEQ ID NO 50168
  misc_feature: Useful for making plants with modulated root development
MARKKIREYDSKRLLKENLKRLAGIDLTILSAQVTQSTDFAELVSQQPWLSTTKLVVKPDMLFGKRGKSGLVALNLDFDQVKEFVKERLGVEVEMGGCKAPITTFIVEPFVPHDQEYYLSIVSERLGSTISFSECGGIEIEENWDKAKTVFLPTEKPMTPDACAPLIATLPLEARGKIGDFIEGVFAVFQDLDFSFMEMNP

SEQ ID NO: 48399 - DNA, 681 bp, Panicum virgatum
  misc_feature: Ceres CLONE 2042789
  misc_feature: Encodes the peptide sequence at SEQ ID NO. 48400
acatgcagcgccgcccatttcgccccgcgccaccgaagctaagctagcagccatgtcggcgtcctcccccgcctcccgctcgctcctcctctgcctctgcctcagcctcgccctgctctcacccttcgccgccgcctcgcctcgcgacctccgcttctccgccgaggacatcgccccggtggaggcggcgctgccgcgccccaggaggtcgtcgaggaccaccttcttcgaggtcgaccgcccgctgcgcccgcccagggggagctcggggccctgctccacgctcctgctctcgcactccttcgccttcacgctcaccaagccgcccgtcaccgcggcgtactcgccgccgagctgcatgcgaggcggcgccggcgccgtctcgctcgcggtgctcgagtggcgcgccgagtgccgcggcgtgcagtacgaccgcgtcttcggcgtctggctcggcggcgccgagatcctgcgggggagcaccgcggagccgaagcccggcggcgtggcgtggtcggtgtccaaggacgtcacaaggtacgcgccgctcctcgccgccggcaacgccacgctcgccgtgtacctcggcaacctcatcgacgacacctacaacggcgtctaccacgccaacctcacgctccacctctacttccgccgcgccgcgcgcgcgcggtcgccggc

SEQ ID NO: 48400 - protein, 209 aa, Panicum virgatum
  misc_feature: Ceres CLONE 2042789
  misc_feature: SWISSPROT Homolog: EC 3.5.1.52 Peptide-N(4)-(N-acetyl-beta-glucosaminyl)asparagine amidase
MSASSPASRSLLLCLCLSLALLSPFAAASPRDLRFSAEDIAPVEAALPRPRRSSRTTFFEVDRPLRPPRGSSGPCSTLLLSHSFAFTLTKPPVTAAYSPPSCMRGGAGAVSLAVLEWRAECRGVQYDRVFGVWLGGAEILRGSTAEPKPGGVAWSVSKDVTRYAPLLAAGNATLAVYLGNLIDDTYNGVYHANLTLHLYFRRAARARSP

SEQ ID NO: 48401 - DNA, 711 bp, Panicum virgatum
  misc_feature: Ceres CLONE 2042796
  misc_feature: Encodes the peptide sequence at SEQ ID NO. 48402
tttcgtcctcgcctcgcatcgcctctctctctagctgcctctctctctagcccaccctcctctcctctcctcccccactcgcacagtgcccaatgccgcgcaaaccctagtgcccccactcccgatctcgcgcggcagccatgggcaactgctgccgctcgccggccgccgcggcgcgggaggacgtcaagtcgtcgcacttctcggcctccgccggcgggaagaagaagccccaccaggcgcggaacggcgccggggccggcgggggcggcggcgccggcggggagaagaagcggttgtcggttctcggggaggaggggtgcgacgtgggcgccgggatcgaggagaagtacgcgctggaccgggagctggggcgcggcgagttcggggtgacgtacctgtgcatggaccggggcacgcgggagctgctggcctgcaagtcgatctcgaagcggaagctgaggacgcccgtggacgtggaggacgtgcgccgggaggtggccatcatgcgtcacctgcccaagagccccagcatcgtgtcgctgcgggaggcgtgcgaggacgacggcgccgtgcacctcgtcatggagctctgcgagggtggggagctgttcgaccgcatcgtggccaggggccactacacggagcgcgcggcggctgcggtcacgcgcaccatcgtcgaggtcgtgcagctctgccaccggcatggcg

SEQ ID NO: 48402 - protein, 190 aa, Panicum virgatum
  misc_feature: Ceres CLONE 2042796
  misc_feature (71)..(190): Pfam Name: Pkinase Pfam Description: Protein kinase domain
  misc_feature: SWISSPROT Homolog: EC 2.7.11.1 Non-specific serine/threonine protein kinase
MGNCCRSPAAAAREDVKSSHFSASAGGKKKPHQARNGAGAGGGGGAGGEKKRLSVLGEEGCDVGAGIEEKYALDRELGRGEFGVTYLCMDRGTRELLACKSISKRKLRTPVDVEDVRREVAIMRHLPKSPSIVSLREACEDDGAVHLVMELCEGGELFDRIVARGHYTERAAAAVTRTIVEVVQLCHRHG

SEQ ID NO: 48403 - DNA, 688 bp, Panicum virgatum
  misc_feature: Ceres CLONE 2042797
  misc_feature: Encodes the peptide sequence at SEQ ID NO. 48404
atacacgtgtgcaccacttggcagtttggccgacatgacgaggctctcagcaaaaactcttttgcttttgtttcttctccatttctcgcttcagtcgccatggtcgcacggcctccagccgggggaacctgaagcaagaaaaatctacattgtttacctcggggaaagacggcatgaagatcctgagcttgtcactgaatcgcaccacgacatgctcgcttccgttctcggaagcaaggaggacgctctgagttcgattgtgtacagctacaaacacggtttctctggctttgctgcaaggatgactgaatcgcaagcaagaaagatacgaggcatgcctggcgtggtgagtgtaagagagaaccaaatccggcgagtgcacaccactcggagctgggatttccttggactggactacaagcaaccaaatgggctgcttgccaaatctagctttggggatggcattattattggtgtccttgactcaggtatcacacctgagtctccgagcttctcggatgctgggtacggcccccctccttccaaatggaaggggatctgccaggccggcccttcgttccccgctagcagctgcaaccggaagctcatcggcgcgcggtggtacgccgacgacctcgacgacgagacgcgtgctcaggaggttctctctgcccgggacatccacggg

SEQ ID NO: 48404 - protein, 217 aa, Panicum virgatum
  misc_feature: Ceres CLONE 2042797
  misc_feature (36)..(116): Pfam Name: Subtilisin_N Pfam Description: Subtilisin N-terminal Region
  misc_feature: SWISSPROT Homolog: EC 3.4.21.25 Cucumisin
MTRLSAKTLLLLFLLHFSLQSPWSHGLQPGEPEARKIYIVYLGERRHEDPELVTESHHDMLASVLGSKEDALSSIVYSYKHGFSGFAARMTESQARKIRGMPGVVSVRENQIRRVHTTRSWDFLGLDYKQPNGLLAKSSFGDGIIIGVLDSGITPESPSFSDAGYGPPPSKWKGICQAGPSFPASSCNRKLIGARWYADDLDDETRAQEVLSARDIH

SEQ ID NO: 48405 - DNA, 713 bp, Panicum virgatum
  misc_feature: Ceres CLONE 2042799
  misc_feature: Encodes the peptide sequence at SEQ ID NO. 48406
gacatcaggcagctgcaggctagttagggttggtgcttggagagaggtacccctttcctcccttgcatatcaagccttgagatcacacccctcaactttttgatcccctaaacacaaagttagtagtccttggttggtgggtacagatcaaggagaggaggggagcagaaagaaagatggatcagctctagctagaggaggaaggagatcgaggcacttcttagctgcttttgaagtagctagatttacacctccatacatagcgagccagcgccgaggatcttgaacagatgtctcaggctatgtcgggtggcaccggcggcggcgcagggcagttcggggacacgacgctcaccaaggtgttcgtggggggccttgcctgggagacgcacaaggagggcatgcgggcctacttcgagcagttcggcgatatccttgaggcggtcgtcatcactgacaagaacaccggtagatccaagggatacggatttgtaacgttccgcgagccagaggcagcactgagagcttgcatcgatccgtacccggtaatcgatggaaggagggccaactgcaaccttgcctatctcggtgtcaacaagtccaagactgcaccggtgccgccatatctgcaaccatatgctcatgtttacgggggaggcaacaacatgcgggcaatgaagtccatccagacagctggtgctggtgccagcttg

SEQ ID NO: 48406 - protein, 140 aa, Panicum virgatum
  misc_feature: Ceres CLONE 2042799
  misc_feature (24)..(94): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSQAMSGGTGGGAGQFGDTTLTKVFVGGLAWETHKEGMRAYFEQFGDILEAVVITDKNTGRSKGYGFVTFREPEAALRACIDPYPVIDGRRANCNLAYLGVNKSKTAPVPPYLQPYAHVYGGGNNMRAMKSIQTAGAGAS

SEQ ID NO: 48407 - DNA, 725 bp, Panicum virgatum
  misc_feature: Ceres CLONE 2042818
  misc_feature: Encodes the peptide sequence at SEQ ID NO. 48408
ctggccccctttccttctggcgcacaccctctccagtcccctccagcctccggcctctcccgcgcgccgccggcgaccgccggatctcaaccgccggatccagatgttagtggcagaggtgctcagggaaggaccatacatctctaggttttctcgacatgcatgcaaagttgcgagaggttgttcagtttcacaatttaaaaaacctcaatttctggacgtgctcagcaaaataagttctttccgctgtagtcaattccgactggtagcaatggcaacagctccagccaatggtgattcgcagagtggccctcagcggaactatcaggttgttgttgctgccactcgtgacttaggcattgggaaggatgggatcttgccatggaagcttcttggtgaccttaagttcttcaaggatcttactctttcaacatttgaccctgccaagaagaatgcagttataatgggaaggaagacatgggagagcattcctgttaagttgaggccattgcctggtcgtttgaatgtcatactcactcgatctggtagttttgattttgcaacagtagaaaatgttgttatctgcggaagcatgaagtctgccttagaactgctagcatcaactccatattgcttatcaattgagaaagtttttgttatagggggtgggcaggtactgagggagtatcttaatggacctgcatgtgaggccatccatctaactg

SEQ ID NO: 48408 - protein, 151 aa, Panicum virgatum
  misc_feature: Ceres CLONE 2042818
  misc_feature (17)..(151): Pfam Name: DHFR_1 Pfam Description: Dihydrofolate reductase
  misc_feature: SWISSPROT Homolog: EC 1.5.1.3 Dihydrofolate reductase
MATAPANGDSQSGPQRNYQVVVAATRDLGIGKDGILPWKLLGDLKFFKDLTLSTFDPAKKNAVIMGRKTWESIPVKLRPLPGRLNVILTRSGSFDFATVENVVICGSMKSALELLASTPYCLSIEKVFVIGGGQVLREYLNGPACEAIHLT

SEQ ID NO: 48409 - DNA, 647 bp, Panicum virgatum
  misc_feature: Ceres CLONE 2042859
  misc_feature: Encodes the peptide sequence at SEQ ID NO. 48410
atatcacactgattgctgaagatgagttcctccacgtccagcgctctggtgctagcagcagcagtgctcctagcagcactgaccgtagcacagcatggctccctcgccgcagccgccggccccagggtcatcatcgtcggcgccggcatgtccgggatctcggctgctaagacgctgtcggaggccgggataaccgacctgctgattctggaagcaacggaccgcatcggcggccggatgcacaagaagaacttctccggcatcaacgtcgagatcggcgccaactgggtggagggcgtcaacggcggcaagatgaaccccatctggcccatcgtcaacgaaacgctcaagctccgcaacttcctcaccgactttagtgtcgccacaaacatctacaaggaggattcgcaacacatagctcgagagaccgcctcgcgtcgcctcctgtgaggcggctcgggggtcggggcgacgcactccgccgtcgaggcggcccgtctgctccttggccgccgccgctgctctccggcgagcggtggcggcggtggcgctcaaaaaggctgccatggtatccttcctttcccatccctctgctatctcgccggccctccccaagctcctcctcctgcagccgttggtttgtgccc

SEQ ID NO: 48410 - protein, 100 aa, Panicum virgatum; identical to SEQ ID NO: 29217
  misc_feature: Ceres CLONE 2042859
  misc_feature: SWISSPROT Homolog: EC 1.5.3.11 Polyamine oxidase

SEQ ID NO: 48411 - DNA, 512 bp, Panicum virgatum
  misc_feature: Ceres CLONE 2042875
  misc_feature: Encodes the peptide sequence at SEQ ID NO. 48412
aaaaactctgcttctcgatttcaaaaaaaaaaaaaaactctgcttctcggcagcaatgccggagcctctatcctcttcggcggcgagcgggggcggcggtcgccttaggaacgccttcggcggagtgctgtgcgccttcaccctcctcctcatcggcgtcatcgcattttcgatccgcctcttctcagtgatcaagtacgagagcgttatccacgagttcgatccctacttcaactaccgcgtcactcagtttttgtcaaagaatggaatctatgaattctggaactggtttgatgaccgaacatggtatcctctggggcgtgttattggcggcacagtctatcctggtttgacactaactgctggcacaatatggtggttgctaaactcccttaaattccctttgactgtggagaccgcctgtgtgtgtgccactccattctgctctgccaaggctgcctgcgcaacttactcttcacttgaggaagcgaaggcctcatgggctggtttga

SEQ ID NO: 48412 - protein, 152 aa, Panicum virgatum
  misc_feature: Ceres CLONE 2042875
  misc_feature: SWISSPROT Homolog: EC 2.4.1.119 Dolichyl-diphosphooligosaccharide--protein glycotransferase
  misc_feature: Functional homolog of the protein sequence given in SEQ ID NO 51470
  misc_feature: Useful for making plants with altered carbohydrate content
MPEPLSSSAASGGGGRLRNAFGGVLCAFTLLLIGVIAFSIRLFSVIKYESVIHEFDPYFNYRVTQFLSKNGIYEFWNWFDDRTWYPLGRVIGGTVYPGLTLTAGTIWWLLNSLKFPLTVETACVCATPFCSAKAACATYSSLEEAKASWAGL

SEQ ID NO: 48413 - DNA, 619 bp, Panicum virgatum
  misc_feature: Ceres CLONE 2042943
  misc_feature: Encodes the peptide sequence at SEQ ID NO. 48414
cccttccccctctctcgcggagccgccgcaaccagcgcaagtctaaccctagatccggaccgctctccggtgatctccggtcatggcgtcccgccgggtcgtctcctccctcctccgctccccctcccgcttcagggcggcctcacccgccgtgccgcgcccgcgcgcgccgccgcaccgcccgtccccggcagggtacctcttcgaccgcgccgccgcctacgcctcgtctgccgcggcccacgagaagcccgtcacctcgccgccttgccctgggaagaccgggggcggcaagatcaccgacgagttcaccggcgccggcgccttcgggcaggtgtgccatgtcatccgcgccgtcgtctacgcgcgcttcgatgagggcctcccgcccatcctcaccgcgctcgatgttcttgactacaccgtcctcctcgtgctagaggtggcgcagcaccttggcgagaacatggtgcgcaccatcgctatggatgggactgacgggctcgtccgcggccctcgcgtcctctacaccggctcccccatcaccgtgcctgttggcagggcgacacttgaacgcattatgaatgttattggtgagccaattgatgagaacggtgac

SEQ ID NO: 48414 - protein, 178 aa, Panicum virgatum
  misc_feature: Ceres CLONE 2042943
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSPSRFRAASPAVPRPRAPPHRPSPAGYLFDRAAAYASSAAAHEKPVTSPPCPGKTGGGKITDEFTGAGAFGQVCHVIRAVVYARFDEGLPPILTALDVLDYTVLLVLEVAQHLGENMVRTIAMDGTDGLVRGPRVLYTGSPITVPVGRATLERIMNVIGEPIDENG

SEQ ID NO: 48415 - DNA, 682 bp, Panicum virgatum
  misc_feature: Ceres CLONE 2042978
  misc_feature: Encodes the peptide sequence at SEQ ID NO. 48416
gagggtgagagaggatgccggcggagctcggctccgacgcctgatctttccgtcgattgaccaggcagcgggtggcggtggtgcatttctgggatgggactgctgttcgtggagcggctcgagggggagggcgtgttcaggtgccggcgctgccgcgtggacgccgcctccaaggacgccatcatctccagggacttctacggccgcaccggccgcgcctacctcttcgaccacgtgtatgttctctgccgcctcccatttagctttgctagctctcgcggcaacggtggccgctggccggttggaattcggctggtagtgcagctgtactgcaaatagaatgtgccggtttcagattaatctatgtcagaattgaagcgagattatagaactctgttcatgttacattggaaaccatggtcatcacaggttctccaatgctagaaatgctgctgcgaataccacgaacgaattttggcttcctcgtcgaactatagcatgcctatgatacgcctgtaaataagttcgaagtttggctaccatgttggagcctttttcagagttgacaatggcttaatccattccttgttacgtgtacttctctgtgatctttgaggtcccgagtcccgacagatatgcacgcttgaccagtcatcagactgtatgtactcctataacttgc

SEQ ID NO: 48416 - protein, 81 aa, Panicum virgatum
  misc_feature: Ceres CLONE 2042978
  misc_feature (1)..(78): Pfam Name: Yippee Pfam Description: Yippee putative zinc-binding protein
MGLLFVERLEGEGVFRCRRCRVDAASKDAIISRDFYGRTGRAYLFDHVYVLCRLPFSFASSRGNGGRWPVGIRLVVQLYCK

SEQ ID NO: 48417 - DNA, 670 bp, Panicum virgatum
  misc_feature: Ceres CLONE 2042980
  misc_feature: Encodes the peptide sequence at SEQ ID NO. 48418
actcttcagctctcttccccttccatcactctccacacccacccccaaggccccaactccccaagcgctcgctatggcagcacccacgggagcttgcggctccaactccccttcttcaacgtgctagcgttcttagctggtgactatggcggcggtggcgagcagggagaggctctccccgggcgccgcgccgcaggtggacacgggcaagtacgtgcggtacacaccggagcaggtggaggcgctggagcgcgtctacagcgagtgccccaagcccagctcgctgcgccggcagcagctcatcagggactgccccatcctcagcaacatcgagcccaagcagatcaaggtctggttccagaaccgcagatgccgggagaagcagcgcaaggaggcctctcgcctgcaaactgtgaatcggaagctgagtgcaatgaataagctgttgatggaggagaatgaccggctgcagaaacaggtgtcccgtctcgtctatgacaacgggtacatgaagaatcaacttcacagtccttctgtagccaccacagacacaagctgtgagtctgtggtgacaagtagtcagcactaccaacagcaaaacccagcagttccgcctcctccaaaaagggacgcgaacaacccagcaggtctactcgctatcgctgaagag

SEQ ID NO: 48418 - protein, 174 aa, Panicum virgatum
  misc_feature: Ceres CLONE 2042980
  misc_feature (22)..(80): Pfam Name: Homeobox Pfam Description: Homeobox domain
  misc_feature: Functional homolog of the protein sequence given in SEQ ID NO 50330
  misc_feature: Useful for making plants with altered carbohydrate content
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
MAAVASRERLSPGAAPQVDTGKYVRYTPEQVEALERVYSECPKPSSLRRQQLIRDCPILSNIEPKQIKVWFQNRRCREKQRKEASRLQTVNRKLSAMNKLLMEENDRLQKQVSRLVYDNGYMKNQLHSPSVATTDTSCESVVTSSQHYQQQNPAVPPPPKRDANNPAGLLAIAE

SEQ ID NO: 48419 - DNA, 444 bp, Panicum virgatum
  misc_feature: Ceres CLONE 2042999
  misc_feature: Encodes the peptide sequence at SEQ ID NO. 48420
acgccgggtctcttgtcccggcgctgagctggcctctgccgccgtgctaatttccagtgcacgcgcgcacacgcacaatttcatcatcatcaagattgaaaccatccctgcaacacggggataaatcggtcggattccgaggagcgcagtaaacaaaggggtgctcttcccttccgactcctatcgttttcgttagggggaaggagagcattgctgcgcggggatgaggaagaggagcggaggccgtggtgggacggtgggcgtgccatggctactgccgctcctcggatgctgctgctgcatcagacggatcttcgctgctgccgacacagaccccaacgatcttgctgtcatcaatacactctttactagtctgaattctcctgggccgctcagtggtcggcaggcaaatggtggtgatccctgaggccggccatggaaggg

SEQ ID NO: 48420 - protein, 67 aa, Panicum virgatum
  misc_feature: Ceres CLONE 2042999
  misc_feature: Functional homolog of the protein sequence given in SEQ ID NO 50266
  misc_feature: Useful for making plants with altered cell wall content and/or composition
MRKRSGGRGGTVGVPWLLPLLGCCCCIRRIFAAADTDPNDLAVINTLFTSLNSPGPLSGRQANGGDP

SEQ ID NO: 48421 - DNA, 688 bp, Panicum virgatum
  misc_feature: Ceres CLONE 2043084
  misc_feature: Encodes the peptide sequence at SEQ ID NO. 48422
agggttcatactgcaacgacttctcccctgctgcaaagccgccggagctccgcccctgccctgccctgcccggtgagatcccttctagagacgggaatacggtttacgagtgcgacaggagtacaggagtgaagaaggagcaagggaagcgctccccgatccatttggatttgctccggccagcggcgggatgtcgttcctcttccgaggcgggtcgcggcagcgctcgtcgccgcaggagatcgtccgctccatcaaggactctctcgttgccctcgacaccaagaccggcgccaaggctctcgatgatgctgagaaaaacatacttacgttgaggcatatgctttctggtgatggagaagtagaaccaaatcaagagcaggttttgcagatagccattgagatttgcaaggagggtgttctttccctctttgttcagaatcttccttccttgggttgggagggtagaaaggatcttgttcactgctggtctattttgttgagacagaaggttgatgaaagctattgctgcgtgcagtatattgaaaatcatgttgaccttttggatttccttgttgtttggtaaggcctgtatttctcaagttatgaattggaacaacaaccaatctgagaatactgattcgtatcttggggggcaatgcaccgcgtgaaatatgtagatgtccta

SEQ ID NO: 48422 - protein, 131 aa, Panicum virgatum
  misc_feature: Ceres CLONE 2043084
  misc_feature (1)..(131): Pfam Name: Mo25 Pfam Description: Mo25-like
MSFLFRGGSRQRSSPQEIVRSIKDSLVALDTKTGAKALDDAEKNILTLRHMLSGDGEVEPNQEQVLQIAIEICKEGVLSLFVQNLPSLGWEGRKDLVHCWSILLRQKVDESYCCVQYIENHVDLLDFLVVW

SEQ ID NO: 48423 - DNA, 729 bp, Panicum virgatum
  misc_feature: Ceres CLONE 2043137
  misc_feature: Encodes the peptide sequence at SEQ ID NO. 48424
acgcctcggctccaagccggccagccaaccaaccgccccgggcagcaaagcacaggcgcacgagctcccacagctccccagctccacgcctcctccctcccgctcccgccatcctctcctccgccgcgcgccttcccgcccgccgagcctttggggtggttccggagtcgcggccgcgcgcgcgagagcgagaccctcccctgctgccgagcatctgccgagctcggcatggggtgaccagatcggggcgcggctcggtgctctacggctgaattccgctcgaggagggggggtttgccttgcctagaagaggccgcggggatggcgaacgccggcgtggccgtcggctcagggggtattagccatgctttgttcagggaactctggcatgcttgtgctgggccgttggtcacagtgcctcgccaaggcgagctggtttactacttcccgcaaggtcatatggaacagcttgaagcatctacagatcagcaacttgaccagcacttacctttgtttaatctaccatccaagatcctgtgcaaggtggtaaatgtagaactcagagctgaaactgattccgatgaagtttatgctcaaattatgctgcaaccagaagcagatgtgagtaggctcacctatcaaagtgagcccaccagcccagctcctgagctaccagagccagaaaggtgcaatgtccattccttctgcaagactttgactgcttcagac

SEQ ID NO: 48424 - protein, 135 aa, Panicum virgatum
  misc_feature: Ceres CLONE 2043137
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 300 in the 10/412,699 US patent application
MANAGVAVGSGGISHALFRELWHACAGPLVTVPRQGELVYYFPQGHMEQLEASTDQQLDQHLPLFNLPSKILCKVVNVELRAETDSDEVYAQIMLQPEADVSRLTYQSEPTSPAPELPEPERCNVHSFCKTLTAS

SEQ ID NO: 48425 - DNA, 692 bp, Panicum virgatum
  misc_feature: Ceres CLONE 2043158
  misc_feature: Encodes the peptide sequence at SEQ ID NO. 48426
cactgaaatctcctatctacaaccatacagttgctcaattctggtctcagctgcagcccaatcattcatcggtatataagtcactacaccctctgcatttcccacccctttagccatcatcaatccttgaagaagcttcgtgctacctgaggtgttcactgtgcacaattggaggctgtatacatccacagacctgtcagctccgctaatttggagctcccaggttctgcattgcactgagatggggaggcattcttgctgctacaagcaaaagttgagaaagggactctggtctcctgaggaggatgagaagctcatgaatcacataacaaagcatggccatggctgctggagttctgttcccaaactcgcagggctccaaaggtgcggaaagagttgcaggctgagatggataaactatctgagaccagacctcaagagaggggcattctctcaagaggaagaagacctcatcattgagctgcatgctgtccttgggaacaggtggtctcaaattgcagcacagctgcctggaaggactgacaacgagatcaagaatctatggaactcatgcatcaagaagaagctgaggcagaaaggcattgatcccaacacccacaagccgcttgctgaggctgatcgcagtggtgcagctcccaccatcagcaccgagaggacctcagggtccagcg

SEQ ID NO: 48426 - protein, 150 aa, Panicum virgatum
  misc_feature: Ceres CLONE 2043158
  misc_feature (14)..(61): Pfam Name: Myb_DNA-binding Pfam Description: Myb-like DNA-binding domain
  misc_feature (67)..(112): Pfam Name: Myb_DNA-binding Pfam Description: Myb-like DNA-binding domain
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: Functional homolog of the protein sequence given in SEQ ID NO 50235
  misc_feature: Useful for biocontainment applications
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 824 in the 10/412,699 US patent application
  misc_feature: Functional homolog of the protein sequence given in SEQ ID NO 50236
  misc_feature: Useful for making plants with modulated biomass
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: Functional homolog of the protein sequence given in SEQ ID NO 50478
  misc_feature: Useful for making plants with altered lignin content
  misc_feature: The sequence is a functional homolog of SEQ ID NO 1917 in the 10/374,780 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: Functional homolog of the protein sequence given in SEQ ID NO 50232
  misc_feature: Useful for making plants with altered alkaloid content
  misc_feature: Useful for making plants with modulated nitrogen use efficiency
  misc_feature: The sequence is a functional homolog of SEQ ID NO 442 in the 10/412,699 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1073 in the 10/374,780 US patent application
  misc_feature: The sequence is a functional homolog of SEQ ID NO 1004 in the 11/435,388 US patent application
  misc_feature: The sequence is a functional homolog of SEQ ID NO 1002 in the 11/435,388 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Functional homolog of the protein sequence given in SEQ ID NO 50234
  misc_feature: Useful for making plants with altered cell wall content and/or composition
  misc_feature: The sequence is a functional homolog of SEQ ID NO 1010 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: Functional homolog of the protein sequence given in SEQ ID NO 50233
  misc_feature: Useful for making plants with altered carbohydrate content
  misc_feature: The sequence is a functional homolog of SEQ ID NO 296 in the 11/479,226 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 58 in the 10/666,642 US patent application
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 836 in the 10/412,699 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: The sequence is a functional homolog of SEQ ID NO 271 in the 11/479,226 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 569 in the 10/374,780 US patent application
  misc_feature: Functional homolog of the protein sequence given in SEQ ID NO 50479
  misc_feature: Useful for making plants with altered terpenoid content
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 822 in the 10/412,699 US patent application
  misc_feature: The sequence is a functional homolog of SEQ ID NO 1681 in the 10/374,780 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: Functional homolog of the protein sequence given in SEQ ID NO 50480
  misc_feature: Useful for making plants with modulated low light sensitivity
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 794 in the 11/435,388 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 790 in the 11/435,388 US patent application
  misc_feature: The sequence is a functional homolog of SEQ ID NO 743 in the 10/666,642 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 796 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 446 in the 10/412,699 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 36 in US patent 7193132
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 1572 in the 10/374,780 US patent application
  misc_feature: Functional homolog of the protein sequence given in SEQ ID NO 50239
  misc_feature: Useful for making plants with modulated flowering time
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 2178 in the 10/374,780 US patent application
  misc_feature: The sequence is a functional homolog of SEQ ID NO 186 in the 10/412,699 US patent application
  misc_feature: The sequence is a functional homolog of SEQ ID NO 126 in the 10/412,699 US patent application
  misc_feature: The sequence is a functional homolog of SEQ ID NO 1566 in the 10/374,780 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: Functional homolog of the protein sequence given in SEQ ID NO 50240
  misc_feature: Useful for making plants with modulated drought sensitivity
  misc_feature: The sequence is a functional homolog of SEQ ID NO 1692 in the 11/479,226 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 1563 in the 10/374,780 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1564 in the 10/374,780 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 1565 in the 10/374,780 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 1054 in the 10/225,066 US patent application
  misc_feature: The sequence is a functional homolog of SEQ ID NO 144 in the 10/412,699 US patent application
  misc_feature: The sequence is a functional homolog of SEQ ID NO 2264 in the 10/374,780 US patent application
  misc_feature: The sequence is a functional homolog of SEQ ID NO 912 in the 11/435,388 US patent application
  misc_feature: The sequence is a functional homolog of SEQ ID NO 132 in the 10/412,699 US patent application
  misc_feature: The sequence is a functional homolog of SEQ ID NO 1968 in the 10/374,780 US patent application
  misc_feature: The sequence is a functional homolog of SEQ ID NO 309 in the 11/479,226 US patent application
  misc_feature: The sequence is a functional homolog of SEQ ID NO 582 in the 11/435,388 US patent application
MGRHSCCYKQKLRKGLWSPEEDEKLMNHITKHGHGCWSSVPKLAGLQRCGKSCRLRWINYLRPDLKRGAFSQEEEDLIIELHAVLGNRWSQIAAQLPGRTDNEIKNLWNSCIKKKLRQKGIDPNTHKPLAEADRSGAAPTISTERTSGSS

SEQ ID NO: 48427 - DNA, 729 bp, Panicum virgatum
  misc_feature: Ceres CLONE 2043188
  misc_feature: Encodes the peptide sequence at SEQ ID NO. 48428
agtcccactagcccgggcagtccaaattcatccctctctgctcccaaatatcctcttccccctcgtgccaagaccggactcacagcctggattgctccatctctccccaattgcagaggagaagagaagacgccatggcccatggcagagggaggtgggttttgctgccttgattagcttcttctctactagtctccatctctctgtccgcaatcgccatccgagaaaggaaagggagtggaggaggatccagccgcgccgaatcgccggaaagatgcggccttcggggcaaaagcgcggggaccttgctctcctttgctgctccgtcgcgctcctcctcccgctgctgtcccatggcgcggacatgccgctggggtcgaccctctcgccggggaactcgacgtcgtggacgtcgcccaacaacaccttctcgctctccttcacgccgtccccgacctccccgtcgctcttcgtcgccgccatcacctacgccggcggcgtccccgtctggtccgcgggcaacggcgcgggcgttggctccgggggctcgctcatcctctcgtccaacggcaacctccagctcgtcaacggatctgggggcgtcctctggtcgtccaacaccggcggccagggcgtgaccgccgcggccgtccaggagagcggcaacctggtgctcaagaactcgacgaccaccctgtggcagtcgttcgaccaccccacggacacggg

SEQ ID NO: 48428 - protein, 151 aa, Panicum virgatum
  misc_feature: Ceres CLONE 2043188
  misc_feature (74)..(151): Pfam Name: B_lectin Pfam Description: D-mannose binding lectin
MRPSGQKRGDLALLCCSVALLLPLLSHGADMPLGSTLSPGNSTSWTSPNNTFSLSFTPSPTSPSLFVAAITYAGGVPVWSAGNGAGVGSGGSLILSSNGNLQLVNGSGGVLWSSNTGGQGVTAAAVQESGNLVLKNSTTTLWQSFDHPTDT

SEQ ID NO: 48429 - DNA, 482 bp, Panicum virgatum
  misc_feature: Ceres CLONE 2043217
  misc_feature: Encodes the peptide sequence at SEQ ID NO. 48430
aaaactcccccctcacaactccgctccctctgctttcccctgcgccggggccgcacgagcggcttcatcttacgatggggaacccgcccgagctgtaccacaatatcctcaacatccccaaggacacctcgccgcatgaaatccacgccgcgaacaagaacctcgtaaagaaatggcaccccaacaaacacccgccgtcgtccaagcccgaggccaacgcgcgcttaaaggccatcagcgaggcctacaaggcgctcctaaaccagcaagagaacagggcggtgttcaggctgtgcaatgacggccgggccggcgaaagggacgacggccgcagcctcaggacgcgcatggagaggacgcacatcaactacttgagcatgaggagcgcgcccggcacgccggcgagagagttcaagaaggagtacatctcctgcaacacgggcgggcggcgcgccttcgccgagttctccagctccatcatg

SEQ ID NO: 48430 - protein, 135 aa, Panicum virgatum
  misc_feature: Ceres CLONE 2043217
  misc_feature (7)..(72): Pfam Name: DnaJ Pfam Description: DnaJ domain
MGNPPELYHNILNIPKDTSPHEIHAANKNLVKKWHPNKHPPSSKPEANARLKAISEAYKALLNQQENRAVFRLCNDGRAGERDDGRSLRTRMERTHINYLSMRSAPGTPAREFKKEYISCNTGGRRAFAEFSSSI

SEQ ID NO: 48431 - DNA, 459 bp, Panicum virgatum
  misc_feature: Ceres CLONE 2043229
  misc_feature: Encodes the peptide sequence at SEQ ID NO. 48432
ctcttctctctctctctctcctctacccccttttcctctaacctttagctttcctccctccctccctccctccttcggtccttccctctcctctcctcaacactcctctcctcttccattcctctaactagtcctagccattcagatcctaagttgctggccttgctgcttcttgttggagaaagatttgttggttccaagttggaagtatcatgagtccaccgagtgtgatggggcaatttggagacacaacctataccaaggttttcgttgggggactcgcatgggaaacccagaaggagaccatgaggaagtacttcgagcagtttggggagatcctggaggccgttgtcatcacagacaagaataccggcagatccaagggctacggatttgttaccttccgggacccggatgcggcgatgagagcttgtgttgatcctgcgccggttatagacg

SEQ ID NO: 48432 - protein, 76 aa, Panicum virgatum
  misc_feature: Ceres CLONE 2043229
  misc_feature (12)..(74): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50671
  misc_feature: Useful for making plants with modulated biomass
  misc_feature: Functional homolog of the protein sequence given in SEQ ID NO 50183
  misc_feature: Useful for making plants with altered alkaloid content
MGQFGDTTYTKVFVGGLAWETQKETMRKYFEQFGEILEAVVITDKNTGRSKGYGFVTFRDPDAAMRACVDPAPVID

SEQ ID NO: 48433 - DNA, 648 bp, Panicum virgatum
  misc_feature: Ceres CLONE 2043256
  misc_feature: Encodes the peptide sequence at SEQ ID NO. 48434
ctcattcgtcatcccacccatcccacctccaccacggccgctccagagtcagctgatggcccgactgccactcccactcccagctatgctccctctcctccttgctgtcctctcagtcgcaacggcggcggcctcctcgcgcccccacccgctcgacccgctctcccccgccgagatcacggccgtgcgcgccgcggtgctagcctcctctctcgtccccgcccgcccgctcaccttccactacgtcggcctagacgagccggacaagcccgacgtcgtcgcctacgcctacggcggcggcaccgcccggcgccgcgcgcgccgtcggcccctccagcggcgcgccctcgtgatcgcccgcgcgcgcggccaatcccacgagctccgcgtggaggtcgcccgcaacggctcctccgccgccgccgtgcgctcccacaccgtgcaccgcggcgcgggcttcccgacgctcacgctcgaggagcagttcgcggcggtggcgctgccgccggcgtacccgccgttcgtggactccgtgcggcgccgcggggtggacatggccgacgtgctctgcgcggtgttcccgtcggctggttcggcgacgccggggcgccgaggcgggtggccaagatgctgtgcttcgtggccggg

SEQ ID NO: 48434 - protein, 187 aa, Panicum virgatum
  misc_feature: Ceres CLONE 2043256
  misc_feature (21)..(116): Pfam Name: Cu_amine_oxidN2 Pfam Description: Copper amine oxidase, N2 domain
  misc_feature: SWISSPROT Homolog: EC 1.4.3.6 Amine oxidase (copper-containing)
MLPLLLAVLSVATAAASSRPHPLDPLSPAEITAVRAAVLASSLVPARPLTFHYVGLDEPDKPDVVAYAYGGGTARRRARRRPLQRRALVIARARGQSHELRVEVARNGSSAAAVRSHTVHRGAGFPTLTLEEQFAAVALPPAYPPFVDSVRRRGVDMADVLCAVFPSAGSATPGRRGGWPRCCASWP

SEQ ID NO: 48435 - DNA, 557 bp, Panicum virgatum
  misc_feature: Ceres CLONE 2043258
  misc_feature: Encodes the peptide sequence at SEQ ID NO. 48436
attcaccatggccgcggcgccgcctcctcttgtcgccgggcgcaccctgctcgccgccttcctggcggcctccctcctggcctccgcggccaatgcggccgtctcgtacgaccaccgctccctcctcatcaacggccgccgcagcatcctcatctccggctccatccactaccccaggagcacgcccgagatgtggcccgggctgatccagaaggccaaggacggcggcctcgacgtcatccagacctacgtcttctggaacggccacgagccggcgcaggggcagtaccacttcgccgaccgctacgacctcgtccgcttcgtcaagctcgtcaagcaggctggcctctacgtccacctccgcatcggcccctacgtctgcgccgaatggaacttcggtggctttcctgtttggctcaagtatgtgcctggcatcaggttcaggacggacaatgggcccttcaaggccgcaatgcagaagttcgtcgagaagatagtgtcgatgatgaagtccgaggggctattcgagtggcagggaggcccaatcatcatggctc

SEQ ID NO: 48436 - protein, 183 aa, Panicum virgatum
  misc_feature: Ceres CLONE 2043258
  misc_feature (38)..(183): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51152
  misc_feature: Useful for making plants with altered carbohydrate content
  misc_feature: Functional homolog of the protein sequence given in SEQ ID NO 51324
  misc_feature: Useful for making plants with altered cell wall content and/or composition
MAAAPPPLVAGRTLLAAFLAASLLASAANAAVSYDHRSLLINGRRSILISGSIHYPRSTPEMWPGLIQKAKDGGLDVIQTYVFWNGHEPAQGQYHFADRYDLVRFVKLVKQAGLYVHLRIGPYVCAEWNFGGFPVWLKYVPGIRFRTDNGPFKAAMQKFVEKIVSMMKSEGLFEWQGGPIIMA

SEQ ID NO: 48437 - DNA, 671 bp, Panicum virgatum
  misc_feature: Ceres CLONE 2043272
  misc_feature: Encodes the peptide sequence at SEQ ID NO. 48438
actccaccccactccaccactctcttctcccctcgtccccacctaaaacctcacgcaccccaccccgcgccgccgccgggtgccgcgatgaccgccgctcctctcgacctcgggggtgggcggggcctccggcggctgcctcctctcctcctcctcccgctcctcctcgccgcgctcgcgcccccggcggcgtcgcagctgccggccaccccgcggctgcaggcggcgtacgcggcgctgcagtcgtggaagcgcacggccatcttctccgaccccttcaacttcaccgccaactgggtgggccccaacgtctgcgcctacaacggcgtcttctgcgcgccgcacccggccggcggcgggctcgccgtcgccggcatcgacctcaaccacgccgacatcgcgggctacctccccgacgacctcccccggggcctccccgacctcgcgctgctccacctcaactccaaccgcttctgcggcgtcctcccggacgccttcctccacctccgcctcctccacgagctcgacctcagcaacaaccgcttcgtcgggcccttcccgcgggtgctcctcgccctgccggcgctcaggtacctcgacctccgcttcaacgacttcgagggccccatcccgccggcgctcttcgaccgcccgctcgacgccatcatcct

SEQ ID NO: 48438 - protein, 194 aa, Panicum virgatum
  misc_feature: Ceres CLONE 2043272
  misc_feature: SWISSPROT Homolog: EC 2.7.11.1 Non-specific serine/threonine protein kinase
MTAAPLDLGGGRGLRRLPPLLLLPLLLAALAPPAASQLPATPRLQAAYAALQSWKRTAIFSDPFNFTANWVGPNVCAYNGVFCAPHPAGGGLAVAGIDLNHADIAGYLPDDLPRGLPDLALLHLNSNRFCGVLPDAFLHLRLLHELDLSNNRFVGPFPRVLLALPALRYLDLRFNDFEGPIPPALFDRPLDAII

SEQ ID NO: 48439 - DNA, 662 bp, Panicum virgatum
  misc_feature: Ceres CLONE 2043314
  misc_feature: Encodes the peptide sequence at SEQ ID NO. 48440
atttccgttcccaaatcgccctgggcagagagtcagagaccgaactcctcaccgcattctcgccgacgcctgagaagccgaagctcccaacccgcccgcgtcggtgcccccgcgccgacgagatggggagcgcggacctggtgctcaagccgtcgtgcgagggctgcggcaacacgtcggacctttatggcacgggatgcaagcacaccacgctctgcagcgactgcggcaagtccatggcgcgctcccgcgcccgctgcctcgtctgctccttgcccatcaccaggcttatccgggaatataatgtccgagctaatgctgttacggataagacatactctattggaagatttgtcactggtttacctcctttctcgaagaagaagagtgctgagaacaagtggtctcttcataaggagggtctacaaggacgtcaaatacctgacaatatgcgggaaaaatacaaccggaaaccatggattttggaagatgaaacgggccaatatcagtatcaaggtcaaatggaaggatcacagtcagctacagctacatattatttgttaatgcggcatggcaaggaatttaatgcctatcctgctggctcttggtataacttcagtaaaattgcacagtacaaacaactgacactggaagaggctgaa

SEQ ID NO: 48440 - protein, 179 aa, Panicum virgatum
  misc_feature: Ceres CLONE 2043314
  misc_feature: SWISSPROT Homolog: EC 2.7.11.1 Non-specific serine/threonine protein kinase
MGSADLVLKPSCEGCGNTSDLYGTGCKHTTLCSDCGKSMARSRARCLVCSLPITRLIREYNVRANAVTDKTYSIGRFVTGLPPFSKKKSAENKWSLHKEGLQGRQIPDNMREKYNRKPWILEDETGQYQYQGQMEGSQSATATYYLLMRHGKEFNAYPAGSWYNFSKIAQYKQLTLEEA

SEQ ID NO: 48441 - DNA, 665 bp, Panicum virgatum
  misc_feature: Ceres CLONE 2043315
  misc_feature: Encodes the peptide sequence at SEQ ID NO. 48442
gaggcgcggcgcggccgctactctgctttgctccctcgacctcgacggcgccgccccacctctgctccctccccttttccccctccaggcgctcaagctcggtggttgcagcgggcgcgcaggacccgtcaatagcgaacgtcttgagcatggccggcgatttgaggagacagtgtactgctatccagtaccctctgcagcagtttttcctgtaaactcgtcctccaggcgcacctcccaggctccaacccttccatcccttccagaaccctcccactccaagcatctccaatcgcatcgcctgagcagagagggcgcgcacgggcgggccaagctcggaggggcgtgatggcggggaacgactggatcaatagctacctggaggctatcctcgacgcgggcggggctgcgggggagatctcggcagccgcaggtggtggcagcggggttgagggggcatccggagagaagcgggacaagtcgtcgctgatgctccgggagcgcggccggttcagccccgcgcgatactttgtcgaggaggtcatctccggtttcgacgagactgacctttacaagacctgggtccgaacatcggcgatgaggagccctcaggagaggaacacgcggctggagaacatgtcctggaggatctggaacctcgccag

SEQ ID NO: 48442 - protein, 105 aa, Panicum virgatum
  misc_feature: Ceres CLONE 2043315
  misc_feature: SWISSPROT Homolog: EC 2.4.1.14 Sucrose-phosphate synthase
  misc_feature: Functional homolog of the protein sequence given in SEQ ID NO 50680
  misc_feature: Useful for making plants with altered cell wall content and/or composition
  misc_feature: Useful for making plants with modulated biomass
  misc_feature: Useful for making plants with modulated carbohydrate content
MAGNDWINSYLEAILDAGGAAGEISAAAGGGSGVEGASGEKRDKSSLMLRERGRFSPARYFVEEVISGFDETDLYKTWVRTSAMRSPQERNTRLENMSWRIWNLA

SEQ ID NO: 48443 - DNA, 701 bp, Panicum virgatum
  misc_feature: Ceres CLONE 2043317
  misc_feature: Encodes the peptide sequence at SEQ ID NO. 48444
acaccgtgggcccatctcgttcgctttcgccttccttcctcctcctttccttccccgagaagccgaactgcgcccgcggtctctcgccacctccgtcccttcctagcagtccctcccctaaaccctagcgcggttctagaatcttccagaaccctctccccgaccccgaaggtccctaacccctcgctcgaaagccggcgccatggacctggaccccgagggcatcttccgcgacgacagcgacgaggacgatgacaacgtccaggagagggaggcaaacaaggatatggttgtctacctcgtcgacgcctcgcccaaaatgttcacccccgctaccaatcaggcagatgaaaaggatgagacccatttccataccatagttaactgcattacgcagtctctgaagacacaaatcattggaagatcctatgatgaagttgcaatatgtttctttaacactaaagagaagaagaatttacaggatttggcaggtgtttatgtttacaatgtcggagacagagatccacttgatagacccactgcaaaactgattaaagatttttcttgcattgaagattctttcatgagcaacattggaagtcgatatggaataactgctggatctcgggagaacaccctttacaatgctctttgggttgcgcaggcactgttgcgcaaaggatctgtgaagaccgtcagaa

SEQ ID NO: 48444 - protein, 166 aa, Panicum virgatum
  misc_feature: Ceres CLONE 2043317
  misc_feature (29)..(165): Pfam Name: Ku_N Pfam Description: Ku70/Ku80 N-terminal alpha/beta domain
MDLDPEGIFRDDSDEDDDNVQEREANKDMVVYLVDASPKMFTPATNQADEKDETHFHTIVNCITQSLKTQIIGRSYDEVAICFFNTKEKKNLQDLAGVYVYNVGDRDPLDRPTAKLIKDFSCIEDSFMSNIGSRYGITAGSRENTLYNALWVAQALLRKGSVKTVR

SEQ ID NO: 48445 - DNA, 587 bp, Panicum virgatum
  misc_feature: Ceres CLONE 2043325
  misc_feature: Encodes the peptide sequence at SEQ ID NO. 48446
gtcccccaccgaaacactccccccgccgcggcgttcccctgtccgtcctcgcgcagtcgccctcggccaccacactttgctctcgctccacgccgccgcgtaccgatattaataccaccacggcacctcctccgccagacggccaccaccgtgctccgtacaaactcagctccgaccatggccgccgccgcggcctcgttcgccgcccttccgtgcctcctactgctgctgctgctgccgtcgctcggcgccgcctccaatgtgacgtacgaccaccgctccctcatcatcgacggccgccgccgcctcgtcatctccacctccatccactacccccgcagcgtccccgagatgtggcccaagctggtggccgaggccaaggacggcggcgccgactgcatcgagacctacgtcttctggaacggccatgagatcgccccaggccagtactacttcgaggataggttcgacctggtacggttcgtgaaggtcgtcagggacgccggcctgcttttgatcctgcgcattgggccgttcgtcgccgccgagtggaactttggaggcgtgcccgtgtggttgcattacgt

SEQ ID NO: 48446 - protein, 136 aa, Panicum virgatum
  misc_feature: Ceres CLONE 2043325
  misc_feature (35)..(136): Pfam Name: Glyco_hydro_35 Pfam Description: Glycosyl hydrolases family 35
  misc_feature: SWISSPROT Homolog: EC 3.2.1.23 Beta-galactosidase
  misc_feature: Functional homolog of the protein sequence given in SEQ ID NO 51738
  misc_feature: Useful for making plants with altered cell wall content and/or composition
  misc_feature: Functional homolog of the protein sequence given in SEQ ID NO 51152
  misc_feature: Useful for making plants with altered carbohydrate content
MAAAAASFAALPCLLLLLLLPSLGAASNVTYDHRSLIIDGRRRLVISTSIHYPRSVPEMWPKLVAEAKDGGADCIETYVFWNGHEIAPGQYYFEDRFDLVRFVKVVRDAGLLLILRIGPFVAAEWNFGGVPVWLHY

SEQ ID NO: 48447 - DNA, 673 bp, Panicum virgatum
  misc_feature: Ceres CLONE 2043328
  misc_feature: Encodes the peptide sequence at SEQ ID NO. 48448
tagttggctttcataaacaagatctatcaactttcagcagctccaaagagtctcaaacaaagaaacttgatattcctgagagtcgtgatgcacttcatacagaggaaatagaagctaaggctggagattacacacctcaaaagactgacgaggataagcttcatgcaaagtctgatgttgatttgttacagaaacataaggaagatttcactgaagaagcaccagagatgataaatagcaagaaaatcaatgaggaacaccttgcaatggttgaagagaagaaaagtattagcatgggggaagaacaatggattgttactgatgaaagcatttcagtggttgaggtggagatggaaacgggtgaggacaaatctctgcatcttcctggagaagaggatccatgggttgaagatgaagtagggatatctgaggatgaagaacactatgaagttgaggagacgtttgtgtctcctgaacaagatatgcaagaatcaccacaggatgaaatggacccacaagaactacaaaggatgcttcgagaacttgctgaaaaaaattatttactaggaaacaagttttttgtttttccagaggttttgaaagctgattcaactattgctctgtatttcaatcgtgatctatcggctatagccaatgagcctgatgtactcat

SEQ ID NO: 48448 - protein, 223 aa, Panicum virgatum
  misc_feature: Ceres CLONE 2043328
  misc_feature (138)..(223): Pfam Name: SSIII Pfam Description: Starch synthase III
  misc_feature: SWISSPROT Homolog: EC 2.4.1.21 Starch synthase
VGFHKQDLSTFSSSKESQTKKLDIPESRDALHTEEIEAKAGDYTPQKTDEDKLHAKSDVDLLQKHKEDFTEEAPEMINSKKINEEHLAMVEEKKSISMGEEQWIVTDESISVVEVEMETGEDKSLHLPGEEDPWVEDEVGISEDEEHYEVEETFVSPEQDMQESPQDEMDPQELQRMLRELAEKNYLLGNKFFVFPEVLKADSTIALYFNRDLSAIANEPDVL

SEQ ID NO: 48449 - DNA, 651 bp, Panicum virgatum
  misc_feature: Ceres CLONE 2043330
  misc_feature: Encodes the peptide sequence at SEQ ID NO. 48450
agcttccgcactcccccacccgtccctcccgcgccgccacccccccacaggtaaggaggaggaggaggcgaggatgtcgcaccgcaagttcgagcacccgaggcacggttccctcggcttcctccccaggaagcgcgcctcccgccaccggggcaaggtgaagtccttccccagggatgaccccaagaagccatgccacctcaccgccttccttggctacaaggctggcatgacacacattgtccgtgaggtcgagaagcctggatccaaactccacaagaaggaaacctgcgaagctgttaccatcattgaaactcctcctgttgtcattgttggtcttgtggcatatgtgaagactcctcgtggcttccgcaccctcaactctgtctgggcacagcacttgagtgaggaagtgaggaggaggttctacaagaactggtgcaagagcaagaagaaggctttcactaagtatgctctaaagtatgacagtgatgcaggcaagaaggaaattcagctgcagcttgagaagatgaagaagtatgcttctgttatccgcgtgattgcccacacccagattaggaagatgaagggtttgaagcagaagaaggctcacctcatggagatccaggtcaatggtggtaccattgccga

SEQ ID NO: 48450 - protein, 192 aa, Panicum virgatum
  misc_feature: Ceres CLONE 2043330
  misc_feature (50)..(192): Pfam Name: Ribosomal_L3 Pfam Description: Ribosomal protein L3
MSHRKFEHPRHGSLGFLPRKRASRHRGKVKSFPRDDPKKPCHLTAFLGYKAGMTHIVREVEKPGSKLHKKETCEAVTIIETPPVVIVGLVAYVKTPRGFRTLNSVWAQHLSEEVRRRFYKNWCKSKKKAFTKYALKYDSDAGKKEIQLQLEKMKKYASVIRVIAHTQIRKMKGLKQKKAHLMEIQVNGGTIA

SEQ ID NO: 48451 - DNA, 652 bp, Panicum virgatum
  misc_feature: Ceres CLONE 2043416
  misc_feature: Encodes the peptide sequence at SEQ ID NO. 48452
aacttcccatttttcacgcacacacgcgcagagagagccaagaaggatgccttgagaagcgcgctgcgggtgtccgatctcctcgtcgacacggtcgacggcggcgtgcaggagctcttcgtcaacgagaagcgcatcgagcatgaggcccgcgcgctgctcaccactatcgcgcgctacaggaagcagactgaccagtggctggctgccaccaacgaaatcaactcagtcttgaaggaaattggagatttcgagaactggatgaagatcatggactttgactgtaaaagtatcaatgcagcgatacgcaatattcatcagtcatgactctacctgcagtcacaacttcagcaagtatttgtgtcattagatgtgctaattatgcgagttggaaaccctcttggatagaactgcttcctgtttttctgtacaaaactgtaaaatgaatccttgccaagtatctctgctatgagtaccatctctgatcccttcaattttcaaagtgacgatatttgatcaaaatacaccttgatctgatcaagccttgctagtggtgttattcttgtgccattgttggagcaacttttgtccatgagcttgcatgctcaagataggtgcggaaacactgaaaggtaagaccaattactgcatt

SEQ ID NO: 48452 - protein, 108 aa, Panicum virgatum
  misc_feature: Ceres CLONE 2043416
  misc_feature (7)..(108): Pfam Name: GCN5L1 Pfam Description: GCN5-like protein 1 (GCN5L1)
NFPFFTHTRAERAKKDALRSALRVSDLLVDTVDGGVQELFVNEKRIEHEARALLTTIARYRKQTDQWLAATNEINSVLKEIGDFENWMKIMDFDCKSINAAIRNIHQS

SEQ ID NO: 48453 - DNA, 634 bp, Panicum virgatum
  misc_feature: Ceres CLONE 2043425
  misc_feature: Encodes the peptide sequence at SEQ ID NO. 48454
aaataccttgctctcgctgactcctctcctctcctctccctctcaagtctcaacccagtctctctccctctccgcccaagtcctcccccgtcgagacgagtcgcgatcctccccgccgccgcccacccccccgtccggactcggatcgaccccgcgtcgcctcggatggctgatgataatccccacggcgccagcagttcgacggcgaaaccagctgatgatccggagacgaccattgagatcaacatcaagaccctggattcgcaagtccacaagctccgtgtcaacaagaatgcgcctgtttcggtccttaaggagaagatagttgatgcaactggtgttcctctggatcagcagcggttgatttttagaggaagggtcttgaaggatgatcacctcctgtcagaataccatttggaagatggattcacattgcatctggttgctcggcgtgcagctgagagccagaattcttctgggacttctgaaggaaacacacatactaatgtaaattttgctgcaaatggaggattattggatgatatttccaggagtgttcgggatcttcttggttccttgggtgttgcgatgtctggtggtctcaccaatacagcattttcagttcctttgggta

SEQ ID NO: 48454 - protein, 156 aa, Panicum virgatum
  misc_feature: Ceres CLONE 2043425
  misc_feature (29)..(97): Pfam Name: ubiquitin Pfam Description: Ubiquitin family
MADDNPHGASSSTAKPADDPETTIEINIKTLDSQVHKLRVNKNAPVSVLKEKIVDATGVPLDQQRLIFRGRVLKDDHLLSEYHLEDGFTLHLVARRAAESQNSSGTSEGNTHTNVNFAANGGLLDDISRSVRDLLGSLGVAMSGGLTNTAFSVPLG

SEQ ID NO: 48455 - DNA, 614 bp, Panicum virgatum
  misc_feature: Ceres CLONE 2043431
  misc_feature: Encodes the peptide sequence at SEQ ID NO. 48456
acatgccattcttgttgccgttgccaacccctcttggccggcctcactcgctgctgctgctgctctacctgcaccgcctcccccatcccatccaccacctcctcctgctgctccgccttgacgtgaccgcgaggggagggcgctgagctacgcctagctaccgaggcagctctcctccagctccccggtccggtcgcctcgggtgaacgcgtgccctgtgctcgcccaagggcggaggagaggggggaggcctccggcggcgcggcgatgccggcgctgctgggtgcttgattaggcgtctcgccgcggcggcgatggaggaggggatgaagcgcggcggggcggcggctgcggtggcgctgtggctgctggtcggcgtctcgttgaccggcgccgcggcggggctcaacgccgacggggcgctgctcatgtccttcaaggccgcggtcaccgcggacccgctgggcgcgctggccggctgggactacgacgccgccgagccctgcgcctggaacggcgtcgtctgcaagggctacccgcagcccggcgccgccgccgccaacgtcacctcgacctcctccggcaccgacggcaactccacggcggcggccgcg

SEQ ID NO: 48456 - protein, 99 aa, Panicum virgatum
  misc_feature: Ceres CLONE 2043431
  misc_feature (31)..(72): Pfam Name: LRRNT_2 Pfam Description: Leucine rich repeat N-terminal domain
MEEGMKRGGAAAAVALWLLVGVSLTGAAAGLNADGALLMSFKAAVTADPLGALAGWDYDAAEPCAWNGVVCKGYPQPGAAAANVTSTSSGTDGNSTAAA

SEQ ID NO: 48457 - DNA, 588 bp, Panicum virgatum
  misc_feature: Ceres CLONE 2043469
  misc_feature: Encodes the peptide sequence at SEQ ID NO. 48458
accaatccattccacccccgttcaccccgtccatttgatttgcgtttagtgcgttgcgtttcttgggtttctcctagttcggaaggagcacctccttcctctggcactcttgttctccgctcggagaaaggcttgaggacccaagaagaggataacaatgggggaagctgccggcgaccgcgtcctgagccgcctccacagcgtcagggagcgcatcggtgactccctatctgctcaccccaatgagctcgtcgctgtcttcaccaggctgaaaaaccttggaaagggcatgctgcagccccaccagatcattgctgagtacaacagcgctatccctgaggctgagcgcgagaagctgaaggatggtgcctttgaggacgtcctgagggcagctcaggaagctattgttatccccccatgggttgcactcgccatccgccctaggcctggtgtctgggagtatgtgagggtcaatgtcagcgagctcgcggttgaggagctgagagtccctgagtacctgcagttcaaggaacagcttgtggaagaagggtataaatttgcacctaaactgatcatgtttgatttttt

SEQ ID NO: 48458 - protein, 143 aa, Panicum virgatum
  misc_feature: Ceres CLONE 2043469
  misc_feature: SWISSPROT Homolog: EC 2.4.1.13 Sucrose synthase
  misc_feature: Functional homolog of the protein sequence given in SEQ ID NO 50269
  misc_feature: Useful for making plants with altered carbohydrate content
  misc_feature: Functional homolog of the protein sequence given in SEQ ID NO 51468
  misc_feature: Useful for making plants with altered cell wall content and/or composition
  misc_feature: The sequence is a functional homolog of SEQ ID NO 12 in US patent 7091398
  misc_feature: The sequence is a functional homolog of SEQ ID NO 2 in US patent 7091398
MGEAAGDRVLSRLHSVRERIGDSLSAHPNELVAVFTRLKNLGKGMLQPHQIIAEYNSAIPEAEREKLKDGAFEDVLRAAQEAIVIPPWVALAIRPRPGVWEYVRVNVSELAVEELRVPEYLQFKEQLVEEGYKFAPKLIMFDF

SEQ ID NO: 48459 - DNA, 663 bp, Panicum virgatum
  misc_feature: Ceres CLONE 2043470
  misc_feature: Encodes the peptide sequence at SEQ ID NO. 48460
accacatcaatcaaccaaagcaacagcagcagcagcaatcgccgctctcgttgctcgtttcgttcgtcgcagatcctctagccttcgttcgaccagcatcaaccaatggctctcggtgacggcgctgcggcggccaccaacaacctggtggtctcgttcggcgagatgctcatcgacttcgtgcccgacgtggcggggctgtcgctcgccgagtccggcggcttcgtcaaggctcccggcggcgcgcccgccaacgtcgcctgcgccatctccaagctcggcgggtcgtccgccttcctcggcaagttcggtgacgacgagttcggtcacatgctcgtcaacatcctgaagcagaacggcgtgaacgccgagggctgcctgttcgaccagcacgcgcgcacggcgctcgccttcgtcacgctcaagaagaacggcgagcgcgagttcatgttctaccgcaacccaagcgccgacatgctgctcacggaggccgagctcaacctcgacctcatccgccgcgccagggtcttccactacggctccatctcgctcatcgccgagccctgccgctccgcgcacctggccgccatgcgcgccgccaaggccgccggcatcctctgctcgtacgaccccaacgtccgtttgcctctctggccctcggag

SEQ ID NO: 48460 - protein, 185 aa, Panicum virgatum
  misc_feature: Ceres CLONE 2043470
  misc_feature: SWISSPROT Homolog: EC 2.7.1.4 Fructokinase
MALGDGAAAATNNLVVSFGEMLIDFVPDVAGLSLAESGGFVKAPGGAPANVACAISKLGGSSAFLGKFGDDEFGHMLVNILKQNGVNAEGCLFDQHARTALAFVTLKKNGEREFMFYRNPSADMLLTEAELNLDLIRRARVFHYGSISLIAEPCRSAHLAAMRAAKAAGILCSYDPNVRLPLWPS

SEQ ID NO: 48461 - DNA, 718 bp, Panicum virgatum
  misc_feature: Ceres CLONE 2043501
  misc_feature: Encodes the peptide sequence at SEQ ID NO. 48462
aggctaagaaaaggtttgaatttttggaggctgttagtgggacaatggatgcacaccttcgttatttcaaacaaggatacgaactactacatcagatggaaccatatatcaatcaagttcttgcttacgcacagcaatcgagagaaaggtctaactatgagcaggctgctcttgttgagagaatgcaagagtttaaacgacaaattgatcgggaaagtcggtggtcaccaaatggaatgaatgattcccctaatggtgatggaatacaagcaattggtagaagttctcataagatgattgaagcagcgatgcaatcagcttcacagggcaaggttcagaccattcgacaaggttatctttccaagaggtcttcaaacttgagaggtgattggaagaggaggttctttgtcctcgacagtcgaggaatgctatactattatcgcaagcagaacagtaggccgtccagtggttattctaaccaaagaactagcactccctccgaacatggttctgggttgctcagcagatggttctcatctcattatcatggcggtgtgcatgatgagaaatctgttgcacgccatactgtaaacttgctaacatcgactattaaagttgatgcagatcaatcggatctgcggttctgcttcagaataatttctcccacaaagaactatacattgcaggcagagagtgcaatggatcagatggattggat

SEQ ID NO: 48462 - protein, 238 aa, Panicum virgatum
  misc_feature: Ceres CLONE 2043501
  misc_feature (113)..(237): Pfam Name: PH Pfam Description: PH domain
AKKRFEFLEAVSGTMDAHLRYFKQGYELLHQMEPYINQVLAYAQQSRERSNYEQAALVERMQEFKRQIDRESRWSPNGMNDSPNGDGIQAIGRSSHKMIEAAMQSASQGKVQTIRQGYLSKRSSNLRGDWKRRFFVLDSRGMLYYYRKQNSRPSSGYSNQRTSTPSEHGSGLLSRWFSSHYHGGVHDEKSVARHTVNLLTSTIKVDADQSDLRFCFRIISPTKNYTLQAESAMDQMDW

SEQ ID NO: 48463 - DNA, 764 bp, Panicum virgatum
  misc_feature: Ceres CLONE 2043649
  misc_feature: Encodes the peptide sequence at SEQ ID NO. 48464
aaaagaccaccgccgctgcctgcgcaccacccaggcctcagctcgagcccaacgaccggcgcctagacgcggctgggcggtcggcctcacctcccctcccccgcgcctccctcctccgcgtctcgatctcgcctcccgcctcccgccacccggccagatctcgccatcccggcgctgcggccatggagaacctgatctccctcgtcaacaagctgcagcgggcctgcacggccctcggcgaccacggcgaggagagcgccctcccaacgctctgggactcgctgccggccatcgccgtcgttggaggccagagttctggcaaatcttcggtgttggagagtgtggtcgggaaggatttcctaccgaggggttcaggcattgtcacccggcgtccgctggtgctgcagctccacagaattgatggagacagggaatatgctgagtttatgcaccaacccaggaagagatatacagattttgctgctgtgaggaaggagatagctgatgaaactgacagagaaactggtcgctcaaagcaaatatcacctgtccctatccatttaagcatctattctccaaatgttgtgaatctgactcttgttgatcttcctgggcttactaaagtagctgttgagggtcaaccagacagtattgttcaggacatcgaaaacatggttcgatcatacattgaaaagccaaattgtatcattttgggcgtttccccagctaatcaggatcttgcaacttctgatgcaatcaagatt

SEQ ID NO: 48464 - protein, 193 aa, Panicum virgatum
  misc_feature: Ceres CLONE 2043649
  misc_feature (37)..(193): Pfam Name: Dynamin_N Pfam Description: Dynamin family
  misc_feature: SWISSPROT Homolog: EC 3.6.5.5 Dynamin GTPase
MENLISLVNKLQRACTALGDHGEESALPTLWDSLPAIAVVGGQSSGKSSVLESVVGKDFLPRGSGIVTRRPLVLQLHRIDGDREYAEFMHQPRKRYTDFAAVRKEIADETDRETGRSKQISPVPIHLSIYSPNVVNLTLVDLPGLTKVAVEGQPDSIVQDIENMVRSYIEKPNCIILGVSPANQDLATSDAIK

SEQ ID NO: 48465 - DNA, 657 bp, Panicum virgatum
  misc_feature: Ceres CLONE 2043652
  misc_feature: Encodes the peptide sequence at SEQ ID NO. 48466
gccaggtatggtcgccccttatctttccttctgctgtgcgagaccaagcaccccaaacctaacccagcgctccctcactcctcgcctccgactcgccgccgccggagctcgccggtggaagtccactcggccgcgatgagggcggcggcgggcacaccccttcccttccttcgaggatctcccgtttctcctttccctccttttcttcccgccggggttgcagcactggtcgccggccgccggcgtccttttcgccggctgtgcgcagatccggcaccggtggttgcggatccggtgccgtcttgcggatccgcttggggcataccggccgaagcagctcgacctccacccgccggccgttcgagatggtcgggtgcctgtgccactgccggatctcgacgatctgaatccagtctcgttggtgatggcgagctcggggttgtcgtggacgctaccggaccacccaaagctccccaaggggaagccagtggcggtcgtcgtgctggacggatggggcgaggccaacgccgaccagtacaattgcatccatgttgcgcagacgcctgtcatggactcgctcaagaatggtgctccagagaaatggagactagtgaaggctcatggaaccgctgtgggtctcccatctgatgatgacat

SEQ ID NO: 48466 - protein, 77 aa, Panicum virgatum
  misc_feature: Ceres CLONE 2043652
  misc_feature: SWISSPROT Homolog: EC 5.4.2.1 Phosphoglycerate mutase
MASSGLSWTLPDHPKLPKGKPVAVVVLDGWGEANADQYNCIHVAQTPVMDSLKNGAPEKWRLVKAHGTAVGLPSDDD

SEQ ID NO: 48467 - DNA, 696 bp, Panicum virgatum
  misc_feature: Ceres CLONE 2043656
  misc_feature: Encodes the peptide sequence at SEQ ID NO. 48468
acagtagacgtgctagctagctagctgcagcactgccactctctccctctccgcctctcgcttgctcgtctttaaagctgtcgccttttgccgctctcggcccctgtcctcttctctctctctctctctctcccgtgccgcgctgtgttcctcgtctcgttctgcttcgacaggatccggaagcccggtgagcgagcgggtgctgccggttctgggcggcggagctgggtgggcgcgttccgggcaggtgatggccgaggctccgtgcgccgccgcggtggccggctcgcgcgggggcagcctgtgactgagggggcgctccggagcagctgagaacaggttttgatcgcttcgaggaggaattgagagctcgccaggacgcgaggaggagcgtttgcgtccgggggtggtgctcagtggccgggcgacgatggcggcggcggtggcgatgcggagcgggagcagcgacggcggcggcgggtacgacaagggcggcatggacacgggcaagtacgtgcggtacacgccggagcaggtggaggcgctggagcgggtgtacgccgagtgccccaagcccagctccgcgcgcaggcagcagctgctgcgcgagtgccccatcctctcaaacatcgagcccaagcaaatcaaggtctggttccagaaccgaaggtgccgtgataagcagcgcaaggagtc

SEQ ID NO: 48468 - protein, 88 aa, Panicum virgatum
  misc_feature: Ceres CLONE 2043656
  misc_feature (27)..(85): Pfam Name: Homeobox Pfam Description: Homeobox domain
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: Functional homolog of the protein sequence given in SEQ ID NO 50330
  misc_feature: Useful for making plants with altered carbohydrate content
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 2 in US patent 7056739
  misc_feature: Functional homolog of the protein sequence given in SEQ ID NO 50331
  misc_feature: Useful for making plants with altered lignin content
  misc_feature: The sequence is a functional homolog of SEQ ID NO 1111 in the 10/412,699 US patent application
  misc_feature: The sequence is a functional homolog of SEQ ID NO 668 in the 10/374,780 US patent application
  misc_feature: The sequence is a functional homolog of SEQ ID NO 785 in the 10/666,642 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: The sequence is a functional homolog of SEQ ID NO 1108 in the 10/412,699 US patent application
  misc_feature: The sequence is a functional homolog of SEQ ID NO 665 in the 10/374,780 US patent application
  misc_feature: The sequence is a functional homolog of SEQ ID NO 782 in the 10/666,642 US patent application
MAAAVAMRSGSSDGGGGYDKGGMDTGKYVRYTPEQVEALERVYAECPKPSSARRQQLLRECPILSNIEPKQIKVWFQNRRCRDKQRKE

SEQ ID NO: 48469 - DNA, 743 bp, Panicum virgatum
  misc_feature: Ceres CLONE 2043661
  misc_feature: Encodes the peptide sequence at SEQ ID NO. 48470
ctttctctcctgctgcccctagcgtgtgcgcgtttcactgctttggtttcatctcccgctctttctttcctccccactgctcctccggccaagtgctggaacgaggaagcctcatgcggccgccggccggggagcggtagagcgccggagatgggctgggcgcccaggtggctgcgcgggctgctcggcggcggcaagaaggccgccgagacgaagcccgtgaaggaaaagaggcgttgggggttcgggaagtccttcggggagaaggcgccggcgccggtggcggcgcggcctccgaccccgccggtgcagcccaaggcgacgcctcgccggggctacgcgccggcgccggacgaggcggacgacgagcagagcaagcgcgccatcgcggtggccgcggccactgcggcggttgcggaggccgccgtagccgcggcgcaggcggccgccgccgtggtgcggctgacgagcagcgggcggtgcgcgccggccgccgccaagcgggaggagtgggcgtctgttcggatccaggccgctttccgtggatacctggcgaggcgggcgctcaaggcgctgcgggggctggtgaagctgcaggcgctggtccggggcaacatcgtgcggcggcaggcggcggagacgctgcggtgcatgcacgcgctcgtccgcgtccaggcgcgcgcccgcgcctgccgcgcaattcgctcgcagcaagtcccggctcaccccgatccgccgacgcc

SEQ ID NO: 48470 - protein, 197 aa, Panicum virgatum
  misc_feature: Ceres CLONE 2043661
  misc_feature (120)..(140): Pfam Name: IQ Pfam Description: IQ calmodulin-binding motif
MGWAPRWLRGLLGGGKKAAETKPVKEKRRWGFGKSFGEKAPAPVAARPPTPPVQPKATPRRGYAPAPDEADDEQSKRAIAVAAATAAVAEAAVAAAQAAAAVVRLTSSGRCAPAAAKREEWASVRIQAAFRGYLARRALKALRGLVKLQALVRGNIVRRQAAETLRCMHALVRVQARARACRAIRSQQVPAHPDPPT

SEQ ID NO: 48471 - DNA, 747 bp, Panicum virgatum
  misc_feature: Ceres CLONE 2043683
  misc_feature: Encodes the peptide sequence at SEQ ID NO. 48472
  misc_feature (637)..(637): n is a, c, t, g, unknown, or other
atcgacactctccccgcaccaccaccaccaccgccgctgcggctcacggctacgcagcccgctcacccgttccctctccctcccctctctccggttgcttcgagggttcgccccgaatcgatcgcccgactgaccccgctagggttcggcccgatcgcccgccgcttcgtcctccccgcgggggttttccccggacgcgatgtcggaccggagctcgccggtcgcgccgacgttcttccccttcggcccgcaggccgatgcgtgggacgtcacgttcaaggtcaaatatggtgacacacttaagaggttttatggttgtgtcaatggagctcattttgacatgaatttatctgctctatgggcaaagatagccactgcctttaagtttggtccagatgccgacttcattctgacttacatcgatgaggatggtgatgctgtaatgctagatgatgatgatgacctgcgcgatgcagctctgcgtcagaaactaaaccctctgaggattactgttcaaccaaagaaaagtcaaccaactgaacaaaaggagaaaaattctactacacctatgaagtccactcctcaggatccactgtcccagattatttcagctattgaaggtttgaagcctgctcangaagaaagcttggcacatataaaatcagctattggtgaaagcttcaagtctatcccagagccaatttctgatgcccttgcaaaactctctcatgaagtacttgatgcggc

SEQ ID NO: 48472 - protein, 182 aa, Panicum virgatum
  misc_feature: Ceres CLONE 2043683
  misc_feature (23)..(108): Pfam Name: PB1 Pfam Description: PB1 domain
  misc_feature (146)..(146): Xaa is any aa, unknown, or other
MSDRSSPVAPTFFPFGPQADAWDVTFKVKYGDTLKRFYGCVNGAHFDMNLSALWAKIATAFKFGPDADFILTYIDEDGDAVMLDDDDDLRDAALRQKLNPLRITVQPKKSQPTEQKEKNSTTPMKSTPQDPLSQIISAIEGLKPAXEESLAHIKSAIGESFKSIPEPISDALAKLSHEVLDA

SEQ ID NO: 48473 - DNA, 709 bp, Panicum virgatum
  misc_feature: Ceres CLONE 2043691
  misc_feature: Encodes the peptide sequence at SEQ ID NO. 48474
aaaccagaaaacctaccccccaaaaaaatccgcaaaaaatcccagaaaaaaatcaccaccacccgatctgagatggcggcgcaggggcagcaggcggcggctggatccgcgtccgagtccggcggcggctccccggcggctccggccgtggcggcggctgccggggcggcgttccccgcgacctcgctgtacgtgggcgacctgcacgagagcgtgcaggacgcgcagctgttcgacgtcttcagccaggtcggcggtgtcgtttccgtccgcgtctgcagggacataaactcccgcaagtcgctcgggtacgcctacgtcaactacaacaacccggccgacgctgcacgggcccttgaactgcttaacttcactcctatcaatggaaagcctatcaggatcatgtattctaaccgtgaccccagctcgcgcaaaagtggcacaggaaatatatttattaagaatcttgataaatcaatagacaacaaagctttgtatgacacgttctgtgcatttgggaacatcctttcatgtaaaattgctacagacccctcgggagaatcaaggggctatggctttgttcagtttgagagggatgaatctgctcagtctgctattgataagcttaatggaatgcttatcaatgacaagaaagtgtatgttggaccttttgttcgcaagcaggaccgtgaaaatgtctccagcaatg

SEQ ID NO: 48474 - protein, 212 aa, Panicum virgatum
  misc_feature: Ceres CLONE 2043691
  misc_feature (39)..(110): Pfam Name: RRM_1 Pfam Description: RNA recognition motif. (a.k.a. RRM, RBD, or RNP domain)
  misc_feature (127)..(197): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQGQQAAAGSASESGGGSPAAPAVAAAAGAAFPATSLYVGDLHESVQDAQLFDVFSQVGGVVSVRVCRDINSRKSLGYAYVNYNNPADAARALELLNFTPINGKPIRIMYSNRDPSSRKSGTGNIFIKNLDKSIDNKALYDTFCAFGNILSCKIATDPSGESRGYGFVQFERDESAQSAIDKLNGMLINDKKVYVGPFVRKQDRENVSSN

SEQ ID NO: 48475 - DNA, 666 bp, Panicum virgatum
  misc_feature: Ceres CLONE 2043692
  misc_feature: Encodes the peptide sequence at SEQ ID NO. 48476
gtcatcagttcacgcccaccactcgctgctgcagcccaccccgcccggacccggccgcgaccgagtcgtcgcgagatccagcgccgtcgtcgcgcaaccgccgctgctgccggagatgccgagcccgacgatccggaggctggacgttgcgtcgccggtgccggcggacatcgacatcgccaattccgtcgagccgctctcgatcgtcgacatcgcggcagagctcggcctcgggcccgagcactacgacctctacggcaagtacaaggccaaggtgttgctgtcggttcttgatgacctcaaggagcagcaggatgggtactacgtcgttgtgggcggcatcacgccgacaccgctcggggagggcaagtccaccactaccgtcggcctgtgccaggctctgggcgcattccttgataaaaaggttgtcacttgtctccgtcaaccatcacaagggcctacctttggaatcaagggaggtgcagctggaggtggctatagccaagttatacccatggatgagttcaaccttcatctgacaggcgatatccatgcaattacagctgcaaacaatctcttggctgctgctattgatacaaggatcttccatgaaaattctcagtcagacaaggcactggttcacagattatgtccagcaaacaaaga

SEQ ID NO: 48476 - protein, 183 aa, Panicum virgatum
  misc_feature: Ceres CLONE 2043692
  misc_feature (15)..(183): Pfam Name: FTHFS Pfam Description: Formate--tetrahydrofolate ligase
  misc_feature: SWISSPROT Homolog: EC 6.3.4.3 Formate--tetrahydrofolate ligase
MPSPTIRRLDVASPVPADIDIANSVEPLSIVDIAAELGLGPEHYDLYGKYKAKVLLSVLDDLKEQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHENSQSDKALVHRLCPANK

SEQ ID NO: 48477 - DNA, 758 bp, Panicum virgatum
  misc_feature: Ceres CLONE 2043694
  misc_feature: Encodes the peptide sequence at SEQ ID NO. 48478
caaaactatgcaatcaccagatattgtatcatgggctggagtcatggcaggctgtgttaagaacctccagtatgaaagagcatgcggttactttaggcagttaagtgatgctggagcacctctagatcagcattgtattgccactgtcgtgaatgcttgcacctttcttcaggacttggataagggaaggcagattcactctttagctcttaaacttgggctgctacttgttgattatgtcagtgcatcactagtaaacatgtatgcaaaatgccatagcattgagggtgctggtgagttattctcccatgctgtgttcccacgaaatttagttgtaatcaatgccatgctttctggatattgctggaatttcctgccagagaaagctctgctgctattttacagggaatatcagtttggtctgcgtcctgatcagttcactttctcaattgttcttggtgcatgttctgatataggagcaaagaaggctggtgagcagatccatggctaccttgtaaaagttggttctgaatgcatggatgtcattgttggaaatgctatcatagacctttatgttaagtgtggatgcattgctagtgcttgtagattctttcatagcatgaagagttggaacatcaattcatatgccatgttaatgtggggttatattcagaacagatgcagtgatgaagctcttcagcttttctctaagatgcagcacagtggattgcgcgcaaatcgtgtcaccttcgcaagat

SEQ ID NO: 48478 - protein, 252 aa, Panicum virgatum
  misc_feature: Ceres CLONE 2043694
  misc_feature (213)..(247): Pfam Name: PPR Pfam Description: PPR repeat
KTMQSPDIVSWAGVMAGCVKNLQYERACGYFRQLSDAGAPLDQHCIATVVNACTFLQDLDKGRQIHSLALKLGLLLVDYVSASLVNMYAKCHSIEGAGELFSHAVFPRNLVVINAMLSGYCWNFLPEKALLLFYREYQFGLRPDQFTFSIVLGACSDIGAKKAGEQIHGYLVKVGSECMDVIVGNAIIDLYVKCGCIASACRFFHSMKSWNINSYAMLMWGYIQNRCSDEALQLFSKMQHSGLRANRVTFAR

SEQ ID NO: 48479 - DNA, 724 bp, Panicum virgatum
  misc_feature: Ceres CLONE 2043700
  misc_feature: Encodes the peptide sequence at SEQ ID NO. 48480
gggaaatcccctctcatggtccactgtattctctaggtggagtttggctggacttcatttattcccaaagatttgagcttttggagctttataggtcacaaaattctcgtggcgctgggggaaactctggccgcccctcgggaggagctcttgccccttccatttctttccagcgaagatttcaacttttttttaaggctttgagagctcaagagttggatttctgaaaccactgtcagaggcttgctctcgccgatttccaagatttcctctttatctcttcgtttccaagatctgagcttggggattcttggtgcaaagcagagcaatccaccaaaaccgccctaagatttggagccggaataatccatcgatgggttccgggtccggccatggagcggcggcggtggccgtggcgctggtttcttggctgtgcttcgcatcggcaggcgtcggcgcgataggagcgaactggggcacgcagacgagccacccgctgccgccggacacggtggtgcggatgctcaaggacaacgggttccagaaggtgaagctgttcgacgccgaggagggcaccatgaacgccctcaagaagagcgggctggaggtgatggtcggcatccccaacgacatgctgctgacgatggccaccaacatgaagtctgccgagaagtgggtcgacacgaacgtctccagctacctcaatgacggcgtcaacatcagg

SEQ ID NO: 48480 - protein, 116 aa, Panicum virgatum
  misc_feature: Ceres CLONE 2043700
  misc_feature: SWISSPROT Homolog: EC 3.2.1.39 Glucan endo-1,3-beta-D-glucosidase
  misc_feature: Functional homolog of the protein sequence given in SEQ ID NO 51750
  misc_feature: Useful for making plants with altered carbohydrate content
  misc_feature: Functional homolog of the protein sequence given in SEQ ID NO 51751
  misc_feature: Useful for making plants with altered cell wall content and/or composition
MGSGSGHGAAAVAVALVSWLCFASAGVGAIGANWGTQTSHPLPPDTVVRMLKDNGFQKVKLFDAEEGTMNALKKSGLEVMVGIPNDMLLTMATNMKSAEKWVDTNVSSYLNDGVNI

SEQ ID NO: 48481 - DNA, 709 bp, Panicum virgatum
  misc_feature: Ceres CLONE 2043713
  misc_feature: Encodes the peptide sequence at SEQ ID NO. 48482
acggcacccaaaacctatccctccactccaccgcgcctccgtcccctccccgatctcgcctggccgcgagccggcggtcccccagatccgcctgccccctccaaccttcccgccgccccgccgccagatccgggcctgcccccggcaaaaccccgcggcgccgcatcccaggccgggggagagcggaggcttaggtctcagcagccatggcggccgcggaggagaacacctcgctgttcctgatcttcatcctcaccatgatcgcgctgccgctcgtgccctacaccatcatgcgcctgtgccgcgccgcctccgagaaggccaagaccatccactgccgctgctcagggtgccaccgctccgggaagtaccgcaagtcgatctacaagaggatatccaacttctcgacgtgcagtaacctgaccatcgttctactttggatctttatgatcttcctggtttactacatcaaacattttagccgtgaggtccaagtttttgagcctttcagcattcttggactggaacctggggcatccgaatctgaaatcaagaaatcatacaggaggctttctattcaatatcatcctgataaaaatcctgatccagaggcccataatttcttcgttgaatatatatccaaggcatatcaggcattaacggatcctgtgtcccgtgaaaattatgagaaatatggtcaccctgatgg

SEQ ID NO: 48482 - protein, 167 aa, Panicum virgatum
  misc_feature: Ceres CLONE 2043713
  misc_feature (99)..(161): Pfam Name: DnaJ Pfam Description: DnaJ domain
MAAAEENTSLFLIFILTMIALPLVPYTIMRLCRAASEKAKTIHCRCSGCHRSGKYRKSIYKRISNFSTCSNLTIVLLWIFMIFLVYYIKHFSREVQVFEPFSILGLEPGASESEIKKSYRRLSIQYHPDKNPDPEAHNFFVEYISKAYQALTDPVSRENYEKYGHPD

SEQ ID NO: 48483 - DNA, 688 bp, Panicum virgatum
  misc_feature: Ceres CLONE 2043740
  misc_feature: Encodes the peptide sequence at SEQ ID NO. 48484
aaaaaaaccgcagcaaaaaaggagcgagcgagagagagagagggggatcgattcggagagctcggaggcggggcggggcggcgggatcgcccgggaggccacagcggcgcggcgcgcggctcccggtccctttgcgggcggcccgatccgacggatccggggggaatggcggcccggggagggatctagggtcgcgcaggcaggcaatggcggcggcggcggcgagggctcggcggcggtgggcggtgtgggcgctcctgctgctgcggctgctgctccacccggccgcgcgcgtgctcgccaacacggaaggtgatgctctgcatagcttaaggactaacttaaatgatcctaataatgttctacaaagttgggatccaactctggtcaacccgtgcacttggtttcatgttacctgcaataacgacaacagtgttatcagagtggatcttggaaatgctgcactatcaggaactttggtcccgcaactcggccagcttaaaaatttgcagtacctggagctctacagtaataacatcagcggcactatacctagtgaacttgggaatctcacaaacttggtcagtttggatttatacttgaacaacttcactggtccaatacctgtttcattggggaacctactgaagctgcggttcttgcgtcttaataacaacagcctttcggg

SEQ ID NO: 48484 - protein, 160 aa, Panicum virgatum
  misc_feature: Ceres CLONE 2043740
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAAAARARRRWAVWALLLLRLLLHPAARVLANTEGDALHSLRTNLNDPNNVLQSWDPTLVNPCTWFHVTCNNDNSVIRVDLGNAALSGTLVPQLGQLKNLQYLELYSNNISGTIPSELGNLTNLVSLDLYLNNFTGPIPVSLGNLLKLRFLRLNNNSLS

SEQ ID NO: 48485 - DNA, 580 bp, Panicum virgatum
  misc_feature: Ceres CLONE 2043763
  misc_feature: Encodes the peptide sequence at SEQ ID NO. 48486
actcgtcttctccggccggccgacgcagctacataaccgcttctcttctcgtagactcgtacgacctggcctgtacacaacaattccttgcccctcccacagtgcctagaacctgcctctcctccgaagcagaaggttctagaagccccgcccgctccccggccaggatgtgcgggatcttcgcctacctcaactacaatgtgtcgcgggagcgccgcaacatcctcgaggtcctcttcaacggcctccgccgcctcgagtaccgcggctacgactcctccgggatcgcgctcgacgccgaccgcaccccgccctcctcctctgcttccccgcctgatgcgccgtacgtcggggcgccgccgctcgtgttccgccaggagggcaagatcgagaacctcgtgcgatccgtctactccgaggttgatgagaaggatgtgaacttggatgctgcgttcagcgtgcatgctgggattgcccacaccagatgggccacacatggtgtgcctgccccgaggaatagccacccccaatcttctggtgccggcgatgagttcttggttgtccacaatggtatcatcac

SEQ ID NO: 48486 - protein, 137 aa, Panicum virgatum
  misc_feature: Ceres CLONE 2043763
  misc_feature (2)..(136): Pfam Name: GATase_2 Pfam Description: Glutamine amidotransferases class-II
  misc_feature: SWISSPROT Homolog: EC 2.6.1.16 Glutamine--fructose-6-phosphate transaminase (isomerizing)
  misc_feature: Functional homolog of the protein sequence given in SEQ ID NO 51752
  misc_feature: Useful for making plants with modulated biomass
  misc_feature: Useful for making plants with modulated flowering time
MCGIFAYLNYNVSRERRNILEVLFNGLRRLEYRGYDSSGIALDADRTPPSSSASPPDAPYVGAPPLVFRQEGKIENLVRSVYSEVDEKDVNLDAAFSVHAGIAHTRWATHGVPAPRNSHPQSSGAGDEFLVVHNGII

SEQ ID NO: 48487 - DNA, 665 bp, Panicum virgatum
  misc_feature: Ceres CLONE 2043765
  misc_feature: Encodes the peptide sequence at SEQ ID NO. 48488
gggcaaaccgctcccttccgtcacgtaaccacgtctcctccgccgccccgcttcctcctgcctccttgctaagcaaacccccgcttttcctcctccgccctgcacgcgcgcgcctcgcgaaatccccccctccctcgccgccgctcgccattccccgccccggaggaagccagccagccccgccggagatgtcgtacgcctacctcttcaagtacatcatcatcggcgacacaggcgtcggcaagtcgtgcctgctgctgcagttcaccgacaagcgcctccagcccgtgcacgacctcaccatcggcgtcgagttcggggcgcggatgatcaccatcgacaacaagcccatcaagctccagatttgggacacggcaagaaccgcaaggtcttcagatccaggaattgctgtttgtgaagaggcactaggacctccaccaggcgccttagtttcatgtccaaatttttaccaagctgtattctggttcgagttggatccctagcctagcaattcgtaattggaaagatgcaactgtcatctttctctgtacctttttgtaatatatgacttttgggtttgaattttgtatgtattacccttttaggtacgttggaatcgggagaaaccttttgggattgtgtattcgatttgtcatcaagtaccg

SEQ ID NO: 48488 - protein, 104 aa, Panicum virgatum
  misc_feature: Ceres CLONE 2043765
  misc_feature (8)..(102): Pfam Name: Ras Pfam Description: Ras family
MSYAYLFKYIIIGDTGVGKSCLLLQFTDKRLQPVHDLTIGVEFGARMITIDNKPIKLQIWDTARTARSSDPGIAVCEEALGPPPGALVSCPNFYQAVFWFELDP

SEQ ID NO: 48489 - DNA, 621 bp, Panicum virgatum
  misc_feature: Ceres CLONE 2043767
  misc_feature: Encodes the peptide sequence at SEQ ID NO. 48490
aaaagccttacatgaaaaatccccaatggctcatcgcgtcctcctcctcctctccctcgccgcggcggccgcggtcgccgccgccgccgccgacgccgaggaccccctgatccgtcaggcggggcccggcggcgacgacaacgacctggagctgaacgcggagtcccacttcctgagcttcatgcagcggttcggcaagtcctacaaggacgccgacgagcacgcgtaccaactgtccgtgttcaagtccaacctgcgccgcgcgcgccgccaccagctgctggacccgtcagcggagcacggcatcaccaagttctccgacctgacgccggccgagttccgccggacctacctcggcctccgcaagtcccggcgcgcgctcctcagggagctcgggggctcggcgcacgaggcgcccgtgctccccaccgacggcctccccgaggacttcgactggagggaccacggcgccgtcggccccgtcaagaaccagggtgcgcactatctcgctaccggcaagctggaggtgctctccgagaagcagtttgtcgactgcgaccatgagggccgtggcgtcaaggcaaacaagctgaatgcgcttcctctggaaactgtgagctc

SEQ ID NO: 48490 - protein, 198 aa, Panicum virgatum
  misc_feature: Ceres CLONE 2043767
  misc_feature (49)..(105): Pfam Name: Inhibitor_I29 Pfam Description: Cathepsin propeptide inhibitor domain (I29)
  misc_feature: SWISSPROT Homolog: EC 3.4.22.41 Cathepsin F
MAHRVLLLLSLAAAAAVAAAAADAEDPLIRQAGPGGDDNDLELNAESHFLSFMQRFGKSYKDADEHAYQLSVFKSNLRRARRHQLLDPSAEHGITKFSDLTPAEFRRTYLGLRKSRRALLRELGGSAHEAPVLPTDGLPEDFDWRDHGAVGPVKNQGAHYLATGKLEVLSEKQFVDCDHEGRGVKANKLNALPLETVS

SEQ ID NO: 48491 - DNA, 731 bp, Panicum virgatum
  misc_feature: Ceres CLONE 2043798
  misc_feature: Encodes the peptide sequence at SEQ ID NO. 48492
attgcatttctctgcctcttcacgctccttcttctcacggttcctggttgacatgcttcttcctgttctttccgttcatggccgccccgggtttgattggcggcaagttactgccctcaacacgctgtttaccagcatgaattcaccagggcagctgcagggctggaaggcaagcggcggtgacccctgcagcgaatcatggcagggaatcacctgctctggatcctcagtcactgcgattaaactgccaggattggggctctctggaactctggcctacaacctgaacaccatggattcactagtggagctagatatgagccaaaatagtctcggtggtggtcaacagattccgtacaatcttccaaataagaagcttgaaagactcaatctggcagggaaccagttctctggaggtataccatactcaatttcgacaatgcctaaacttcaatacctaaaccttaatcataaccaactatcaggagatatcactgacatattttccaacctcccaagtttgaccacagtagacctttcctccaattctcttactggtaatctgccgcaaagtttcagttctttgccaagcctgaaaacactgtatttgcagaacaatcaacttactggctcaatcaatgtacttgccaatcttccacttgacgatttgaatgtagcaaataatcgcttcactggttggattcctgatgagctaaaaagataaatagcct

SEQ ID NO: 48492 - protein, 223 aa, Panicum virgatum
  misc_feature: Ceres CLONE 2043798
  misc_feature (15)..(56): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLPVLSVHGRPGFDWRQVTALNTLFTSMNSPGQLQGWKASGGDPCSESWQGITCSGSSVTAIKLPGLGLSGTLAYNLNTMDSLVELDMSQNSLGGGQQIPYNLPNKKLERLNLAGNQFSGGIPYSISTMPKLQYLNLNHNQLSGDITDIFSNLPSLTTVDLSSNSLTGNLPQSFSSLPSLKTLYLQNNQLTGSINVLANLPLDDLNVANNRFTGWIPDELKR

SEQ ID NO: 48493 - DNA, 654 bp, Panicum virgatum
  misc_feature: Ceres CLONE 2043801
  misc_feature: Encodes the peptide sequence at SEQ ID NO. 48494
acccaatccccagccgcagccgccacaaaccgagagagagagcacgagcagcggcgcgagttgcgagccgcggacgcgccgtcacctgcggcgcctcctcctcccatcgcagcctccttcgcttccttagcggttcagccatgggtaaggagaagtcccacatcaacatcgtggtcattggccacgtcgactccggcaagtcgaccaccaccggccacctgatctacaagcttggaggcatcgacaagcgtgtgatcgagaggttcgagaaggaggctgcggagatgaacaagaggtccttcaagtacgcgtgggtgcttgacaagctcaaggccgagcgtgagagaggtatcaccattgatatcgccctgtggaagttcgagaccaccaagtactactgcacggtcattgatgcccctggacaccgtgacttcatcaagaacatgatcacgggtacatcccaggctgactgtgctgtccttatcattgactccaccactggtggttttgaggccggtatctccaaggatggccagacccgtgagcatgctctccttgctttcactcttggagtcaagcagatgatctgctgctgcaacaaggtataattccagaaagttctatctcattcttcttcatgatccaagatgctct

SEQ ID NO: 48494 - protein, 155 aa, Panicum virgatum
  misc_feature: Ceres CLONE 2043801
  misc_feature (5)..(155): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKV

SEQ ID NO: 48495 - DNA, 557 bp, Panicum virgatum
  misc_feature: Ceres CLONE 2043803
  misc_feature: Encodes the peptide sequence at SEQ ID NO. 48496
cccgtctcgtctgcccttcgcacgacccccccccccccccaccccccccaccaccaccaaaaaaaaaaccaagtcgctctccactctccagtggggaggaggaggagacgggagcgatctgcggatcgaatccatggcgcggaccaactgggaggccgataagatgctcgacgtctacatctacgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccactcctccaccgccaaggcctcctcctccgccgccggggcgcctcctcccccccacctcgatatcaacaagtcgagggagcaccagatgaggctccagcttctgcaccagcacaacgcccaactccacaccagaggagctgcccctcctcccgcctccatcaatgccctcaactctgacgtctccgccgtccttgcttctaaaatgatggaggaccggatcaggaaccccaacc

SEQ ID NO: 48496 - protein, 141 aa, Panicum virgatum
  misc_feature: Ceres CLONE 2043803
  misc_feature (10)..(36): Pfam Name: LisH Pfam Description: LisH
MARTNWEADKMLDVYIYDYLVKRNLQATAKAFIAEGKVATDPVAIDAPGGFLFEWWSIFWDIFHSSTAKASSSAAGAPPPPHLDINKSREHQMRLQLLHQHNAQLHTRGAAPPPASINALNSDVSAVLASKMMEDRIRNPN

SEQ ID NO: 48497 - DNA, 252 bp, Panicum virgatum
  misc_feature: Ceres CLONE 2043826
  misc_feature: Encodes the peptide sequence at SEQ ID NO. 48498
agccatgcggtccctctccctcttctcgcgacaaacgcgccaccccaccacgccgccgccgccctccttctccggcggcgggggcgaggggcgggggcggaggttgaccacatataacaatgagctgattgcactcttattaaaatatattaaccaaagcaagagaatgcttcaacaccatcaactgctaaatgagtttgatacgctgtttgataaagacaaggaaaaatatgcaccctttgaatactttct

SEQ ID NO: 48498 - protein, 82 aa, Panicum virgatum
  misc_feature: Ceres CLONE 2043826
  misc_feature: SWISSPROT Homolog: EC 2.4.1.13 Sucrose synthase
MRSLSLFSRQTRHPTTPPPPSFSGGGGEGRGRRLTTYNNELIALLLKYINQSKRMLQHHQLLNEFDTLFDKDKEKYAPFEYF

SEQ ID NO: 48499 - DNA, 626 bp, Panicum virgatum
  misc_feature: Ceres CLONE 2043830
  misc_feature: Encodes the peptide sequence at SEQ ID NO. 48500
actcttctctgctttccggtctccgctcccgcaccaaaactcactcgaacaggcaatctccacctccccctcccgcaatctccgccgagctcccacctccgccgcgtcaatgaagccgccgcagtggaccgagctgcagcggttcaacccgggggatctcgtcgaggtggtccccgacgagcccggcgagcaaggggcccactacgcagccgtcgtcgtggagcgcagcacccagccctgcggctacaccgtcgagtacgacgacctcgtcgagcgagagggctccgaccgcccgctccgggaggtcgtgccggcgcagatcctccgcccgcacccgccgccacgctgcacctactcgggggaggctcccgtggagcacgccgccgtcgacgcgttcctcgacggcgcctggtggctcggggtctacctcggcttcgtggacgggggcgggaaggtcagggtgtgcttcccggatacgcgggaggtcatgaacttcgacgccgccgacgtccgaccccacttcgagtgggggtggggcggctcttttaggaagcgctccgccttgggcatggagatgaccgtggcagtgccgtacccgaaaggaatgacaattgaagtttccaagt

SEQ ID NO: 48500 - protein, 172 aa, Panicum virgatum
  misc_feature: Ceres CLONE 2043830
  misc_feature (12)..(80): Pfam Name: Agenet Pfam Description: Agenet domain
MKPPQWTELQRFNPGDLVEVVPDEPGEQGAHYAAVVVERSTQPCGYTVEYDDLVEREGSDRPLREVVPAQILRPHPPPRCTYSGEAPVEHAAVDAFLDGAWWLGVYLGFVDGGGKVRVCFPDTREVMNFDAADVRPHFEWGWGGSFRKRSALGMEMTVAVPYPKGMTIEVSK

SEQ ID NO: 48501 - DNA, 604 bp, Panicum virgatum
  misc_feature: Ceres CLONE 2043831
  misc_feature: Encodes the peptide sequence at SEQ ID NO. 48502
attgctggcgccgggctgcctcctccacttcccagccggaatccgcttccctcccccttcgttttgcttagttccggactttcggtggtatgagcagcggctggtgaattggtgagacgatgaggaaggcgctgctgctgctgctcgtcctctgctgcctcgccgccaccagcgaggcggtggcggtggtgggggaggaggaggcggcgtcggcgcgcctggctgttggtgtggacctgtcgtggcggttgccgagccggcggctggtggggggctacgtcgcgctgcagacgtggaagcagcaggccatcttctccgacccccgcaacttcaccgccgactgggtgggccccggggtctgcaactacaccggcgtcttctgcgcgcccctgccgcgcggggagcccggcgccggggagctcgccgtagcgggcatcgacctcaaccacggcgacatcgcggggtacctcccgtcggagctcggcctcctcgccgacctcgcgctgctgcacctcaactccaaccgcttctgcggcctcgtccccgccacgttctgccggctccgcgtcctcgtcgagctcgacctcagcaacaaccgcctcgt

SEQ ID NO: 48502 - protein, 161 aa, Panicum virgatum
  misc_feature: Ceres CLONE 2043831
  misc_feature: SWISSPROT Homolog: EC 2.7.11.1 Non-specific serine/threonine protein kinase
MRKALLLLLVLCCLAATSEAVAVVGEEEAASARLAVGVDLSWRLPSRRLVGGYVALQTWKQQAIFSDPRNFTADWVGPGVCNYTGVFCAPLPRGEPGAGELAVAGIDLNHGDIAGYLPSELGLLADLALLHLNSNRFCGLVPATFCRLRVLVELDLSNNRL

SEQ ID NO: 48503 - DNA, 609 bp, Panicum virgatum
  misc_feature: Ceres CLONE 2043833
  misc_feature: Encodes the peptide sequence at SEQ ID NO. 48504
attaccggctctgatgaccaaactgcgaaggtttgggattatcaaacaaagagctgtgttcaaacacttgaaggacatgcccataatgtctctgctgtttgtttccatcccgagcttccaataataatgacaggttcagaggatggaactgttcgtctatggcactcaactacctacaggtcctgctgtgtctgttctagtttgtggccttttgacactctttgtgtttacttcttgatatgtttagcgctcttgtattgtatttctatgcagaagtagtgctaatttgattgtaccaatcaaagttctcatgatcacacccagtgtagtgctatcatcagataaacaagccagcacaatgctacatgtgatttgagggggggaaacacactgttgtttaacaatggtgatagttggatgcagttaaaatttcccagccgaactgaaaactgcgactgactatttgaaaaatggagtggacttttgtatttaaataggggcatttgtgttcttacccctacttttaagtgtaattttgattttgcccccattttttttactttgtgatttttccctttactattcacaagtcagtgcgattttacccct

SEQ ID NO: 48504 - protein, 92 aa, Panicum virgatum
  misc_feature: Ceres CLONE 2043833
  misc_feature (17)..(55): Pfam Name: WD40 Pfam Description: WD domain, G-beta repeat
  misc_feature: SWISSPROT Homolog: EC 2.7.11.7 [Myosin heavy-chain] kinase
ITGSDDQTAKVWDYQTKSCVQTLEGHAHNVSAVCFHPELPIIMTGSEDGTVRLWHSTTYRSCCVCSSLWPFDTLCVYFLICLALLYCISMQK

SEQ ID NO: 48505 - DNA, 674 bp, Panicum virgatum
  misc_feature: Ceres CLONE 2043847
  misc_feature: Encodes the peptide sequence at SEQ ID NO. 48506
actcgatcgcctcttccgtcgggaggtcttggatggtgcccgcatgacacatgggttcgattagagattacaagtggaagcgtatgggtaccaaggaagcatcccctcctactgttctctgcctcttctttctgttctgcttaggctgcaaatgcttagcgtcagaattcgaagccacccagacagcaaccctcaaggttgatgcctcaccgcagcttgctcggaagattcctgatacactatttgggatcttttttgaggagatcaaccatgcaggagctggtggaatatgggctgaactcgttagtaacagaggttttgaagctggaggccctcatactccatcaaacatcaacccatggtccatcattggagatgactcttccatatttgtggcgactgatcgtacatcatgtttcagtcgaaacattgttgctctaaggatggaggtcctctgtgatgacggtccagctgggggtgttggcatttacaacccaggattctggggcatgaacatagaagatggaaagacatacaacctagttatgtatgttaagtcaccagaaacaacagacttgacagtttcattaacgagtgccgatgggtcgcaaaatctggcttcagctacggtcacagtttctggcacgtcaaattggacaaaactggagcagaag

SEQ ID NO: 48506 - protein, 207 aa, Panicum virgatum
  misc_feature: Ceres CLONE 2043847
  misc_feature: SWISSPROT Homolog: EC 3.2.1.55 Alpha-N-arabinofuranosidase
  misc_feature: Functional homolog of the protein sequence given in SEQ ID NO 51746
  misc_feature: Useful for making plants with altered carbohydrate content
  misc_feature: Functional homolog of the protein sequence given in SEQ ID NO 51313
  misc_feature: Useful for making plants with altered cell wall content and/or composition
MGSIRDYKWKRMGTKEASPPTVLCLFFLFCLGCKCLASEFEATQTATLKVDASPQLARKIPDTLFGIFFEEINHAGAGGIWAELVSNRGFEAGGPHTPSNINPWSIIGDDSSIFVATDRTSCFSRNIVALRMEVLCDDGPAGGVGIYNPGFWGMNIEDGKTYNLVMYVKSPETTDLTVSLTSADGSQNLASATVTVSGTSNWTKLEQ

SEQ ID NO: 48507 - DNA, 625 bp, Panicum virgatum
  misc_feature: Ceres CLONE 2043856
  misc_feature: Encodes the peptide sequence at SEQ ID NO. 48508
agaaaatgagctcaagggaaggccagcgccgcctggtctcgggttcctgaggaggagacgaggagtcaagcagcggcctggcccggagacgacgaccaagatttcctcttccgggggagcaccgcagcgaaccagagtcccactttccaaactcattgataatttaccaacatctgcataagttcatagcagcctttgaacaatttgagccaaaatgaagatagtgtttctcatgttgttgcttgtctccctgttcctcttccctaatgagatccacaagagcttagctgcaaggccttcagttgtgagtattggttctattcttcggtttaactccaccactggaggtgtttcagcagttgccatccgtgcggccttggaggatataaactctgatccgacagttctaaatggaacaacattacaagttgacatgagggatacaaattgcgatgatggtttcctcggaatggttgaagctttgcagttcatggagactgatgctattgcaatcattgggccacaatgctctactattgctcatatcatttcgtatgtcgcaaatgagctccaagtccctttgatgtcctttgcatccgatgcaactctatcatcaatccagttc

SEQ ID NO: 48508 - protein, 136 aa, Panicum virgatum
  misc_feature: Ceres CLONE 2043856
  misc_feature: SWISSPROT Homolog: EC 4.6.1.2 Guanylate cyclase
MKIVFLMLLLVSLFLFPNEIHKSLAARPSVVSIGSILRFNSTTGGVSAVAIRAALEDINSDPTVLNGTTLQVDMRDTNCDDGFLGMVEALQFMETDAIAIIGPQCSTIAHIISYVANELQVPLMSFASDATLSSIQ

SEQ ID NO: 48509 - DNA, 600 bp, Panicum virgatum
  misc_feature: Ceres CLONE 2043906
  misc_feature: Encodes the peptide sequence at SEQ ID NO. 48510
aagcggggctcgcatcgcgggaggacctcaggacccggcgccagctcactcgcgcacgcctcccccccccagatcccatctcgcgctcgccctccccggcgggggcccatggccaccgccgccaccgcctcgcacccggcctccgcctccacctccggccgcgacgcgctcgccgcggcctcctcctcccccgccgccgtctgcctcgtcccgttcaggtggtgggcgcgggtgcgggaggaggaggcggcgggcggggtgcggtacgcggccaccgccgcggcctcgccctcctactacggcctcaggctgctccacagcttcctgcacccggatctcgtcctgcgcctcgagcgcggggacggccgcgcgggcggcacaggcgcgggggggcgcagctacgcgctcgtccccgccgacgagctctccagggcgctcgccaggcagaactctggttttggtttgcaaaataagcattcgtttgctggagatagtgctggtgcttatcctttggtgcttaggatatctgtccgagaaacaagtattttgacactgaagattagcaaaaaggacaatccagttgagaactacaaacgagca

SEQ ID NO: 48510 - protein, 163 aa, Panicum virgatum
  misc_feature: Ceres CLONE 2043906
  misc_feature: SWISSPROT Homolog: EC 3.1.2.15 Ubiquitin thiolesterase
MATAATASHPASASTSGRDALAAASSSPAAVCLVPFRWWARVREEEAAGGVRYAATAAASPSYYGLRLLHSFLHPDLVLRLERGDGRAGGTGAGGRSYALVPADELSRALARQNSGFGLQNKHSFAGDSAGAYPLVLRISVRETSILTLKISKKDNPVENYKR

SEQ ID NO: 48511 - DNA, 652 bp, Panicum virgatum
  misc_feature: Ceres CLONE 2043932
  misc_feature: Encodes the peptide sequence at SEQ ID NO. 48512
gtccaaccctagccctacccgaatccccacctcctctccctgctcgccgtccccgccggatcgcgcgcctcgatccgccgaatccactccaattcgacgaccacagtcggttccggcgcccatttcgccggggatttttcgaccttcccgcagcagcagcaaaatggatcacttggatgagcatgacagtgatgaaatgaaagtaggggcggcctctgatggcaccggcaccagattgagaaagaagaggtctaagatctgggatgagtacaggcccatagttgttgatggagcgattcagagcgccgaatgcctatactgccatattcacatgagttgcagaggtgctgatgggcagtccaacggaacaagccatttgtggcgacaccagaaaatttgccgagcaaaagatgggttcggtccgagcctgctgcaacaggatgccaacttgccttacgtggtgaatgaagtagatccactggacaaaattcttccagattcacttgatgagataaacttggtgacccgtagtgagaatagcaaattcaggtcaaaggtatggaaggattttataccattctatgttgaagggagagtccagggtgctgactgtgtccattgccacaagcgactcagtgcagataaaggtaga

SEQ ID NO: 48512 - protein, 162 aa, Panicum virgatum
  misc_feature: Ceres CLONE 2043932
  misc_feature (30)..(80): Pfam Name: zf-BED Pfam Description: BED zinc finger
MDHLDEHDSDEMKVGAASDGTGTRLRKKRSKIWDEYRPIVVDGAIQSAECLYCHIHMSCRGADGQSNGTSHLWRHQKICRAKDGFGPSLLQQDANLPYVVNEVDPLDKILPDSLDEINLVTRSENSKFRSKVWKDFIPFYVEGRVQGADCVHCHKRLSADKG

SEQ ID NO: 48513 - DNA, 587 bp, Panicum virgatum
  misc_feature: Ceres CLONE 2043933
  misc_feature: Encodes the peptide sequence at SEQ ID NO. 48514
accgacattacatttgaagttgatggcgagatgtttcctgcccacaaggttgttctttcggctcggtctccagtttttagggcacaactttttggtcctatgaaggataagaatatgaagtgcattaagattgaagacatggaggctccagtattcaaggctttgctccatttcatgtactgggatgagttgccggatattgaagaacttactggtgtaaatacaacttgggtatccaccttgatggctcagcatttgcttgctgctgcggaccgttatgcattggagagattaaagttgctctgtgaacttaagctgtgtgaagatgttgcaataaacacagttgcaaacactttggcgctggctgaacagcaccactgttttcaactaaaaactgtttgcttgaaattcgtagctctgcctgagaatttgaaagctgtcatgcaaaccgatgggtttgattatttgcagcaaagctgcccgtcccttctgaccgagcttcttgagtatgtggccaaggtaggagagcactctgtcactccctgcttgtattcaactgaagtccttgatggtggcgatgccaatgg

SEQ ID NO: 48514 - protein, 195 aa, Panicum virgatum
  misc_feature: Ceres CLONE 2043933
  misc_feature (2)..(110): Pfam Name: BTB Pfam Description: BTB/POZ domain
  misc_feature: Functional homolog of the protein sequence given in SEQ ID NO 50896
  misc_feature: Useful for making plants with modulated biomass
TDITFEVDGEMFPAHKVVLSARSPVFRAQLFGPMKDKNMKCIKIEDMEAPVFKALLHFMYWDELPDIEELTGVNTTWVSTLMAQHLLAAADRYALERLKLLCELKLCEDVAINTVANTLALAEQHHCFQLKTVCLKFVALPENLKAVMQTDGFDYLQQSCPSLLTELLEYVAKVGEHSVTPCLYSTEVLDGGDAN

SEQ ID NO: 48515 - DNA, 156 bp, Panicum virgatum
  misc_feature: Ceres CLONE 2043935
  misc_feature: Encodes the peptide sequence at SEQ ID NO. 48516
ctggctttattgcctcccatgccgcgacccacaccgtgaagaacaaccctgacaaccagatactcgtcctccacaagcacgactactgctccaacctgaaaaaacggctctccgtgagctcgtcgtcaaacttcaagtttgccaagggcgacatcg

SEQ ID NO: 48516 - protein, 51 aa, Panicum virgatum
  misc_feature: Ceres CLONE 2043935
  misc_feature: SWISSPROT Homolog: EC 4.2.1.46 dTDP-glucose 4,6-dehydratase
  misc_feature: Functional homolog of the protein sequence given in SEQ ID NO 51125
  misc_feature: Useful for making plants with altered carbohydrate content
  misc_feature: Functional homolog of the protein sequence given in SEQ ID NO 51136
  misc_feature: Useful for making plants with altered cell wall content and/or composition
GFIASHAATHTVKNNPDNQILVLHKHDYCSNLKKRLSVSSSSNFKFAKGDI

SEQ ID NO: 48517 - DNA, 734 bp, Panicum virgatum
  misc_feature: Ceres CLONE 2043938
  misc_feature: Encodes the peptide sequence at SEQ ID NO. 48518
ctctcgaaaccctagtcccgctccaccccccgccgccgccgcagctcccccgtctcgccccccacctccggccctcgcgagtcgcgaagcgcctcctcgaccgccgggagtgagagaagagatggcgggcaagggcgacgggccggcgatcggcatcgacctcggcaccacctactcgtgcgtcggcgtgtggcagcacgaccgcgtcgagatcatcgccaacgaccaggggaaccgcaccaccccctcgtacgtcgccttcaccgactccgagcgcctcatcggagatgccgccaagaaccaggtcgccatgaaccccatcaacaccgtctttgatgccaagcgtctcatcggcagaaggttctctgatgcttctgtccagagtgatatcaagctctggcccttcaaggtcatttctggacctggtgagaagcccatgattgttgtccagcacaagggtgaggataagcagtttgctgctgaggagatctcctccatggttctgatcaagatgcgtgagattgctgaagcttaccttggcagcactatcaagaacgctgttgtcacagttcctgcctatttcaacgactcacagaggcaggccaccaaggatgctggggtgattgctggcctcaacgtgctacgtatcatcaatgagccgactgctgctgctattgcctatggtcttgacaagaagggcaccagtgtgggcgagaagaatgtcctcatctttg

SEQ ID NO: 48518 - protein, 204 aa, Panicum virgatum
  misc_feature: Ceres CLONE 2043938
  misc_feature (9)..(203): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEDKQFAAEEISSMVLIKMREIAEAYLGSTIKNAVVTVPAYFNDSQRQATKDAGVIAGLNVLRIINEPTAAAIAYGLDKKGTSVGEKNVLIF

SEQ ID NO: 48519 - DNA, 730 bp, Panicum virgatum
  misc_feature: Ceres CLONE 2043959
  misc_feature: Encodes the peptide sequence at SEQ ID NO. 48520
gtagcagaggtcaaaccaaaaagcccgcaccccgccgcaaccccggcccaacccaccgccgccaccgctctccaatggcggctccccttgcccttcaaaacggcctttcccctcgaccgatctccctcgcaatcttcctctagcgggagcggatcgagttgaatctgcggccgcgagagtgccgtggagcgagcaatggagggggtgtggaggaaggccaagaaggcgatgggcgccggcctgtgcgtgcacctccccgccgtcgccggcgaccgggagggcggcgccagcgagcgccgcgcgtcggatgcggtctccctggactctgcggcggcggcgcacgcatcggcgccgaacacgccggcggcgacggccacggcggaggccagcggcacccgcgcgctgcggaggtccaagtccggaggcaagtcctccaagagaatgtgcgctatatgttttgactccatgaagccgggtcatggacaagccctattcactgctgaatgttctcatatgtttcacttccactgcatctcctccagtgtgaaacatggaaaccatgtatgcccagtttgccgggcaaagtggaaagagatcccctttaatcgttcattatcttctatagttccccgtgggagaggtgggttgaatgtaaaccaagctcgattaccccagcaagatgcttacatggctcttctccgcccagttccaaaccgccagcgagaacctc

SEQ ID NO: 48520 - protein, 178 aa, Panicum virgatum
  misc_feature: Ceres CLONE 2043959
  misc_feature (84)..(127): Pfam Name: zf-C3HC4 Pfam Description: Zinc finger, C3HC4 type (RING finger)
  misc_feature: SWISSPROT Homolog: EC 2.7.11.25 Mitogen-activated protein kinase kinase kinase
MEGVWRKAKKAMGAGLCVHLPAVAGDREGGASERRASDAVSLDSAAAAHASAPNTPAATATAEASGTRALRRSKSGGKSSKRMCAICFDSMKPGHGQALFTAECSHMFHFHCISSSVKHGNHVCPVCRAKWKEIPFNRSLSSIVPRGRGGLNVNQARLPQQDAYMALLRPVPNRQREP

SEQ ID NO: 48521 - DNA, 429 bp, Panicum virgatum
  misc_feature: Ceres CLONE 2043961
  misc_feature: Encodes the peptide sequence at SEQ ID NO. 48522
taaatcccatcgagatcccttcctcctcctccatcgccggctgccgccgccgccctccatcactcgtcgggactagtgaccagatcccctcctcctcaatcgtccggggagagaccttgccggcaagggccgaggcctcctctctctctgctcctccacctagggttctgcgagatggggatagaagattaccatgtcatcgacctcgtcggggagggctcctttggcgaggtttacaagggcaggcgcaagtacactcgccagacggttgccatgaagatcattcttaagcatggcaagaccgataaagacatacacaaccttaggcaggagatcgagatcctaaggaaactcgaacacgagaacttaatcgaaatggtcgatgctttcgaaacctctcaagagttttgcgttgtcacaggaggtagc

SEQ ID NO: 48522 - protein, 84 aa, Panicum virgatum
  misc_feature: Ceres CLONE 2043961
  misc_feature: SWISSPROT Homolog: EC 2.7.11.1 Non-specific serine/threonine protein kinase
MGIEDYHVIDLVGEGSFGEVYKGRRKYTRQTVAMKIILKHGKTDKDIHNLRQEIEILRKLEHENLIEMVDAFETSQEFCVVTGG

SEQ ID NO: 48523 - DNA, 742 bp, Panicum virgatum
  misc_feature: Ceres CLONE 2044000
  misc_feature: Encodes the peptide sequence at SEQ ID NO. 48524
atcctctatctcaattctcacgtaccttctctcccgtggagaccgagacccaacggccggccagactttcggggttgtcccgccatggatgggacaaatgatggaagcccttcatctaaacttcatacaagactgaggctttgggagtttcctgactgttatatattggaaccaattgatggccttgctgacttgttcttgtcagttagccgagccaatggaacaatgaatctggttgaagcgctgccaccatgtggatcatcaacacctaaagttcaaacagtttatggtgtgataggagtgctcaagcttgcagttggatcattttttctggtgatcacagatcgtgattgtgtgggatcctacttgggacacgctatttttaaagtcacaggactaaaagttcttccctgcaacaatgcacttaacacaacttctgctgaacagaaaaaaatggaaagtgaattctcggaactcctggatgctgcagagaggactatcggccttcacttctcctatgatatcaaccttacactctctgcacagaggctacatgatcttggtgatgagtataaatcacttcccctttggagacaggctgaaccaagatttctatggaacagttacttgttggaacctctaattgagaacaagctgaaccagtacttattgccagtaattcaaggcagttttcaaacatgcatgcagaagttgggtcagaaaagtttaatgtgaccctgat

SEQ ID NO: 48524 - protein, 216 aa, Panicum virgatum
  misc_feature: Ceres CLONE 2044000
  misc_feature (67)..(215): Pfam Name: Syja_N Pfam Description: SacI homology domain
MDGTNDGSPSSKLHTRLRLWEFPDCYILEPIDGLADLFLSVSRANGTMNLVEALPPCGSSTPKVQTVYGVIGVLKLAVGSFFLVITDRDCVGSYLGHAIFKVTGLKVLPCNNALNTTSAEQKKMESEFSELLDAAERTIGLHFSYDINLTLSAQRLHDLGDEYKSLPLWRQAEPRFLWNSYLLEPLIENKLNQYLLPVIQGSFQTCMQKLGQKSLM

SEQ ID NO: 48525 - DNA, 658 bp, Panicum virgatum
  misc_feature: Ceres CLONE 2044018
  misc_feature: Encodes the peptide sequence at SEQ ID NO. 48526
tctgtttcttgaaccgttcccttctctcggactctctcctgtctcctcccttactctcccttccctggcggcgacgaccgagcggcggcgtcatttgtcctgtcttggcccaaccctttgccagcgacgagcgcatcctccagtttcaacaatgaagatgatcgctgcctacctgctcgctgtcctgggtggaaacacttcccccactgctgatgacgttaaaaacattctggaatcagttggggctgaagctgatgaagagaaactggacttcctgctcacagaactcaaaggcaaggacataacagaagtgattgcagctggaagggaaaagttcgcctccgtgccttcaggtggtggtgcaattgctgtgggagctccggctgctgcagctggtggtgctgcacctgctgaagaggcaaagaaggaagagaaggttgaagagaaggaggaatcagatgacgatatgggtttcagcttgttcgattaagcactgctgccctgcatgtagtttcttcgcacgtatggtctgatacaccggtcggtatctgcaaaataaccatgccgagaaactagtatcagtgtgctattttgcttgtgataatggcatgtctagtactttggtgtcatgatatgcgagtatgcagtcctctgtgct

SEQ ID NO: 48526 - protein, 112 aa, Panicum virgatum; identical to SEQ ID NO: 12915
  misc_feature: Ceres CLONE 2044018
  misc_feature (17)..(111): Pfam Name: Ribosomal_60s Pfam Description: 60s Acidic ribosomal protein
  misc_feature: Functional homolog of the protein sequence given in SEQ ID NO 50285
  misc_feature: Useful for making plants with altered oil content
  misc_feature: Useful for making plants with modulated biomass

SEQ ID NO: 48527 - DNA, 755 bp, Panicum virgatum
  misc_feature: Ceres CLONE 2044019
  misc_feature: Encodes the peptide sequence at SEQ ID NO. 48528
aagaacattcgccctccctcctccggctcgccgccaccaccggcgctctccctccccccttcacttcacctcaccccccatggctatagtccctccacccgcacaccctcgtcatccctaaccctagatcccacccccactctcacacctcaatcacaaacacagaccgcactacgccactcctaccgtgcccctccaatctcctccgtccgtctccatggaggcgggcaacggcaccggctgcagcgcccgtacgctggcggcgtgcgtcattggcggcatcgtgctgggcgcatccgtgctcgcgctccacctcgcggggcccgtgtcccttccgtccctgctgccgctcgacgcggtcaggcgccggctccgccgccgccgccgccgccgccccgtgcgcgtctacatggacggctgcttcgacatgatgcactacggacactgcaacgcgctgcgccaggcgcgcgccctcggggacgagctcatcgtcggcgtcatcagcgacgaagagatcaaggcaaacaaagggccgcctgttacgcccctccacgagagaatgataatggtcagtgctgtgaaatgggtggatgatatcattccagatgcaccttatgccataaccgaagaattcatgaacaagctattcactgagtacaacatagattacattatccatggtgacgatccttgcttgctacccgatggcactgatgcatatgcccttgccaaaaaggctggccgatataagcaga

SEQ ID NO: 48528 - protein, 179 aa, Panicum virgatum
  misc_feature: Ceres CLONE 2044019
  misc_feature (64)..(173): Pfam Name: CTP_transf_2 Pfam Description: Cytidylyltransferase
  misc_feature: SWISSPROT Homolog: EC 2.7.7.14 Ethanolamine-phosphate cytidylyltransferase
MEAGNGTGCSARTLAACVIGGIVLGASVLALHLAGPVSLPSLLPLDAVRRRLRRRRRRRPVRVYMDGCFDMMHYGHCNALRQARALGDELIVGVISDEEIKANKGPPVTPLHERMIMVSAVKWVDDIIPDAPYAITEEFMNKLFTEYNIDYIIHGDDPCLLPDGTDAYALAKKAGRYKQ

SEQ ID NO: 48529 - DNA, 704 bp, Panicum virgatum
  misc_feature: Ceres CLONE 2044040
  misc_feature: Encodes the peptide sequence at SEQ ID NO. 48530
gcttcgcatccattccttctgcaagacactgactgcttcagacacaagcacacatggtggattctcggtgttgcgccggcatgcggatgagtgcctccctcccctggatatgagtcagcatcccccaaatcaagagctagtggccaaggacctgcatggggttgaatggcgctttcgtcacatctttcgaggtcagccacggagacaccttcttcagagtggttggagtgtttttgttagtgccaagcgtctcgttgctggggatgccttcatatttctcagaggtgagaacggggagctacgtgttggagttaggcgggcattgaggcaccaaaccactatcccatcttcagtcatttcaagccacagtatgcatcttggtgttcttgcaacagcatggcatgcagtgaacactgggagtatgttcactatctactacaagccaaggactagtccagccgaattcgtggtctcacgtgataggtactatgaatcactgaaacgaaattattcaatagggatgagattcaagatgagatttgaaggcgaagaggcagcagagcagaaattcactggaacaatagttggaataggtgcttctgatccatctggctgggctgattcgaaatggcgttcccttagggtgagatggggatgaagctcttccgttcctcgtccggaaagagtttctgcttggcaaataa

SEQ ID NO: 48530 - protein, 218 aa, Panicum virgatum
  misc_feature: Ceres CLONE 2044040
  misc_feature (132)..(214): Pfam Name: Auxin_resp Pfam Description: Auxin response factor
  misc_feature (5)..(110): Pfam Name: B3 Pfam Description: B3 DNA binding domain
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Functional homolog of the protein sequence given in SEQ ID NO 50313
  misc_feature: Useful for making plants with modulated seed size
  misc_feature: Functional homolog of the protein sequence given in SEQ ID NO 50311
  misc_feature: Useful for making plants with modulated biomass
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature: Functional homolog of the protein sequence given in SEQ ID NO 50312
  misc_feature: Useful for biocontainment applications
  misc_feature: Useful for making plants with modulated flowering time
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: The sequence is a functional homolog of SEQ ID NO 100 in the 10/666,642 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 576 in the 10/666,642 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 696 in the 11/479,226 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 630 in the 10/412,699 US patent application
LRIHSFCKTLTASDTSTHGGFSVLRRHADECLPPLDMSQHPPNQELVAKDLHGVEWRFRHIFRGQPRRHLLQSGWSVFVSAKRLVAGDAFIFLRGENGELRVGVRRALRHQTTIPSSVISSHSMHLGVLATAWHAVNTGSMFTIYYKPRTSPAEFVVSRDRYYESLKRNYSIGMRFKMRFEGEEAAEQKFTGTIVGIGASDPSGWADSKWRSLRVRWG

SEQ ID NO: 48531 - DNA, 655 bp, Panicum virgatum
  misc_feature: Ceres CLONE 2044043
  misc_feature: Encodes the peptide sequence at SEQ ID NO. 48532
atccgcaaaaagccaaacattccgcccttcgccgccgccgctttcgatcttctccccgcgcgccccgaagtccgaaccggcgaacctcgcggccaccgctggagattcgcccacgcccggcgccgccgtccgcgtcggccccgagctcgagctcaccggctacggctgcgaggaccacttcctcgagcaggacaccaccgcgcacgcatgggagtgcttaaaggacattttaactggggactatacagacaacatcttatgcagcataggaatgccagttattttcaatagcgtacggtataattgccaagtcttctgcctaaatcgcaagataatcatgattcaaccaaagatatcccttgcaaatgatggaaattatcgggaatttcggtggttttctgcttggacatttaaagatgagattgttgagtttcaactccctattgaagtttcagaggctatatcccaggatactgtaccttttggttatggttacatgcagtttttagatgtatctttggctgctgaaacctgtgaagagctctttactgcacatgctcctcggattgatttagcattgaatggtgttgaggttttcatgaatgcgagtggaagtcaccatccgctgaggaagctcaatctttctattgattcc

SEQ ID NO: 48532 - protein, 217 aa, Panicum virgatum
  misc_feature: Ceres CLONE 2044043
  misc_feature (13)..(204): Pfam Name: CN_hydrolase Pfam Description: Carbon-nitrogen hydrolase
  misc_feature: SWISSPROT Homolog: EC 6.3.5.1 NAD(+) synthase (glutamine-hydrolyzing)
SAKSQTFRPSPPPLSIFSPRAPKSEPANLAATAGDSPTPGAAVRVGPELELTGYGCEDHFLEQDTTAHAWECLKDILTGDYTDNILCSIGMPVIFNSVRYNCQVFCLNRKIIMIQPKISLANDGNYREFRWFSAWTFKDEIVEFQLPIEVSEAISQDTVPFGYGYMQFLDVSLAAETCEELFTAHAPRIDLALNGVEVFMNASGSHHPLRKLNLSID

SEQ ID NO: 48533 - DNA, 715 bp, Panicum virgatum
  misc_feature: Ceres CLONE 2044061
  misc_feature: Encodes the peptide sequence at SEQ ID NO. 48534
tatttatctggaacgacaataaccaacttcttttgggaattcgtcgtgcaaatcgtccacagactgttatgccctcatctgtgctatcaagtgatagcatgcatattggtcttcttgcagcagcagctcatgctgcggccacaaacagtcgtttcactattttctacaatcctcgggctagcccttctgagtttgtcattccactggctaagtatgtgaaagctgtttaccacacacgtgtgtctgttggaatgcgatttcgaatgctttttgagacagaggaatcaagtgtcagacgatacatgggtacgatcacaggcataagcgatcttgactcggagcgatggccaaactcacactggcgttctgtgaaggttggttgggatgaatctacagctggtgataagcaaccaagggtttcactctgggagattgaaccattgacaacctttccgatgtaccctactgcctttccattaagacttaagcgtccgtgggcttcaggactacccatgttcaatggcgggaggagtgatgagtttgctcgttattcttctctcatgtggcttcgagatggaaacagagggtcccagtctttgaacttccagggacttggagtgtcaccatggcttcagccaagaatagattatccattgctgggtctgaagccagatacttaccagcagatggctgctgcggcactggaagaaattaa

SEQ ID NO: 48534 - protein, 237 aa, Panicum virgatum
  misc_feature: Ceres CLONE 2044061
  misc_feature (41)..(124): Pfam Name: Auxin_resp Pfam Description: Auxin response factor
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Functional homolog of the protein sequence given in SEQ ID NO 50498
  misc_feature: Useful for making plants with modulated light quality sensitivity
FIWNDNNQLLLGIRRANRPQTVMPSSVLSSDSMHIGLLAAAAHAAATNSRFTIFYNPRASPSEFVIPLAKYVKAVYHTRVSVGMRFRMLFETEESSVRRYMGTITGISDLDSERWPNSHWRSVKVGWDESTAGDKQPRVSLWEIEPLTTFPMYPTAFPLRLKRPWASGLPMFNGGRSDEFARYSSLMWLRDGNRGSQSLNFQGLGVSPWLQPRIDYPLLGLKPDTYQQMAAAALEEI

SEQ ID NO: 48535 - DNA, 631 bp, Panicum virgatum
  misc_feature: Ceres CLONE 2044087
  misc_feature: Encodes the peptide sequence at SEQ ID NO. 48536
aaccccttcctccgctttcccttcgcgcgcacgcctcctccgcgatttcgtcgagcaccccccgcgccgcgccgcgccgcgccatgccgccgcccgcaggcgcgtcctgctccggcgccggctccgaagaacccgagtccccggcggcacgccgcctccgccgcctctccctgcacctcctccacctcgagccctcccccgccccggccgatcaggcggcgggcccggcgctggcccccgcggcgtgcgcggggcgggtgcggcgcgtcgagggcggcgcggacgtggcggcggcgctggcggcgtacctgcggggccggcaccgcgcggcgcagctgcggctgttcgacttcctccgcgcgcgcccggacctgcagacgcccgtggagctcgccacggccgcgcaccaggagctctgcttccgccagctgcgcgcgctggtgcgggacgccggggtgcgcccgctcacgctcatggccaccgaccccgccgagtacttcgccgtcatggaggccgccggcggcgccgacatctccctcggcgtcaagctgggcgtccagtacagcctctggggaggttctgtcataaatttaggaaccaaaaagcacagagataagttctttgatggaat

SEQ ID NO: 48536 - protein, 182 aa, Panicum virgatum
  misc_feature: Ceres CLONE 2044087
  misc_feature: SWISSPROT Homolog: EC 1.3.3.6 Acyl-CoA oxidase
MPPPAGASCSGAGSEEPESPAARRLRRLSLHLLHLEPSPAPADQAAGPALAPAACAGRVRRVEGGADVAAALAAYLRGRHRAAQLRLFDFLRARPDLQTPVELATAAHQELCFRQLRALVRDAGVRPLTLMATDPAEYFAVMEAAGGADISLGVKLGVQYSLWGGSVINLGTKKHRDKFFDG

SEQ ID NO: 48537 - DNA, 733 bp, Panicum virgatum
  misc_feature: Ceres CLONE 2044088
  misc_feature: Encodes the peptide sequence at SEQ ID NO. 48538
acatgtgaggcggggagagctgtcgaaagataccgcgggggggcgatgagctgtgcgtgggagagcaggcacattgcccccagctagcagcagcagcgcggcgcgcaaggcaacaaaggaaaggagccccaacccaagcaagcgcggcgcccctcccccttctccccactccctcccctcttccgcgttcagttcccacccccattccctcctgccgccgccgccgccgcacgcgcgcctccctcactcggccggcggggtagccagaggaggagccgcctgagatctggagatctggtagtgcgagggggatggaggccagcgccgggctggtcgccggctcgcacaaccggaacgagctcgtcgtcatccgccgcgatggcgagccagggctgaagccgctgaaccagcagaacgggcaggtgtgccagatttgcggcgacgacgtggggctcaatcccgacggcgagcccttcgtcgcctgcaacgagtgcgccttccccatctgccgggactgctacgagtacgagcgccgcgagggcacgcagaactgcccgcagtgcaagacccgcttcaagcgcctcaaggggtgcgcgcgtgtaccgggggatgaggaggaggacggcgtcgatgacctggagaacgagttcaactggacggacaagcacgactcccagtatgtcgccgagtccatgctccacgcccacatgagctaccgccgcggcgcccactt

SEQ ID NO: 48538 - protein, 140 aa, Panicum virgatum
  misc_feature: Ceres CLONE 2044088
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Functional homolog of the protein sequence given in SEQ ID NO 51500
  misc_feature: Useful for making plants with altered cell wall content and/or composition
  misc_feature: Useful for making plants with modulated biomass
  misc_feature: Functional homolog of the protein sequence given in SEQ ID NO 50124
  misc_feature: Useful for making plants with altered carbohydrate content
MEASAGLVAGSHNRNELVVIRRDGEPGLKPLNQQNGQVCQICGDDVGLNPDGEPFVACNECAFPICRDCYEYERREGTQNCPQCKTRFKRLKGCARVPGDEEEDGVDDLENEFNWTDKHDSQYVAESMLHAHMSYRRGAH

SEQ ID NO: 48539 - DNA, 647 bp, Panicum virgatum
  misc_feature: Ceres CLONE 2044139
  misc_feature: Encodes the peptide sequence at SEQ ID NO. 48540
cacggcactgcaaccacgttcgctgagcgcggtaggcgccacctagcagacatacttgggttcgctagctgcaaggctgctgcctgctggccgagatcgattccacccgaccatcaggagggattgagatcgtctcgttaaattgtgccagggccgaggcgctgcttgagcgcaggtagcgtgtgaatgaagtgtggcaattcacatgcataatcacattcgcaatgcttctatcgcttgccctcctgctgttgctgtgccaaggaaccggccacctctacggccacggccacagcagccgtgacatgctcgcgctactcgatttcaagaaggccatctccggcaataagccgaacagagccttgagctcctggaacacgagcacccctttctgccagtggaagggagtcttatgctcgagggagcacccagggcgtgtcgtcaagctacaccttcaccaccaaggcctgtcggggcctatttccccgtacctcggaaacctgacgctgctcagggaactaaacctctcccgcaacaacttgtctggccggtttcctcctctcaaccgtcttcacgccttggaggtcattgatctggcagaaaactcgctgcgtggcacaatcccgggtacgctcgcaaactgtttc

SEQ ID NO: 48540 - protein, 140 aa, Panicum virgatum
  misc_feature: Ceres CLONE 2044139
  misc_feature (24)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLSLALLLLLCQGTGHLYGHGHSSRDMLALLDFKKAISGNKPNRALSSWNTSTPFCQWKGVLCSREHPGRVVKLHLHHQGLSGPISPYLGNLTLLRELNLSRNNLSGRFPPLNRLHALEVIDLAENSLRGTIPGTLANC

SEQ ID NO: 48541 - DNA, 634 bp, Panicum virgatum
  misc_feature: Ceres CLONE 2044166
  misc_feature: Encodes the peptide sequence at SEQ ID NO. 48542
accgccgcctcctcgcgtcacccagatgccgccgccgccgggctcgtctgcgcccgcgccggagcggcgcctcgccgtgctcctctcccacttccgcccgacccgcgaggccccgcgcgccaccatccgcctcgccagcgccgagcgccacgggaccgcggccgcggcggaggccgaggccgaggccgaggccgaggcggggctctctgcttccccctgcgccgccggaggaagcgggtcctctggaggcggacactgtgtgttctgcaacatcgtcgcgggcgccgcaccggccttcaagctctacgaggatgatgagtgcgtgtgcatcctggatgttaaaccactaacaactgggcattccctgatcattccgaaaagccactatccctcactgcaaacaacaccaccaacagtactagcagctatctgctctaaactgccactcctgggtactgcaataatgaaggctactcaatgtgatgcattcaatgtgctaatcaacaatggagagaaggcagggcaggttatttttcatactcatgtccacatcattccccgtagcaaagatgataacctgtggtcttcagagacctactcaaggaaccctatctcgcatggccaggaaactaag

SEQ ID NO: 48542 - protein, 202 aa, Panicum virgatum
  misc_feature: Ceres CLONE 2044166
  misc_feature (85)..(182): Pfam Name: HIT Pfam Description: HIT domain
  misc_feature: SWISSPROT Homolog: EC 3.6.1.17 Bis(5'-nucleosyl)-tetraphosphatase (asymmetrical)
MPPPPGSSAPAPERRLAVLLSHFRPTREAPRATIRLASAERHGTAAAAEAEAEAEAEAGLSASPCAAGGSGSSGGGHCVFCNIVAGAAPAFKLYEDDECVCILDVKPLTTGHSLIIPKSHYPSLQTTPPTVLAAICSKLPLLGTAIMKATQCDAFNVLINNGEKAGQVIFHTHVHIIPRSKDDNLWSSETYSRNPISHGQET

SEQ ID NO: 48543 - DNA, 733 bp, Panicum virgatum
  misc_feature: Ceres CLONE 2044169
  misc_feature: Encodes the peptide sequence at SEQ ID NO. 48544
caagcgctagttgcatagcagagctagcgatccaaaagtccctgagattttcctagatctcgagttcgcctgctagtttcgattccttcttcttctcccgttcgagcaagcgattccggtggcaatggccaagggcgagggaccggcgatcgggatcgatctcggcaccacctactcgtgcgtcggcgtgtggcagcacgaccgggtggagatcatcgccaacgaccaggggaaccgcaccacgccgtcgtatgtcgccttcaccgacaccgagcgtctcatcggcgacgccgccaagaaccaggtcgccatgaaccccaccaacaccgtcttcgacgcgaagcggttgattggtaggaggttctctgacccttcagtgcagagtgacatgaagctgtggccgttcaaggtcatccctggccccggtgacaagcccatgattgttgtcaactacaagggcgaggagaagcaattcgctgccgaggagatctcctccatggtgctcataaagatgagggagattgctgaagcctacctcggcaccacaatcaagaatgctgtggtgacggtgccggcctacttcaacgactcgcagaggcaggccaccaaggacgctggtgtcattgccggcctcaatgtcctgcgtatcatcaacgagcccacagctgctgctattgcctatggtcttgataagaaggccagcagcgctggagagaagaacgtgctcatcttc

SEQ ID NO: 48544 - protein, 202 aa, Panicum virgatum
  misc_feature: Ceres CLONE 2044169
  misc_feature (8)..(202): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVIPGPGDKPMIVVNYKGEEKQFAAEEISSMVLIKMREIAEAYLGTTIKNAVVTVPAYFNDSQRQATKDAGVIAGLNVLRIINEPTAAAIAYGLDKKASSAGEKNVLI

SEQ ID NO: 48545 - DNA, 631 bp, Panicum virgatum
  misc_feature: Ceres CLONE 2044175
  misc_feature: Encodes the peptide sequence at SEQ ID NO. 48546
gagcggcactgtactaccaaaaccagctttgggtgctcggatcaacaccctccaaggcagagataaagagcattgtcacgtggcttcaggagaaccatgatggttcaactgggctgagtaccgacagcttagtggaagcgggttatcctggtgctgctgcacttcgtgaggttgtgtgtggcatggcagccataaagatctcttccaaagatttcatcttctggttccgagcccacacagcaaaggagatcaagtggggtggaagtaagcatgaaacggtcgatgcagatgagaacggccggcagatgcatccacgatcttcattcaaggcattcttggaggtggttaaatggagaagtgttccctgggaggatgttgaaatggacgctatccattctttgcagttaatattacgcggctccctgcaagataaagatgccaacaaaaacaatgtaatgtccattgtagaagctccatctgaggatacaaagaatatacaggggctacttgagctaagaacagttacaaacgagatggtccgcttaattgagacagcaactgcccctatctttgctgttgacattgacggtaacataaatgggtggaataataaagtcgcagaactcactgg

SEQ ID NO: 48546 - protein, 209 aa, Panicum virgatum
  misc_feature: Ceres CLONE 2044175
  misc_feature (1)..(146): Pfam Name: Phytochrome Pfam Description: Phytochrome region
  misc_feature: SWISSPROT Homolog: EC 2.7.11.1 Non-specific serine/threonine protein kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
  misc_feature: Functional homolog of the protein sequence given in SEQ ID NO 51566
  misc_feature: Useful for making plants with altered low light response
  misc_feature: Useful for making plants with modulated flowering time
  misc_feature: Functional homolog of the protein sequence given in SEQ ID NO 51512
  misc_feature: Useful for making plants with modulated nitrogen use efficiency
AALYYQNQLWVLGSTPSKAEIKSIVTWLQENHDGSTGLSTDSLVEAGYPGAAALREVVCGMAAIKISSKDFIFWFRAHTAKEIKWGGSKHETVDADENGRQMHPRSSFKAFLEVVKWRSVPWEDVEMDAIHSLQLILRGSLQDKDANKNNVMSIVEAPSEDTKNIQGLLELRTVTNEMVRLIETATAPIFAVDIDGNINGWNNKVAELT

SEQ ID NO: 48547 - DNA, 665 bp, Panicum virgatum
  misc_feature: Ceres CLONE 2044183
  misc_feature: Encodes the peptide sequence at SEQ ID NO. 48548
ccaatacttcatcggtgttcaactagatggaagtgaccatctcgaaccccttacgaatcgtctctctgagaacaccgagctacaaagtgctaaattggtcaaagctacagcggagaatgtggatgaagcagtcagagagcttcctgatcccaacttgagaccagaggacctgtgggcaattcactctcaacctgtttctccaaaacctcacaaacgacttaattcttcttggatagcgatagaaaagcggactttcagaactagtggccgctggcaagaagctctccacttgactacatcaatacaaagctaagtggatggatgtcaattcacattccatacccttatagcaaagttcaatgatatttgatgaactctggcaaagtggcaattgccatgccagctcaacaaactgataagcccatccgtgcccttcagtaatttatttctcccactgatttctcacgaaaagaaaaagaaaagaacttttgtcccatgttatgaagggtacggtggtgcttgttccatatatatatagaaccattaagtaatgatgtacaatttaaattatttatttaataatgaagccagttcttcagtttgagtaattttgctcctgtcatgtttgtgctagcttgattctagaacttacctcgtatgaatac

SEQ ID NO: 48548 - protein, 103 aa, Panicum virgatum
  misc_feature: Ceres CLONE 2044183
  misc_feature: SWISSPROT Homolog: EC 2.7.11.1 Non-specific serine/threonine protein kinase
  misc_feature: Functional homolog of the protein sequence given in SEQ ID NO 51310
  misc_feature: Useful for making plants with modulated light quality sensitivity
QYFIGVQLDGSDHLEPLTNRLSENTELQSAKLVKATAENVDEAVRELPDPNLRPEDLWAIHSQPVSPKPHKRLNSSWIAIEKRTFRTSGRWQEALHLTTSIQS

SEQ ID NO: 48549 - DNA, 640 bp, Panicum virgatum
  misc_feature: Ceres CLONE 2044197
  misc_feature: Encodes the peptide sequence at SEQ ID NO. 48550
atgtgggaatagataaagcttatttgtgctgtgcctgaatcggctcttctggtggatacccaagggtgttatgcgctgtttcttgcttcagattgaaggagaggaagcctctcgtttgtctaaacagcaccaggaacgtgaggaagctcgtcaatatgctgctgctgatttctctgaagatctatctgaaggcgaaaaaggagaaaacagtaatgaaccatctattcacgatgagaggacaatgacacggatgccaaggattggttcaactgatgctattgaagcatgggcaagccagcacaaagataaaaaattgtacattgtattgataagcattcacggcctaatacgcggtgagaatatggagctagggcgggactcagatacaggtggtcaggtcaaatatgttgtagaacttgctagggctttaggttcaacaccaggcatatacagagtggatctacttacaaggcagatttctgcacctgatgttgattggagttatggggaacctactgagatgctcagtccaatatgttcagagaactttgggcatgagatgggcgaaagcagtggtgcctacattgttcgtataccatttggaccaagagataaatatatccctaaagagcatctgtgg

SEQ ID NO: 48550 - protein, 189 aa, Panicum virgatum
  misc_feature: Ceres CLONE 2044197
  misc_feature: SWISSPROT Homolog: EC 2.4.1.14 Sucrose-phosphate synthase
  misc_feature: Functional homolog of the protein sequence given in SEQ ID NO 50680
  misc_feature: Useful for making plants with altered cell wall content and/or composition
  misc_feature: Useful for making plants with modulated biomass
  misc_feature: Useful for making plants with modulated carbohydrate content
MRCFLLQIEGEEASRLSKQHQEREEARQYAAADFSEDLSEGEKGENSNEPSIHDERTMTRMPRIGSTDAIEAWASQHKDKKLYIVLISIHGLIRGENMELGRDSDTGGQVKYVVELARALGSTPGIYRVDLLTRQISAPDVDWSYGEPTEMLSPICSENFGHEMGESSGAYIVRIPFGPRDKYIPKEHL

SEQ ID NO: 48551 - DNA, 653 bp, Panicum virgatum
  misc_feature: Ceres CLONE 2044210
  misc_feature: Encodes the peptide sequence at SEQ ID NO. 48552
tctccgctcctacaaccagtgcgccttcgcgcctctgcctccgccccgccgccgcacgcgcacgcgcacgcgcacgccgcgtcgcgctgccgcggcagcgcgcggaaccctaggatcgcgggctggccgggcttacggctctggcgccgccgcctgagaccatggcgtcctgcgggtgcctggtgctcgagaaggtggaggaccacagcggcgaggcggcgcgcgggagggtcaaggtggcgccgtccgccgcctccgggtgcggcggatcgtgcgccggggtgtggaggagaaggtccgaggctattttccccatctacgtcatggggagctcgcgggcgagcaccgtggcggcggcgcggggcatcgtcgactctgccgacgaccccatatgggaggccgtcaagtcggaggccaagtctgaggcagaaaaggagcctattttaagtagcttcctgtacgccagtgtgttatctcatgactgtctggagcgagcgttgagcttcgtccttgcaaacaggcttgaagatccaacattgcttgctactcagctaatcgatatttttaatgatgttatgatgaataacaaagatatatgtcgttccattcgccttgatgctcaggccttcaaagacagagatccagcctgtgcg

SEQ ID NO: 48552 - protein, 163 aa, Panicum virgatum
  misc_feature: Ceres CLONE 2044210
  misc_feature (77)..(163): Pfam Name: SATase_N Pfam Description: Serine acetyltransferase, N-terminal
  misc_feature: SWISSPROT Homolog: EC 2.3.1.30 Serine O-acetyltransferase
MASCGCLVLEKVEDHSGEAARGRVKVAPSAASGCGGSCAGVWRRRSEAIFPIYVMGSSRASTVAAARGIVDSADDPIWEAVKSEAKSEAEKEPILSSFLYASVLSHDCLERALSFVLANRLEDPTLLATQLIDIFNDVMMNNKDICRSIRLDAQAFKDRDPAC

SEQ ID NO: 48553 - DNA, 287 bp, Panicum virgatum
  misc_feature: Ceres CLONE 2044217
  misc_feature: Encodes the peptide sequence at SEQ ID NO. 48554
aaccgggcggggctcaggcagctgccattggatcctgatacggtcaggtatttgagcaagagggtcaaggagggctaccacaatgattttgtgattgatgtggatcaacagtggctgctgcaggggtggaagggacgcatactctgtgccatgtccacatgggttgcagatgatgatgctatatgatcatgagtttcgatgcttgccatgtaatttgtcgatggattcttttaaaacaagtgaggatgcttcgattggcaattgagaaataagaacaaaattttcat

SEQ ID NO: 48554 - protein, 61 aa, Panicum virgatum
  misc_feature: Ceres CLONE 2044217
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: The sequence is a functional homolog of SEQ ID NO 1938 in the 10/412,699 US patent application
  misc_feature: The sequence is a functional homolog of SEQ ID NO 2202 in the 10/374,780 US patent application
NRAGLRQLPLDPDTVRYLSKRVKEGYHNDFVIDVDQQWLLQGWKGRILCAMSTWVADDDAI

SEQ ID NO: 48555 - DNA, 652 bp, Panicum virgatum
  misc_feature: Ceres CLONE 2044242
  misc_feature: Encodes the peptide sequence at SEQ ID NO. 48556
ggttgagtcgttagcagtttgcaatgtggacattgttgcctgcggggagttccacacttgtgctgtcacaacagctggggaactgtacacctggggtgatggaacacataatattggacttctaggcaatggtactgatgtaagccactggattccaaaaagaatttcaggagcacttgatggtcttcaagttgcctatgtttcttgtgggacctggcatacagccttgattacatctagaggccagctatttacattcggtgatggtacatttggagtcttaggacatggaaaccgcgagagtattttgtgtccaagggaggtagagtctttatcggggttaaagacaattgctgttgcatgcggtatatggcacactgcggctgttgtagaagttatagtgacccaatccagttcaagtatatcttctggaaagctcttcacatggggagatggcgacaaacatcggcttggtcatggtgacaaggaacaaaggcttaagcctacatgcgtggcctcacttattgattatgatttctataggatagcatgtggtcatagtcttaccataggcctgacaacatctggacaagttctgagcatgggtaatactgtttatggccagcttgggaatccccgctcagatggtaaa

SEQ ID NO: 48556 - protein, 216 aa, Panicum virgatum
  misc_feature: Ceres CLONE 2044242
  misc_feature (143)..(192): Pfam Name: RCC1 Pfam Description: Regulator of chromosome condensation (RCC1)
  misc_feature (25)..(77): Pfam Name: RCC1 Pfam Description: Regulator of chromosome condensation (RCC1)
  misc_feature: SWISSPROT Homolog: EC 2.7.11.1 Non-specific serine/threonine protein kinase
VESLAVCNVDIVACGEFHTCAVTTAGELYTWGDGTHNIGLLGNGTDVSHWIPKRISGALDGLQVAYVSCGTWHTALITSRGQLFTFGDGTFGVLGHGNRESILCPREVESLSGLKTIAVACGIWHTAAVVEVIVTQSSSSISSGKLFTWGDGDKHRLGHGDKEQRLKPTCVASLIDYDFYRIACGHSLTIGLTTSGQVLSMGNTVYGQLGNPRSDG

SEQ ID NO: 48557 - DNA, 732 bp, Panicum virgatum
  misc_feature: Ceres CLONE 2044248
  misc_feature: Encodes the peptide sequence at SEQ ID NO. 48558
agcacgaacaacagcggaattacaagatccagaggggtccaaccgcaaaacggtctctgctgctgcgctgcgttgtgccagcggagtccctcggggacgaagaaaatctcaaggcgccgcgcagcagcagcagcctctagaggaaaggctcggcaacagaaacgaaagcaacaagctgccacgccaagagaactgactcaacggctgactcaacggcaagccttgctccaaccgaagagcgcggcagccgcctcccgattcttgtagggccgagattcgccatgaatggagatccatccgcgcgtgccattgattcgcttttgctgttttcggcctgctgcacaagactcgggaatgcaggaaaatgtgcttgcacaacaacaagcaattattccgcgcaaacaagattcgagcttccttcaagctgatattattgggctctcatgagaacgtgcttcatgctgattcagttcgtctccgtgttttaaaacacagtagatcgaaggcatctaggtatttagatcgccacctgggagacgacggttaacaactgctgccatccttttacgtagttggtgtctggtgtttgttcagttactatctttgcttccgtagcttgttataatggatggaaggaggaccatcttgatgggccgttatgaaattggcaaacagttgggacaaggaacctttgcaaaggttttttatgctcgcaatctttcaactgggcag

SEQ ID NO: 48558 - protein, 35 aa, Panicum virgatum
  misc_feature: Ceres CLONE 2044248
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MDGRRTILMGRYEIGKQLGQGTFAKVFYARNLSTG

SEQ ID NO: 48559 - DNA, 661 bp, Panicum virgatum
  misc_feature: Ceres CLONE 2044256
  misc_feature: Encodes the peptide sequence at SEQ ID NO. 48560
tccctcaacatttcagcgtgacaagatctcaggttctctatcaccaatggcagctcagtttgcagcggcaccaccggtcctgatcagttgcctcattgctcttgcaacacttgcgacctgcaaccctgaaggagacatactgtaccagcaaaagcaggtttggaaggacacaaacaatgtgctgcaaaaatgggatccaacccttgtcaacccctgcacctggattcatgtcacctgcaacaatgataacgctgtcatccgtgtggatatggggaacgcatgcatctcagggcctctgattccagatctgggaggactgcagaacctccagtacctccagttgtataacaacagcctgagcggtataataccagcaacactgggtaacctgactaaacttgtcagctgggatctatagggaaaccacctaacagaacgaatactatctacacttggcgccatcggcaccctgagatgtctgatgctgtatgagaacaaccagaccggggctataccaacgtctgtatgtaatctgtagaaccttcacgaactgaaacttcacaagaacgcgctcagtggctctattccatcctcttttggaaacatcaaaacgtggcttctcctgaaaatgaacgataacctgctgtctggtacagttcca

SEQ ID NO: 48560 - protein, 123 aa, Panicum virgatum
  misc_feature: Ceres CLONE 2044256
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAQFAAAPPVLISCLIALATLATCNPEGDILYQQKQVWKDTNNVLQKWDPTLVNPCTWIHVTCNNDNAVIRVDMGNACISGPLIPDLGGLQNLQYLQLYNNSLSGIIPATLGNLTKLVSWDL

SEQ ID NO: 48561 - DNA, 750 bp, Panicum virgatum
  misc_feature: Ceres CLONE 2044267
  misc_feature: Encodes the peptide sequence at SEQ ID NO. 48562
gtcctctctcccggcggcgcctccacatctcgtctctcagatcgggaggcgaaaccaagtgtgatcttcaaaagaagtcaagatggtgaagttcacggcagaggagctccgcgccatcatggacaaaaagaacaacattcgtaatatgtctgttattgctcatgtggaccacggcaagtctacccttacagactcccttgtggcagctgctgggattattgcccaggaagttgctggtgatgtccgcatgactgatactcgcgctgatgaagcagagcgtggtattacaatcaaatccaccggtatctctctctactatgagatgactcctgagtcactgaagaattacaagggtgagagagatggcaaccagtatttgatcaaccttatcgactcacctgggcacgtcgatttttcttcggaagtgacagctgcccttcgtatcaccgatggtgctctggtggtggttgactgtattgaaggtgtctgcgtgcaaactgagactgtgcttcgccaggctcttggtgagaggattaggccagtccttactgtgaacaagatggacaggtgcttccttgagcttcaggttgagggtgaggaagcctaccagactttctcccgtgtgattgagaatgccaacgtcattatggcaacatatgaagataagctccttggtgatgtccaagtctacccggagaagggaactgttgctttctctgctgggctgcacggctgggccttcaccctcac

SEQ ID NO: 48562 - protein, 222 aa, Panicum virgatum
  misc_feature: Ceres CLONE 2044267
  misc_feature (17)..(221): Pfam Name: GTP_EFTU Pfam Description: Elongation factor Tu GTP binding domain
MVKFTAEELRAIMDKKNNIRNMSVIAHVDHGKSTLTDSLVAAAGIIAQEVAGDVRMTDTRADEAERGITIKSTGISLYYEMTPESLKNYKGERDGNQYLINLIDSPGHVDFSSEVTAALRITDGALVVVDCIEGVCVQTETVLRQALGERIRPVLTVNKMDRCFLELQVEGEEAYQTFSRVIENANVIMATYEDKLLGDVQVYPEKGTVAFSAGLHGWAFTL

SEQ ID NO: 48563 - DNA, 705 bp, Panicum virgatum
  misc_feature: Ceres CLONE 2044269
  misc_feature: Encodes the peptide sequence at SEQ ID NO. 48564
actcctttcctcctcccccctccgcttgttcccgcactttccatgtcactgcaccactgctccgccgccaccacgacgcccgccatggccgccgccacggccagcgccggcctctcacccgctcccccgttccgcctcctcggctccggcccggcccagctccgactccctcaagctgctgcctgccgccgtcgttcgctactccgctgcgccgcctctggtggcggtgacggcggcgccggttccgatccgacccttgaggagcagaggcggcgtcaggccgagctggccgcgcgcattgcgtccggcgagttcaccgtccaaggccctggatggattgctcctctcgtggggaggctgtccaagctggggccgccgggggagctcgccgccgcgctgctcacgaggctggccggcgctggtgccgcgcgcggcggcccggagattccgcaggcggtgggatcgatcaacgcggtcgtgggccaggcgttcttcgtccccctgtacgatctcttcctcacctacggcggcatcttccgcctcaactttgggcctaagtcatttcttatagtatctgatccggctatagctaagcacattctgagagagaactccaaagcttattccaagggaattcttgcggaaatattggagtttgtcatgggtacaggtttgatcccagctgatggggagatttggcgtgtt

SEQ ID NO: 48564 - protein, 206 aa, Panicum virgatum
  misc_feature: Ceres CLONE 2044269
  misc_feature: SWISSPROT Homolog: EC 1.14.14.1 Unspecific monooxygenase
MAAATASAGLSPAPPFRLLGSGPAQLRLPQAAACRRRSLLRCAASGGGDGGAGSDPTLEEQRRRQAELAARIASGEFTVQGPGWIAPLVGRLSKLGPPGELAAALLTRLAGAGAARGGPEIPQAVGSINAVVGQAFFVPLYDLFLTYGGIFRLNFGPKSFLIVSDPAIAKHILRENSKAYSKGILAEILEFVMGTGLIPADGEIWR

SEQ ID NO: 48565 - DNA, 445 bp, Panicum virgatum
  misc_feature: Ceres CLONE 2044276
  misc_feature: Encodes the peptide sequence at SEQ ID NO. 48566
caaaaaaaaattcttaaccgggaaccgcaggaattcctggatacacactggcacgcatgcggcggcggcggctacggcggcggtcgtcagggtggctacggcggcggcggcggctacggaggcggtggtggctacggcggtggtcgccgtgagggcggctacggcggaggcggtggcggcggtcgccgcgagggcggctacggtgatggtggctacggcagccgcggtgactccggtggtaactggaggaactgatggggtggccctcccgtgctggcagccaagttatcctatatatctattagtgttcgtgtcactgtttgatccgagttacccctgagttttgttcgtgtgttaccgttcgattaggtgttggttcccatgtttaccgttcccgagttgtttccgcaataaaatgagaagaaaagagtgtctctcggttcac

SEQ ID NO: 48566 - protein, 84 aa, Panicum virgatum
  misc_feature: Ceres CLONE 2044276
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50178
  misc_feature: Useful for making plants with modulated nitrogen use efficiency
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Functional homolog of the protein sequence given in SEQ ID NO 50142
  misc_feature: Useful for making plants with altered lignin content
  misc_feature: Functional homolog of the protein sequence given in SEQ ID NO 50185
  misc_feature: Useful for making plants with modulated flowering time
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Functional homolog of the protein sequence given in SEQ ID NO 50144
  misc_feature: Useful for making plants with altered terpenoid content
  misc_feature: Functional homolog of the protein sequence given in SEQ ID NO 50179
  misc_feature: Useful for making plants with modulated phosphate use efficiency
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
QKKILNREPQEFLDTHWHACGGGGYGGGRQGGYGGGGGYGGGGGYGGGRREGGYGGGGGGGRREGGYGDGGYGSRGDSGGNWRN

SEQ ID NO: 48567 - DNA, 572 bp, Panicum virgatum
  misc_feature: Ceres CLONE 2044303
  misc_feature: Encodes the peptide sequence at SEQ ID NO. 48568
gacttcctttcctccccgactccgcccgtgatcccaaccgaacaaagtagacccacgcgtccggccgtccgggcgccgccatggccgcgtggcgcctccgccgtgcgggcgccgccctcgccgcatcctccgccgtcgccgtggccctcgccgcctcctctgcgtccgcctccgacccctccgccgcggccctcgacgccgcgcggcagcgcgtggcgcagccgggggccgcgccgccccctcgcgacgcgcagcgcgcggcgctggctgggtccacgcccgcggagcccctcgacgtgctcgtcgtcggcggcggagccactggatgcggcgcagcgctcgatgccgccacccgtgggcttcgggttggcctcgtggaacgcgaggacttctcctccgggacttcctcccgatccacgaaactcatccacggcggtgtgcgttacttggagaaagcagtgttcaatcttgattatgggcagctcaaacttgttttccacgcacttaaggaacgcaagcaggttattgagaatgctccccatttgtgccatgctttgccatgcatgactccc

SEQ ID NO: 48568 - protein, 163 aa, Panicum virgatum
  misc_feature: Ceres CLONE 2044303
  misc_feature: SWISSPROT Homolog: EC 1.1.99.5 Glycerol-3-phosphate dehydrogenase
MAAWRLRRAGAALAASSAVAVALAASSASASDPSAAALDAARQRVAQPGAAPPPRDAQRAALAGSTPAEPLDVLVVGGGATGCGAALDAATRGLRVGLVEREDFSSGTSSRSTKLIHGGVRYLEKAVFNLDYGQLKLVFHALKERKQVIENAPHLCHALPCMT

SEQ ID NO: 48569 - DNA, 664 bp, Panicum virgatum
  misc_feature: Ceres CLONE 2044312
  misc_feature: Encodes the peptide sequence at SEQ ID NO. 48570
tagacagacacaccacatcacttcagctcaagaggcgtctcatttgtccagctagcagatgatgcctcgagcggcaatccagactacctccaccatgctactccttgctttcatcttcatcctcatgctcccatccgcgcgcccttctgcaacacccttgcctgcatccgctgccgccagcaacgaatcgagcacggaccgtgcagcccttctctgcctcaagtcccagctccatgacccatcaggagcattagcctcctggagggatgattctcttctattctgcgagtggcacagcgtcacatgcggcaagcagcatgcgtcgcgtgtcattgcgttggaccttgaatccgagaacattggtggcaacctattcccttgcgttgctgaactcagcttcctcgaaaggatccacatgcccggtaaccagctcaatggacacatttctcccgacatcgcccaattatcacggcttcggtaccttaatctcagcatgaactcgcttgacggcgagataccccagacgatatcatcgtgctcccaccttgagaccattgacctgtacagcaattcacttcagggtaacatccctccaagccttggtcagtgttccgcccttcagactcttgttcttagcagcaacaatcttcagggaagcatccct

SEQ ID NO: 48570 - protein, 189 aa, Panicum virgatum
  misc_feature: Ceres CLONE 2044312
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MLLLAFIFILMLPSARPSATPLPASAAASNESSTDRAALLCLKSQLHDPSGALASWRDDSLLFCEWHSVTCGKQHASRVIALDLESENIGGNLFPCVAELSFLERIHMPGNQLNGHISPDIAQLSRLRYLNLSMNSLDGEIPQTISSCSHLETIDLYSNSLQGNIPPSLGQCSALQTLVLSSNNLQGSI

SEQ ID NO: 48571 - DNA, 692 bp, Panicum virgatum
  misc_feature: Ceres CLONE 2044326
  misc_feature: Encodes the peptide sequence at SEQ ID NO. 48572
ctggacaaaatcagctcccgaaatccaaaattgaaacaggtggttttgagcttggggcttgctcggaggaccgattttggagccggcgaagggatgtcaggacccctcgatcgatttgctaggccatgttcctaaaagcgcggaaatttgatgttgagaaagcaaagaatatgtggtcagacatgcttagatggaggaaggaattcgggaccgacaaaatagaggaatttgactacaccgagttagatgaagttacaaagtattacccacaattttatcatggggtggataaagagggtagacctatctacatagagttaataggaaaagttgatgcaaacaagctagttcaagtaacaaccatcgatcggtatgtgagataccatgtcaaggagtttgagagatgtttccagatgagatttccagcttgctcaattgctgcaaaaaaacacatagactcatctacgactattttggatgtgcaaggagtgggtttcaagaacttctcaaaatctgcgagggaattagtcgcacgactgcagaagatcgatggtgataactacccagagacattgtgccgaatgtatataattaatgctggccaaggcttcaagatgttatggaacacaataaaatcgttccttgatccaaaaactgcttccaagatccatgttctcgggaataagtaccac

SEQ ID NO: 48572 - protein, 188 aa, Panicum virgatum
  misc_feature: Ceres CLONE 2044326
  misc_feature (48)..(188): Pfam Name: CRAL_TRIO Pfam Description: CRAL/TRIO domain
MFLKARKFDVEKAKNMWSDMLRWRKEFGTDKIEEFDYTELDEVTKYYPQFYHGVDKEGRPIYIELIGKVDANKLVQVTTIDRYVRYHVKEFERCFQMRFPACSIAAKKHIDSSTTILDVQGVGFKNFSKSARELVARLQKIDGDNYPETLCRMYIINAGQGFKMLWNTIKSFLDPKTASKIHVLGNKY

SEQ ID NO: 48573 - DNA, 679 bp, Panicum virgatum
  misc_feature: Ceres CLONE 2044329
  misc_feature: Encodes the peptide sequence at SEQ ID NO. 48574
gcgcatctagcctagccgccaaccgccaccaccgcagccggggagagagagagagagcggagcacgaggccgggggggacggatggcgagcccccagtgctgcgagaacccgccgacgctgaacccggccggcggggcgggcaaggtcgtggacagcttcggcgggctcaaggcctacgtcgccggccccgaggactccaaggccgccgtcgtcctcgtcgccgacgtcttcgggtttgaagcgccgaatctgaggaagatagccgacaaggttgctctgtcaggatactttgttgtggtaccagatttcttccgtggggatccttacatacctgagaatactgagaggcccattcctgagtggctaaagtcgcatactccggaaaaagggtttgaagatgcaaaaccagttattgctgctctaaaggagaagggagtgtctgctgttggagctgcaggttattgctggggtgctaaggttgttgtggagttggcaaaagctaaggagatccaggctgctgtaatgttgcacccttcgtttgtttcagttgacgatatcaaagaggtcaaatgccctatttctgtactgggagctgagattgacaaaacgtccccgccagaattagtcaagcaatttgagcaggttctttctgccaactcaggggttggtcacttcgtc

SEQ ID NO: 48574 - protein, 198 aa, Panicum virgatum
  misc_feature: Ceres CLONE 2044329
  misc_feature (29)..(198): Pfam Name: DLH Pfam Description: Dienelactone hydrolase family
MASPQCCENPPTLNPAGGAGKVVDSFGGLKAYVAGPEDSKAAVVLVADVFGFEAPNLRKIADKVALSGYFVVVPDFFRGDPYIPENTERPIPEWLKSHTPEKGFEDAKPVIAALKEKGVSAVGAAGYCWGAKVVVELAKAKEIQAAVMLHPSFVSVDDIKEVKCPISVLGAEIDKTSPPELVKQFEQVLSANSGVGHF

SEQ ID NO: 48575 - DNA, 734 bp, Panicum virgatum
  misc_feature: Ceres CLONE 2044334
  misc_feature: Encodes the peptide sequence at SEQ ID NO. 48576
atcaacctgagaaggccaaaagggtatcaacaggcttaaggtaggacaagagtgtgtttgagctagtcaacaggaacaaattcaacgtttgagaacagagaaaagaggccactggaaaacacaggtacagcagatgtatcaccaacatcagggcccgagtgagctcttcactacaaggacatcctttcctatggagcagcatctgtttttgcgtggaggaaatgcccaaggagattctgggctggttctctcaactgatgctaaaccaaggctgaaatggacacctgagttacatcagagatttgtagatgcagtcaatcaattaggtggagctgagaaagctacaccaaaaacagtcatgagactcatgggcattccaggactcaccttgtaccatctgaaaagccatctccagaaatacaggcttagcaagaacctccaagctcaagcaaatgtcagcacatcaaagaatgccataggatgtgcaaccattgctgataggatgcctggaacaagtgcgccaacaatgagcagtacaaatgtcattccacaggcagagaagactattcaaattggcgaagcacttcagatgcaaattgaggttcagaggcagttgaatgaacagcttgaggtgcaaaggcatctacaactacgaatagaagcccaagggaagtacctacaggcagttttagagcaggcacaagagacacttggaaaacagaatttgggtcctg

SEQ ID NO: 48576 - protein, 181 aa, Panicum virgatum
  misc_feature: Ceres CLONE 2044334
  misc_feature (27)..(78): Pfam Name: Myb_DNA-binding Pfam Description: Myb-like DNA-binding domain
  misc_feature: Functional homolog of the protein sequence given in SEQ ID NO 51559
  misc_feature: Useful for making plants with modulated flowering time
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: Functional homolog of the protein sequence given in SEQ ID NO 50244
  misc_feature: Useful for making plants with altered alkaloid content
  misc_feature: Useful for making plants with altered lignin content
  misc_feature: Functional homolog of the protein sequence given in SEQ ID NO 50243
  misc_feature: Useful for making plants with altered terpenoid content
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MEQHLFLRGGNAQGDSGLVLSTDAKPRLKWTPELHQRFVDAVNQLGGAEKATPKTVMRLMGIPGLTLYHLKSHLQKYRLSKNLQAQANVSTSKNAIGCATIADRMPGTSAPTMSSTNVIPQAEKTIQIGEALQMQIEVQRQLNEQLEVQRHLQLRIEAQGKYLQAVLEQAQETLGKQNLGP

SEQ ID NO: 48577 - DNA, 646 bp, Panicum virgatum
  misc_feature: Ceres CLONE 2044343
  misc_feature: Encodes the peptide sequence at SEQ ID NO. 48578
aaaacagcctctttctcgcatccttttgttaccagacaatagtccatggcttccattgtctgggcattgctgctctgccttgtccagctccactcactcgtcgcctccagcgcccatcctgatggcaatctcactcaccactctagtactcctctgtgccgcccggatcaggctaacgctctgcttaaactcaagcagtctttcatgttccactcaaactccgagtcagaggactcattattagactccatcaccactcttccttcttggcaagctggcacagactgttgtatctgggagggcgtcggctgcagcaactccacgggccatgtcacctcgctcaacctcggtggttttggcttgtacagcaatggcatcgacccagcgctctttaatctcacctccctcaggctgcttgacctgagcgccaataactttggtggcaagaggatcccgtcagtttgtttcgagaggctcgctttgcttacccatctcaacctctcaggttcaggcatcagcggtcaggtacctgttggcattagcaaactcacgaatcttgtatccttagacctttccaacggtaatatttatgccgatgacgacccaggctcctatgcctggagcggcacacctaatacactttggg

SEQ ID NO: 48578 - protein, 200 aa, Panicum virgatum
  misc_feature: Ceres CLONE 2044343
  misc_feature (39)..(90): Pfam Name: LRRNT_2 Pfam Description: Leucine rich repeat N-terminal domain
  misc_feature: SWISSPROT Homolog: EC 2.7.11.1 Non-specific serine/threonine protein kinase
MASIVWALLLCLVQLHSLVASSAHPDGNLTHHSSTPLCRPDQANALLKLKQSFMFHSNSESEDSLLDSITTLPSWQAGTDCCIWEGVGCSNSTGHVTSLNLGGFGLYSNGIDPALFNLTSLRLLDLSANNFGGKRIPSVCFERLALLTHLNLSGSGISGQVPVGISKLTNLVSLDLSNGNIYADDDPGSYAWSGTPNTLW

SEQ ID NO: 48579 - DNA, 652 bp, Panicum virgatum
  misc_feature: Ceres CLONE 2044346
  misc_feature: Encodes the peptide sequence at SEQ ID NO. 48580
acgactggctctccccacgcaaagcgagccgcgcgcctcggtcgccaccgcattggcatcggatcgatcgctccgccacagcccacagagaggaggaggagggaggcaggagggggagctgatggcaatctcactcaccactctagtactcctctgtgccgcccggatcaggctaacgctctgcttaaactcaagcagtctttcatgttccactcaaactccgagtcagaggactcattattagactccatcaccactcttccttcttggcaagctggcacagactgttgtatctgggagggcgtcggctgcagcaactccacgggccatgtcacctcgctcaacctcggtggttttggcttgtacagcaatggcatcgacccagcgctctttaatctcacctccctcaagctgcttgacctgagcgccaataactttggtggcaagaggatcccgtcagtttgtttcgagaggctcgctttgcttacccatctcaacctctcaggttcaggcatcagcggtcaggtacctgttggcattagcaaactcacgaatcttgtatccttagacctttccaacggtaatatttatgccgatgacgacccaggctcctatgcctggagcggcacacctaatacactttgggaaccca

SEQ ID NO: 48580 - protein, 217 aa, Panicum virgatum
  misc_feature: Ceres CLONE 2044346
  misc_feature (54)..(105): Pfam Name: LRRNT_2 Pfam Description: Leucine rich repeat N-terminal domain
  misc_feature: SWISSPROT Homolog: EC 2.7.11.1 Non-specific serine/threonine protein kinase
TTGSPHAKRAARLGRHRIGIGSIAPPQPTERRRREAGGGADGNLTHHSSTPLCRPDQANALLKLKQSFMFHSNSESEDSLLDSITTLPSWQAGTDCCIWEGVGCSNSTGHVTSLNLGGFGLYSNGIDPALFNLTSLKLLDLSANNFGGKRIPSVCFERLALLTHLNLSGSGISGQVPVGISKLTNLVSLDLSNGNIYADDDPGSYAWSGTPNTLWEP

SEQ ID NO: 48581 - DNA, 655 bp, Panicum virgatum
  misc_feature: Ceres CLONE 2044349
  misc_feature: Encodes the peptide sequence at SEQ ID NO. 48582
cctgattatacatctcaaaaaacacgtgcctggtgggctagtttggtaaaggacttcatctctaatggtgttgatggaatatggaatgatatgaatgaacctgctgttttcaagactaccacgaagacaatgcctgaaaacaatatccataggggagatgctgatgtcggcggtgttcaaaatcattcgtactatcacaatgtctacggaatgctaatggcaagatctacttatgaaggaatggaaatgggtaatgcagctaaacggccatttgttcttacacgagctggctttatagggagccaacgctatgctgcaacatggaccggtgataatctgtcaaactgggagcatttgcacatgagtctaccaatggttcttcagttgggtctcagtggtcaaccattgtcaggtcctgatattggtggttttgctggaaatgccactccaaaactttttggaagatggatgggtgtgggtgcactgtttccattttcacgtggtcatacagaaactggaagtgttgaccacgagccatggtccttcggtgaagagtgcgaggaagtttgtcgccttgcgctactgagacggtaccggctactgccgcatatctacactcttttttaccgttcacatacaaccggtattcctgttg

SEQ ID NO: 48582 - protein, 218 aa, Panicum virgatum
  misc_feature: Ceres CLONE 2044349
  misc_feature (1)..(218): Pfam Name: Glyco_hydro_31 Pfam Description: Glycosyl hydrolases family 31
  misc_feature: SWISSPROT Homolog: EC 3.2.1.20 Alpha-glucosidase
PDYTSQKTRAWWASLVKDFISNGVDGIWNDMNEPAVFKTTTKTMPENNIHRGDADVGGVQNHSYYHNVYGMLMARSTYEGMEMGNAAKRPFVLTRAGFIGSQRYAATWTGDNLSNWEHLHMSLPMVLQLGLSGQPLSGPDIGGFAGNATPKLFGRWMGVGALFPFSRGHTETGSVDHEPWSFGEECEEVCRLALLRRYRLLPHIYTLFYRSHTTGIPV

SEQ ID NO: 48583 - DNA, 626 bp, Panicum virgatum
  misc_feature: Ceres CLONE 2044366
  misc_feature: Encodes the peptide sequence at SEQ ID NO. 48584
aagtctccacccagtctcgctctctctccgcccaagtcctcccctgccactatcaaaaaaaaaaaaaaaaaagtcctcccctgccgagacgagtcgcgatcctccccgacgccgcccatcccccccgtccggactcggatcgacccctcgtcgcctcggatggctgaagataatccccatggcgccagcagttcgacggcgaaaccagctgatgatacggagtccaccattgagatcaacatcaagaccctggattcgcaagtccacaagctccgtgtgaacaagaatgcgcccgtttcggtccttaaggagaagatagttgatgcaactggtgttcctctggatcagcagcggttgatttttagaggaagggtcttgaaggatgatcacctcctgtcagaataccatttggaagatggatttacattgcatctggttgctcggcgtgcggctgagggccagaattcttctgggacttctgaaggaaacacacctgctaatgtaaattttgctgcaaatggaggattattggacgatatttccaggagtgttcgggatcttcttggttccttgggtgttgcgatgtctggtggtctcaccaatgcatcattttcggttcctttggc

SEQ ID NO: 48584 - protein, 155 aa, Panicum virgatum
  misc_feature: Ceres CLONE 2044366
  misc_feature (29)..(97): Pfam Name: ubiquitin Pfam Description: Ubiquitin family
MAEDNPHGASSSTAKPADDTESTIEINIKTLDSQVHKLRVNKNAPVSVLKEKIVDATGVPLDQQRLIFRGRVLKDDHLLSEYHLEDGFTLHLVARRAAEGQNSSGTSEGNTPANVNFAANGGLLDDISRSVRDLLGSLGVAMSGGLTNASFSVPL

SEQ ID NO: 48585 - DNA, 668 bp, Panicum virgatum
  misc_feature: Ceres CLONE 2044369
  misc_feature: Encodes the peptide sequence at SEQ ID NO. 48586
tctgcggaggttcttgatcacttggcgggttcctattcaggacttgtaggtcgaaggcatatgtgctcactaccagagaccactgcttgtgatattgcagcgacagctattattttgtctaccaagatttcttctggggtctcaataggagaggattcattggtttatgattcagtactttgtggtagaatacggattggttcgcaatccattgttgttggggtgaatataagtgagtttcatgtgtacagtcctcagataatcaatagtagcacttgtttcacattacctgatcgccattgcctctgggaagtaccattggtaaactctgcaggaagagttttggtttactgtggtcttcatgataatccaaaagtttctgttaagagggatggtacattctgtggcaagccatggataaatgttttggaagatcttagaatccaggatatggatctttggaactcaaccagccaggacaagtgcttatggactgcaagactttttcctgtcatgtctctccctgaaatgctgaatgtaggcatgtggcttatggggtcagcatgcgacccagatggaaaaatagctaccttgtggagaaaatcacagagggtcagcttggaagagctgcatcgtgctatcaactacagtcagctttgcgcggattc

SEQ ID NO: 48586 - protein, 222 aa, Panicum virgatum
  misc_feature: Ceres CLONE 2044369
  misc_feature (1)..(176): Pfam Name: Fucokinase Pfam Description: L-fucokinase
  misc_feature: SWISSPROT Homolog: EC 2.7.1.52 Fucokinase
SAEVLDHLAGSYSGLVGRRHMCSLPETTACDIAATAIILSTKISSGVSIGEDSLVYDSVLCGRIRIGSQSIVVGVNISEFHVYSPQIINSSTCFTLPDRHCLWEVPLVNSAGRVLVYCGLHDNPKVSVKRDGTFCGKPWINVLEDLRIQDMDLWNSTSQDKCLWTARLFPVMSLPEMLNVGMWLMGSACDPDGKIATLWRKSQRVSLEELHRAINYSQLCAD

SEQ ID NO: 48587 - DNA, 699 bp, Panicum virgatum
  misc_feature: Ceres CLONE 2044398
  misc_feature: Encodes the peptide sequence at SEQ ID NO. 48588
attgcaggctcgcagctgcatttcttcactcatttcttccctttttcgatttgcgaaggcttcagttgagctctgtaatttgggtcagctaacggaggggaggtacccagttgagctctgaaaatttccccccttttcgtttggtggtcctcgaattcttccggtctttgacattcaggaaggccattttcagattgagctagttcagtggggctagttttctcaaccaaagatcgcctccttttgacctgttcttgattcgcccgggattcctttcctctcctccgttaagtggagctctctcctgccattgctcgatcgcgattgttgttggttggtgggtgccgccatggatcccttccacggcattgtgaaggaggaagagttcgacttcgatttcgacttcaccggcgcttcggcggcgggcgctccggcagcgggggcgtcgtcgtcgtcctcctgggctgttggcgtgccggagctgccccggccgatggaagggctcggcgaggtggggcctactccgttcctgaccaagacctacgacgtcgtggacgaccccaacaccgacaccgtcatctcctgggggttcgccggccacagcttcgtcgtctgggatgccaacgccttcgccaacgttatcctcccgcgctatttcaagcacagtaacttctccagcttcgtccgccagctcaacac

SEQ ID NO: 48588 - protein, 116 aa, Panicum virgatum
  misc_feature: Ceres CLONE 2044398
  misc_feature (58)..(116): Pfam Name: HSF_DNA-bind Pfam Description: HSF-type DNA-binding
  misc_feature: The sequence is a functional homolog of SEQ ID NO 1686 in the 10/412,699 US patent application
  misc_feature: Functional homolog of the protein sequence given in SEQ ID NO 50267
  misc_feature: Useful for making plants with modulated heat sensitivity
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 1805 in the 10/374,780 US patent application
MDPFHGIVKEEEFDFDFDFTGASAAGAPAAGASSSSSWAVGVPELPRPMEGLGEVGPTPFLTKTYDVVDDPNTDTVISWGFAGHSFVVWDANAFANVILPRYFKHSNFSSFVRQLN

SEQ ID NO: 48589 - DNA, 566 bp, Panicum virgatum
  misc_feature: Ceres CLONE 2044412
  misc_feature: Encodes the peptide sequence at SEQ ID NO. 48590
aacccaattccctcgcgcttcctcttccccctcccgcatcacacatccccccaccaggccaccaccaccacccaccgcccgaccccgtatgcaattattcgcacccggacgccaccgcctccaccaccatcgcatccgccatgggcgactcctcggtggccggcgcgctcgtgccgtccgtgcccaagccggaggccgcgccgtccggtgacgcctccacggcggccgcggcgaccacggcggcgctggcgctggcggaggaggcgggcacgcgcgcggcgtcggcgtccccgcagggcccggcggcggagggggaaggccccgccagcagggacctcctctgcccgatctgcatggcggtcatcaaggacgccttcctcaccgcctgcggccacagcttctgctacatgtgcatcgtcacgcacctcagccacaagagcgactgcccctgctgcgggcactacctcaccaaggcccagctctaccccaatttcctcctcgacaaggttctgaagaaaatatcggcccggcaaattgctaaaacagtgtcaccaatcgatcaattt

SEQ ID NO: 48590 - protein, 141 aa, Panicum virgatum
  misc_feature: Ceres CLONE 2044412
  misc_feature (68)..(105): Pfam Name: zf-C3HC4 Pfam Description: Zinc finger, C3HC4 type (RING finger)
  misc_feature: The sequence is a functional homolog of SEQ ID NO 13 in US patent 7208652
  misc_feature: The sequence is a functional homolog of SEQ ID NO 1841 in the 11/479,226 US patent application
  misc_feature: Functional homolog of the protein sequence given in SEQ ID NO 51753
  misc_feature: Useful for making plants with modulated light quality sensitivity
MGDSSVAGALVPSVPKPEAAPSGDASTAAAATTAALALAEEAGTRAASASPQGPAAEGEGPASRDLLCPICMAVIKDAFLTACGHSFCYMCIVTHLSHKSDCPCCGHYLTKAQLYPNFLLDKVLKKISARQIAKTVSPIDQ

SEQ ID NO: 48591 - DNA, 675 bp, Panicum virgatum
  misc_feature: Ceres CLONE 2044444
  misc_feature: Encodes the peptide sequence at SEQ ID NO. 48592
agcctaaaatcttccaactctgccgagcgcctgagcccacctccagctccccgccccttggcaccacactatagcccagtgcctactagctcgcttgctcctccctgttgtccgcaggagcagagccaaaaaacccgtcagctcggttgcaagaacggccatgaagtacgtgctggtgaccggaggggtggtgagcggcctcggcaagggcgtgacggccagcagcatcggcgtcgtgctcaaggcctgcggcctccgcgtaaccaccatcaagatcgacccctacctcaacactgatgctggaaccatgtctccatttgagcatggcgaggtctttgttttggatgatggtggagaggtggacctggaccttggaaattatgaacgttttctggatatcaaattgacccgtgacaacaatataaccacaggaaaaatctatcaggctgtcattaacaaagaaagaagaggtgactacctaggaaaaaccgtccaggttgtgccacatattacagatgaaatacaagattggattgaacgcgttgcaatgaatccagttgatggcaaagaaggaccacctgatgtttgtgtcattgaacttggcggcactataggggacaaaatcttttcgccgcataacgacagtggcattcttgatgcaggggatatcgagtc

SEQ ID NO: 48592 - protein, 171 aa, Panicum virgatum
  misc_feature: Ceres CLONE 2044444
  misc_feature (1)..(170): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTTIKIDPYLNTDAGTMSPFEHGEVFVLDDGGEVDLDLGNYERFLDIKLTRDNNITTGKIYQAVINKERRGDYLGKTVQVVPHITDEIQDWIERVAMNPVDGKEGPPDVCVIELGGTIGDKIFSPHNDSGILDAGDIE

SEQ ID NO: 48593 - DNA, 570 bp, Panicum virgatum
  misc_feature: Ceres CLONE 2044459
  misc_feature: Encodes the peptide sequence at SEQ ID NO. 48594
ccccttgctccctctgtcttgtcctcgtcgcctctcggcttgccctccgccctccggtgcctcggtgccctgccgactgcaagttcagcggcgattcagcgcatgttcgcccgcacctgcgcggccgttgatcgcgacagcctcgtcgcagcggtcggaggagcagcgccggcggcgtccatggcggcggggtcgtcgaggcaagcggcggagaaggtggacaagtggatggcgttcccgtcgggcgccgacggcggcagcttcaccttcccgccgccgcgttccgggtcgggcggcggcaaggagatcgtggaggagccggcgtcgtcctctccgggcgccgccgccgccggaggcggcagctaccggcagccgtcgttccagcgcgggcgcgacagcggcggcgcgggcagcaccaagtcgtcgctggacggcgcgcgcggctcgggggagtcgtcgctgccgcgggtgtcgcaggagctcaaggacgcgctgtccaacctgcagcagaccttcgtcgtctccgacgcgacgcgcccggactgcccaatcatctacgccagcgccggc

SEQ ID NO: 48594 - protein, 129 aa, Panicum virgatum
  misc_feature: Ceres CLONE 2044459
  misc_feature: SWISSPROT Homolog: EC 2.7.11.1 Non-specific serine/threonine protein kinase
MAAGSSRQAAEKVDKWMAFPSGADGGSFTFPPPRSGSGGGKEIVEEPASSSPGAAAAGGGSYRQPSFQRGRDSGGAGSTKSSLDGARGSGESSLPRVSQELKDALSNLQQTFVVSDATRPDCPIIYASA

SEQ ID NO: 48595 - DNA, 651 bp, Panicum virgatum
  misc_feature: Ceres CLONE 2044497
  misc_feature: Encodes the peptide sequence at SEQ ID NO. 48596
tccctcgcggcgactagtcggccatcgtaggcgccatttgtcaagcaccccaaacctaacccagcgctccctcactcctcccctccgactcgccgccgccggagctcgccggtggaagtccactcggccgcgatgagggcggcggcgggcacaccccttcccttccttcgaggatctcccgtttctcctttccctccttttcttcccgccggggttgcagcactggtcgccggccgccggcgtccttttcgccggctgtgcgcagatccggcaccggtggttgcggatccggtgccgtcttgcggatccgcttggggcataccggccgaagcagctcgacctccacccgccggccgttcgagatggtcgggtgcctgtgccactgccggatctcgacgatctgaatccagtctcgttggtgatggcgagctcggggttctcgtggacgctaccggaccacccaaagctccccaaggggaagccagtggcggtcgtcgtgctggacggatggggcgaggccaacgccgaccagtacaattgcatccatgttgcgcagacgcctgtcatggactcgctcaagaatggtgctccagagaaatggagactagtgaaggctcatggaaccgctgtgggtctcccatctgatgatga

SEQ ID NO: 48596 - protein, 76 aa, Panicum virgatum
  misc_feature: Ceres CLONE 2044497
  misc_feature: SWISSPROT Homolog: EC 5.4.2.1 Phosphoglycerate mutase
MASSGFSWTLPDHPKLPKGKPVAVVVLDGWGEANADQYNCIHVAQTPVMDSLKNGAPEKWRLVKAHGTAVGLPSDD

SEQ ID NO: 48597 - DNA, 586 bp, Panicum virgatum
  misc_feature: Ceres CLONE 2044524
  misc_feature: Encodes the peptide sequence at SEQ ID NO. 48598
atttcggccttcctcccccactccctctcccccagcgcacaggcgcgccgcgcacgcaactcagacccggcgagatggtgatggctcagaagacgaaggaggcggagatcacggagcaggattcgctgcttctaacaaggaatttgcttcggattgccatatacaacatcagctacatcagaggcctattccatgaaaaatacttcagtgataagtcagttccagcactagagatgaagattaagaagctgatgccgatggatgccgagtcgaggaggctgattgattggatggagaaaggggtctatgatgctttgcaaaagaaatatctcaagacccttctcttttgtatctgtgagaaggaggaaggcccgatgattgaggagtacgccttctcatttagctaccccaacaccagtactgaggaagttgcaatgaacatgagtcgtacagggagcaaaaagggtagcactacatttacttcgaatgcttcagaagtaactcctgatcagatgaggagctctgcttgtaagatgatcagaacgctggtttcacttatgaggaccttggacccaatgccagagaa

SEQ ID NO: 48598 - protein, 170 aa, Panicum virgatum
  misc_feature: Ceres CLONE 2044524
  misc_feature (13)..(170): Pfam Name: HORMA Pfam Description: HORMA domain
MVMAQKTKEAEITEQDSLLLTRNLLRIAIYNISYIRGLFHEKYFSDKSVPALEMKIKKLMPMDAESRRLIDWMEKGVYDALQKKYLKTLLFCICEKEEGPMIEEYAFSFSYPNTSTEEVAMNMSRTGSKKGSTTFTSNASEVTPDQMRSSACKMIRTLVSLMRTLDPMPE

SEQ ID NO: 48599 - DNA, 734 bp, Panicum virgatum
  misc_feature: Ceres CLONE 2044539
  misc_feature: Encodes the peptide sequence at SEQ ID NO. 48600
attttcatttcctgcctgccgccccctcgtcccctctcctctcctctcctctccacccctgcctccgccctccgccctctgcgagatcggcagctcttggacgggtgttcaggtgccggtggtttggccttggcgcacgctctctcgccttcagctgttgcttccctggcgctcatggtgcacagccggtgagccgagtttccgtcagattcggtggttccgctggtttggaaatccggagatggctcgttttcaggaaatcaaggcgacgaacgaccgaaagcctgctgctgatcgcgccggccatgcagacttcatggaccatccgaagaaaactctcgattcgccagaaggaccgcgagctcctaaggcacgcaagccatacacgatatccaagcagagggagaagtggacggaggacgagcacaagctgttcttggaagcccttcagcaacatggccgtgcctggcgtcgtatccaagagcacataggcagcaagactgccgtgcaaatcaggagccacgctcagaagttcttctccaaggtcatccgagaatcatctggggatagcaacagcatagctgctccaccacaaatttatattcctccggcacggccaaagaggaagccagcacacccatacccgcgcaatctgggtaattctctctgcaaggatgcctctacaatcaaacagcttgagaagccccagttgaagatacagtttgctgtctgag

SEQ ID NO: 48600 - protein, 163 aa, Panicum virgatum
  misc_feature: Ceres CLONE 2044539
  misc_feature (54)..(99): Pfam Name: Myb_DNA-binding Pfam Description: Myb-like DNA-binding domain
  misc_feature: Functional homolog of the protein sequence given in SEQ ID NO 50633
  misc_feature: Useful for making plants with modulated light response
  misc_feature: The sequence is a functional homolog of SEQ ID NO 1067 in the 11/479,226 US patent application
  misc_feature: The sequence is a functional homolog of SEQ ID NO 146 in the 10/374,780 US patent application
  misc_feature: The sequence is a functional homolog of SEQ ID NO 1806 in the 10/412,699 US patent application
  misc_feature: The sequence is a functional homolog of SEQ ID NO 254 in the 11/375,241 US patent application
  misc_feature: The sequence is a functional homolog of SEQ ID NO 464 in the 10/412,699 US patent application
  misc_feature: The sequence is a functional homolog of SEQ ID NO 794 in the 10/225,066 US patent application
MARFQEIKATNDRKPAADRAGHADFMDHPKKTLDSPEGPRAPKARKPYTISKQREKWTEDEHKLFLEALQQHGRAWRRIQEHIGSKTAVQIRSHAQKFFSKVIRESSGDSNSIAAPPQIYIPPARPKRKPAHPYPRNLGNSLCKDASTIKQLEKPQLKIQFAV

SEQ ID NO: 48601 - DNA, 713 bp, Panicum virgatum
  misc_feature: Ceres CLONE 2044540
  misc_feature: Encodes the peptide sequence at SEQ ID NO. 48602
tcccgaccgcgcaaaaatatcacgatccacacccattccccgctgccgccgccgccgcggcgaacgagatggcggcagccctcctgctccgcggtctccgctcgtcggcgagccgggcacacacccactcgctctcccatgcatcgtccccatcggcgctggggtcatccctcctgcgccggctctactcctccgcggcggcgtccgccgctgcgtcgcctgctttaacacccagcggcgtcatggacccgtcccgcatccgcaacgtggcggtgatagcccacgtcgaccacgggaagactacgctcatggaccggctcctgcggcagtgcggggccgatatcccccacgagcgcgccatggactccatcagcctcgagcgcgagcgcggcatcaccattgcctccaaggtcacttctgtttcttggaaggaaactgaactcaacatggttgatacccctggccacgctgatttcggtggtgaggttgaacgagttgtgggaatggtggaaggagctgtcttggttgttgatgctggagagggacccttagcacaaactaaatttgtgctttcaaaggctttaaagtatggcttgcgcccaattctcctcctcaacaaggttgataggccttcagtttctgaagaaacttgcaatgaggtagagagcttggtttttgatctttttgcaaaccttggtgctacagaagaacag

SEQ ID NO: 48602 - protein, 214 aa, Panicum virgatum
  misc_feature: Ceres CLONE 2044540
  misc_feature (62)..(214): Pfam Name: GTP_EFTU Pfam Description: Elongation factor Tu GTP binding domain
  misc_feature: SWISSPROT Homolog: EC 2.7.7.4 Sulfate adenylyltransferase
MAAALLLRGLRSSASRAHTHSLSHASSPSALGSSLLRRLYSSAAASAAASPALTPSGVMDPSRIRNVAVIAHVDHGKTTLMDRLLRQCGADIPHERAMDSISLERERGITIASKVTSVSWKETELNMVDTPGHADFGGEVERVVGMVEGAVLVVDAGEGPLAQTKFVLSKALKYGLRPILLLNKVDRPSVSEETCNEVESLVFDLFANLGATEE

SEQ ID NO: 48603 - DNA, 583 bp, Panicum virgatum
  misc_feature: Ceres CLONE 2044545
  misc_feature: Encodes the peptide sequence at SEQ ID NO. 48604
attattcttgctatccgcatcacgggcctttttgttcaagctacctcgcatcacagcaacggaatgagctcagtggtcaagcttggaccttggggccgcagcaagaggtacagttcaggtcagcgctgtgacatcgcagtagcgccgttgcgcctggagagaatcaccgtgcaccatggggacgtcgtcgacggcctcggcttctcctaccgcgatcgcgagaagctgccccacaccgccggccactggggcggcaccggtggccaggccaccacgatagagcttcggccgtcggagttcatgacggaggttcacggcaagtacggatcctactacggccacgacggcgtcgcgagcctgacgctcgtcaccaacctccgaacccacgggccgttcggcgactgcagcacgttggggtgggagcgcttcagcttgcccgtgaagaacaacgccagcatcgtcggcttcttcgtccacaccggcaaccagtacctcagtgccatcggcgtctacgtcaagccgttctgatcgagccgcgcgcgtgtccatataaatggtccatacgtgtgtgtgtgtgtgtgtg

SEQ ID NO: 48604 - protein, 154 aa, Panicum virgatum
  misc_feature: Ceres CLONE 2044545
  misc_feature (19)..(153): Pfam Name: Jacalin Pfam Description: Jacalin-like lectin domain
MSSVVKLGPWGRSKRYSSGQRCDIAVAPLRLERITVHHGDVVDGLGFSYRDREKLPHTAGHWGGTGGQATTIELRPSEFMTEVHGKYGSYYGHDGVASLTLVTNLRTHGPFGDCSTLGWERFSLPVKNNASIVGFFVHTGNQYLSAIGVYVKPF

SEQ ID NO: 48605 - DNA, 577 bp, Panicum virgatum
  misc_feature: Ceres CLONE 2044551
  misc_feature: Encodes the peptide sequence at SEQ ID NO. 48606
aaaaaagcactcggcaaccattctacttcttgccatggcggcgagctagctagctagcaacttctgtcgtcgcgcaccgctctttgattcctgtcaccatgcgtcccctcctcctccttgtccttggttggatccttttctcccagcagcacaccccctcatactccatacccacggacacactctcacgcggccgctcactcgccagcgacgacaggcttgtctccggcaatggcaagttcgcccttggcttcttccaaatgggcaccagcaacctcctcaactggtacctcagcatatggttcaacaagattcccaagataaagcctgtgtggacggccaacagggataatccgatctcggatccagcttctccagagctcataattgccagcgacggcaacctggttgtcttagctcaaggcgccatcatctggtctacccaagcaaacattacagccaatgacacaaccgtcgctgtaatcttggacagtggcaaccttgttctacggagctcctcaaactcttcacatatattctgggaaagctttgatcaccccacagacacccatctacc

SEQ ID NO: 48606 - protein, 159 aa, Panicum virgatum
  misc_feature: Ceres CLONE 2044551
  misc_feature (74)..(159): Pfam Name: B_lectin Pfam Description: D-mannose binding lectin
MRPLLLLVLGWILFSQQHTPSYSIPTDTLSRGRSLASDDRLVSGNGKFALGFFQMGTSNLLNWYLSIWFNKIPKIKPVWTANRDNPISDPASPELIIASDGNLVVLAQGAIIWSTQANITANDTTVAVILDSGNLVLRSSSNSSHIFWESFDHPTDTHL

SEQ ID NO: 48607 - DNA, 575 bp, Panicum virgatum
  misc_feature: Ceres CLONE 2044553
  misc_feature: Encodes the peptide sequence at SEQ ID NO. 48608
atagtatggaagaagaggtctagaagatggcaagattgtcatgtagagtggtagtgttatggtagggtagtcacgtaaagagtataaggttcttgtattgtactaagttaatgtgaaaaataatagagttggtctaaaaaaagaggagcaccaaggacttccggcgcctgttcaggatctacatcatcccgagcgagttcttggttgatctcttcctcttcgacctcctcccaggctcttgtgtagcttgccactctcgccagtcaagttttcatgtctgaacttgacattcagatcccaactgccttcgatccctttgctgaagccaatgctggggactctggtgcggcagcaggatcaaaggactacgttcatgtacgcatccagcagcgtaatggtcgcaagagtctgactactgtccagggattgaagaaggaattcagctacaacaagatcctaaaagatctcaagaaagagttctgctgcaatggtacagtggtccaggacccagagcttggacaggtcattcaactccagggtgatcagaggaagaacgtctcaaatttccttgtcca

SEQ ID NO: 48608 - protein, 100 aa, Panicum virgatum
  misc_feature: Ceres CLONE 2044553
  misc_feature (27)..(100): Pfam Name: SUI1 Pfam Description: Translation initiation factor SUI1
  misc_feature: Functional homolog of the protein sequence given in SEQ ID NO 50445
  misc_feature: Useful for making plants with modulated biomass
  misc_feature: Useful for making plants with modulated flowering time
MSELDIQIPTAFDPFAEANAGDSGAAAGSKDYVHVRIQQRNGRKSLTTVQGLKKEFSYNKILKDLKKEFCCNGTVVQDPELGQVIQLQGDQRKNVSNFLV

SEQ ID NO: 48609 - DNA, 689 bp, Panicum virgatum
  misc_feature: Ceres CLONE 2044578
  misc_feature: Encodes the peptide sequence at SEQ ID NO. 48610
cttaacgccccagtgatcttcaagccggagccacctccacctccgcctccgcctccacacccacccgcacgcgcgcgcagccatggcagctgctcaaggtggcagtgctgtctcttcctctgagaaagttgattttctcaagcttcaaaatggcagtgatattcgtggtgttgctgttgctggggttgaaggtgagcctgtcaacctcacggaacctgccactgaagctatagctgcagcttttgctgcgtggctgttaaacaggaaggaagcagatggattgagacgtttaagaatctctgttggacatgactcacgaatctctgcccataaattgcagaatgcagttactcatggaatcactgcggctggacatgatatcctacagtttggattggcctcgacacctgcaatgttcaacagtacacttacaaaagatgagaggaatcatttacccgttgatggagccataatgataacagccagtcatcttccctacaatcgaaatggtctcaagttttttacaagtgatggtgggttaaataaggctgatatcaaagatatcctggagcatgcttctaaaatatacgaggaatctgcacatggtaaacggcaagaacgggaggatgcttctaggggagttgtgaatagtgtggactacatgtcaatttatgcttctgatcttgtac

SEQ ID NO: 48610 - protein, 202 aa, Panicum virgatum
  misc_feature: Ceres CLONE 2044578
  misc_feature (19)..(172): Pfam Name: PGM_PMM_I Pfam Description: Phosphoglucomutase/phosphomannomutase, alpha/beta/alpha domain I
  misc_feature: SWISSPROT Homolog: EC 5.4.2.10 Phosphoglucosamine mutase
MAAAQGGSAVSSSEKVDFLKLQNGSDIRGVAVAGVEGEPVNLTEPATEAIAAAFAAWLLNRKEADGLRRLRISVGHDSRISAHKLQNAVTHGITAAGHDILQFGLASTPAMFNSTLTKDERNHLPVDGAIMITASHLPYNRNGLKFFTSDGGLNKADIKDILEHASKIYEESAHGKRQEREDASRGVVNSVDYMSIYASDLV

SEQ ID NO: 48611 - DNA, 691 bp, Panicum virgatum
  misc_feature: Ceres CLONE 2044593
  misc_feature: Encodes the peptide sequence at SEQ ID NO. 48612
atctgcaatctatctgctccacatcagtagcagtagccgtagcagcggggagtcactcatggcggccgcgtcgcacaagcccctgggcgcgatcaccgccggcgacctggccgccgcggcgcccgggacggacgccgccgcgttccacgcggccctccggcgcgcgctcggcgccggcgacgcggaccccgccgccgtgtggggggagctctgccggtccctgctccgcccggacgtccccttcgccatccaccggatgctttactacggctgcttcgccgggctcccgtcccccacgccgcccgcctggacccccgaccccgaggaggcggccttgaccaatgtcggccgcgtcatggaggcgcgggggagggagctcctcggagacgcgtaccaggatcccatcaccagcttcactgacctctacaagttctccaacgagaacccagaggcgtactggaagatggtctttgaggatatgggtgttgagttcagtgtggagccgtcttgcatctggagagagagccatgcgtatcctggtggcgagtggttaccgggcgcagagctgaatgctgccgccaattgcctgacggctaaacctgggagaagctccgaggatgttgccattgtgtggagggatgaaggaaaggattcagaaccctctcacttcatgactcttgaggagctgagg

SEQ ID NO: 48612 - protein, 210 aa, Panicum virgatum
  misc_feature: Ceres CLONE 2044593
  misc_feature: SWISSPROT Homolog: EC 6.2.1.1 Acetate--CoA ligase
MAAASHKPLGAITAGDLAAAAPGTDAAAFHAALRRALGAGDADPAAVWGELCRSLLRPDVPFAIHRMLYYGCFAGLPSPTPPAWTPDPEEAALTNVGRVMEARGRELLGDAYQDPITSFTDLYKFSNENPEAYWKMVFEDMGVEFSVEPSCIWRESHAYPGGEWLPGAELNAAANCLTAKPGRSSEDVAIVWRDEGKDSEPSHFMTLEEL

SEQ ID NO: 48613 - DNA, 673 bp, Panicum virgatum
  misc_feature: Ceres CLONE 2044594
  misc_feature: Encodes the peptide sequence at SEQ ID NO. 48614
ctcatccgcgcaggccaaccaacagtgccctccctcctctccttccgcgtcgcgtgccctcgccgcagcccatccccatggcggaccagctcaccgacgagcagatcgcggagttcaaggaggcgttcagcctcttcgacaaggacggcgacggttgcatcactaccaaggagctgggaactgttatgcgctcccttggccagaaccctactgaagcagagctgcaggacatgatcaacgaggttgatgctgatggcaatggtaccatcgacttcccagagttcctgaacctgatggcaaggaagatgaaggacactgactccgaggaggagctcaaggaggctttccgcgtcttcgacaaggaccagaacggtttcatctcggctgctgagctccgccatgtcatgaccaaccttggtgagaagctgaccgacgaggaagtcgacgagatgatccgtgaggctgatgtggacggtgatggccagatcaactatgaggagtttgtcaaggtcatgatggccaagtgaggagcggtcccccaaaaataagtttgtccaaagcaaactgaattatcaggctcacaagctgtactttgtcatgtcctgttgatgagcacgtatcagtatcatgcaggtggtaatgttgagtagtggcggttgggggggggggtaaa

SEQ ID NO: 48614 - protein, 149 aa, Panicum virgatum; identical to SEQ ID NO: 9768
  misc_feature: Ceres CLONE 2044594
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 48615 - DNA, 695 bp, Panicum virgatum
  misc_feature: Ceres CLONE 2044595
  misc_feature: Encodes the peptide sequence at SEQ ID NO. 48616
ctacaaatttgttgtcttttaagagtgataattcatccaccaagaattctgagattggtgacaaggtagcagatatgccagctgctcctctgaatgtacaagtttctcatgatgatgacagtgcaaaggataattcagttgccaaaacagatgaaattccagcatctcctgctgataatcagagtatattggtttctctatcttctcgttgtgtttggaaagaaactctgtgtgaaaggccacatcttcttcgcataaaatattatggtaactttgacaaacctttaggcaggtttctgcgtgaccagctatttgatcagagcaacctttgccactcttgtgagctgccaccagaggcccatgtttattgctatgttcacccccaaggcagcttaacaatatcagtaaggaaactttcagtaaagttgcctggtgatggtgaacatgatggtagaatttggatgtggcatagatgcttacgctgtcctcgagttaatgggctccctccagctactaaaagagtagtgatgtctgatgctgcctggggcttgtcatttggtaaatttttggaacttagtttttcaaatcatgcagcagcaagtagagtcgccagctgtggtcattctcttcacagggattgccttcgcttttatggctttggcgaaatggttgcttgcttccgatatgcatcaatt

SEQ ID NO: 48616 - protein, 230 aa, Panicum virgatum
  misc_feature: Ceres CLONE 2044595
  misc_feature: SWISSPROT Homolog: EC 2.7.1.68 1-phosphatidylinositol-4-phosphate 5-kinase
TNLLSFKSDNSSTKNSEIGDKVADMPAAPLNVQVSHDDDSAKDNSVAKTDEIPASPADNQSILVSLSSRCVWKETLCERPHLLRIKYYGNFDKPLGRFLRDQLFDQSNLCHSCELPPEAHVYCYVHPQGSLTISVRKLSVKLPGDGEHDGRIWMWHRCLRCPRVNGLPPATKRVVMSDAAWGLSFGKFLELSFSNHAAASRVASCGHSLHRDCLRFYGFGEMVACFRYAS

SEQ ID NO: 48617 - DNA, 655 bp, Panicum virgatum
  misc_feature: Ceres CLONE 2044619
  misc_feature: Encodes the peptide sequence at SEQ ID NO. 48618
tgagattcgtttctggtggaaatgaagatgatcaaggtgaagcaactgtttcagattcagatttggatgatataattggggtctcagatagctctgcgctggaggaaagggatccccctgattctctgctatgtgatctacgcccttatcaaaagcaggcccttcattggatgctgcagcttgagaaaggtagttcttcccagaatgcagctacaacccttcacccttgttgggaagcatacaaactcgaggacaagagggagctagttttgtacttgaatgtattctcaggcgatgctacaactgaatttcctagtacactacaactttcaagaggagggattctggcagatgcaatgggactggggaagactattatgacaatagctcttcttctttctgattctagcaaaggatgcatcacaactcagaatactactcacatctttggagaagccagtgggttgggtgaatcgcaagatgctgtgaagaagcttgctagccctttctcttttagcaggcacaagacagtcaaggccccacttattgaaggtggcaatctaattatctgcccgatgacactaataagtcagtggaaggcagagattgaagctcatactaagccaggtgctgtgaatatatacgttcactatgg

SEQ ID NO: 48618 - protein, 217 aa, Panicum virgatum
  misc_feature: Ceres CLONE 2044619
  misc_feature: The sequence is a functional homolog of SEQ ID NO 1846 in the 11/479,226 US patent application
  misc_feature: The sequence is a functional homolog of SEQ ID NO 300 in the 10/374,780 US patent application
  misc_feature: The sequence is a functional homolog of SEQ ID NO 836 in the 10/225,066 US patent application
RFVSGGNEDDQGEATVSDSDLDDIIGVSDSSALEERDPPDSLLCDLRPYQKQALHWMLQLEKGSSSQNAATTLHPCWEAYKLEDKRELVLYLNVFSGDATTEFPSTLQLSRGGILADAMGLGKTIMTIALLLSDSSKGCITTQNTTHIFGEASGLGESQDAVKKLASPFSFSRHKTVKAPLIEGGNLIICPMTLISQWKAEIEAHTKPGAVNIYVHY

SEQ ID NO: 48619 - DNA, 700 bp, Panicum virgatum
  misc_feature: Ceres CLONE 2044629
  misc_feature: Encodes the peptide sequence at SEQ ID NO. 48620
tctccagggaccacgggaggacgcaacaccaacgcccttctcctcctcctcctctctctctctcctcggaggttaagggacggtgcttctgaccatggcaggaactttactccagtcagttgccctcggaacaacatttgcaggtcgcataagcacccagcaattgaggtcccatggcgccaggaggcctgtctctatgttggcaatgtcgcttagccgccctgtcaagatgtcagcatttgttggcctaagatcggtacatagcttctcgatcacaccgacagtgtccaattccaggtcagcagttgcatcttacagatcgtctcggcggacaaggcgttctcgttttgttactcgggcgatgtttgagaggtttacagagaaagctattaaggtcatcatgcttgcgcaagaggaagcaaggcgcctgggtcacaactttgttggaaccgagcaaattctcttgggtctgatcggagagggcactggtattgcagcaaaggtgctcaagtccatgggtataaatctcaaggatgcacgtgtggaagtggaaaagatcattgggcggggcaacggctttgttgctgttgaaataccattcacaccgcgcgctaaacgtgttttggagctctcattggaggaagctcgccaattaggacacaattatattggatctgagcacctgctttctggactgctt

SEQ ID NO: 48620 - protein, 201 aa, Panicum virgatum
  misc_feature: Ceres CLONE 2044629
  misc_feature (105)..(157): Pfam Name: Clp_N Pfam Description: Clp amino terminal domain
MAGTLLQSVALGTTFAGRISTQQLRSHGARRPVSMLAMSLSRPVKMSAFVGLRSVHSFSITPTVSNSRSAVASYRSSRRTRRSRFVTRAMFERFTEKAIKVIMLAQEEARRLGHNFVGTEQILLGLIGEGTGIAAKVLKSMGINLKDARVEVEKIIGRGNGFVAVEIPFTPRAKRVLELSLEEARQLGHNYIGSEHLLSGL

SEQ ID NO: 48621 - DNA, 660 bp, Panicum virgatum
  misc_feature: Ceres CLONE 2044635
  misc_feature: Encodes the peptide sequence at SEQ ID NO. 48622
atttgtcgtcagtaaatagatcgaggacaccatgggtaattttcattgggcacagaccgatgtattcctcccatatcggcataccagccaatgtggatcttatttttgtaacatctgtcgagccactattgctgaagtaccaggtggatttggttttcttcggccatgtacacaactacgagaggacttgtgcattatataagaacaattgcaaaggcatgccaaagaaggacgcaagtggaattgatacttatgacaccagcaactataccgcgccagttcatgccattgttggagctggagggttcagcttggacaaattccctaagattgtgttgaacaagtggagctcatccagggtttcggagtttggatatgccagggtgcgtgctacaagaactgatgttttggttcagtttgtaaactcaggtacaatggaagtacgggaccagtttagaattgtgaaatgagctccagcaaggaagctacgaagctgtggatcagcatctttttatttttgatatgccataagttggcgctgcattatacatcagcgcacagcgtgtattctacagttgcttgtattataaatctgtacatcaatagtacacgtatttgtacgaagtgttttgactccattttcctgttgacttccgtggc

SEQ ID NO: 48622 - protein, 155 aa, Panicum virgatum
  misc_feature: Ceres CLONE 2044635
  misc_feature: SWISSPROT Homolog: EC 3.1.3.2 Acid phosphatase
LSSVNRSRTPWVIFIGHRPMYSSHIGIPANVDLIFVTSVEPLLLKYQVDLVFFGHVHNYERTCALYKNNCKGMPKKDASGIDTYDTSNYTAPVHAIVGAGGFSLDKFPKIVLNKWSSSRVSEFGYARVRATRTDVLVQFVNSGTMEVRDQFRIVK

SEQ ID NO: 48623 - DNA, 676 bp, Panicum virgatum
  misc_feature: Ceres CLONE 2044640
  misc_feature: Encodes the peptide sequence at SEQ ID NO. 48624
ggggatgggcgtcgtcctcctgctccagagctcactccgctcgcgctcctccgccaccgtaggtccgctctccgcctcatttcctctcccctcccctgttgcccagcttcaatcgtcgtctgctcacgctctgttcttgggcacggattgcggtgaggccgtgaaggtcgtgggctggttacttgaccctccgccgcgtccctcttgctcccgtctggggttcaggaggagtgatatccagtggttgagtgcttcaagtatttgagattgaaacagaaaatgtcttcctcaaggcctactcagtgttccagttcgtccagcaggactcgccagaactcacgagcaaggatattagcacaaacaacccttgatgctgaactcaatgcagagtttgaagaatctggtgattccttcgattattccaagttggttgaagcgcagcggagcgctccacctgagcagcaagggcgttcagagaaggtcatagcctacttgcagcacattcagagaggaaagctaatccaaccatttggttgcttgttggcccttgatgagaagagcttcagggttattgcattcagtgagaatgctccggaaatgcttacaacagtcagccatgctgtgcctaatgttgatgattccccaaagctaggaattggtaccaatgtgcgctccc

SEQ ID NO: 48624 - protein, 132 aa, Panicum virgatum
  misc_feature: Ceres CLONE 2044640
  misc_feature (70)..(132): Pfam Name: PAS_2 Pfam Description: PAS fold
  misc_feature: SWISSPROT Homolog: EC 2.7.11.1 Non-specific serine/threonine protein kinase
  misc_feature: Functional homolog of the protein sequence given in SEQ ID NO 51315
  misc_feature: Useful for making plants with modulated biomass
  misc_feature: Useful for making plants with modulated light quality response
  misc_feature: Useful for making plants with modulated light quality sensitivity
MSSSRPTQCSSSSSRTRQNSRARILAQTTLDAELNAEFEESGDSFDYSKLVEAQRSAPPEQQGRSEKVIAYLQHIQRGKLIQPFGCLLALDEKSFRVIAFSENAPEMLTTVSHAVPNVDDSPKLGIGTNVRS

SEQ ID NO: 48625 - DNA, 707 bp, Panicum virgatum
  misc_feature: Ceres CLONE 2044640-R
  misc_feature: Encodes the peptide sequence at SEQ ID NO. 48626
gatctccaagagcaatgtagtggatgacatggtcycaagcaacgctatcctttatgagcccggcgagcatcctgatcacgttgttgtgatcaagtatgtgccgtacgttggggacagcaagagagccatggatgagtacacctctgagatattcatgggcggcaagaacaccatcgttctgcacaacacctgcgaggactcgctcctcgccgcaccaatcattcttgatctggtgctcctggctgagctcagcaccaggattcagctaaaagctgagggagaggagaagttccactccttccacccagtggccaccatcctgagctacctcaccaaggcacccctggttccccccggcacgccggtggtgaatgccctggcgaagcagagggcgatgctggagaacatcatgagagcctgcatcgggctggcccccgagaacaacatgatcctggagtacaagtgagcgctgcggctatgcagcagggggcgcctactggaagggaacaagaaaggcgagactagctgtgggactggtgttggcttctcgtttgtttttttgcgttctttcctgctcattgttgtacacttttgtaagggtttgctcgtcaggtcgtgattatcagggctctgctattagcggcacgaaccctgaaactgtgtcgtatgataatgtgctgagggtgctagttgccctctgtattcct

SEQ ID NO: 48626 - protein, 154 aa, Panicum virgatum
  misc_feature: Ceres CLONE 2044640-R
  misc_feature (1)..(67): Pfam Name: Inos-1-P_synth Pfam Description: Myo-inositol-1-phosphate synthase
  misc_feature: SWISSPROT Homolog: EC 5.5.1.4 Inositol-3-phosphate synthase
  misc_feature (12)..(12): Xaa is any aa, unknown, or other
ISKSNVVDDMVXSNAILYEPGEHPDHVVVIKYVPYVGDSKRAMDEYTSEIFMGGKNTIVLHNTCEDSLLAAPIILDLVLLAELSTRIQLKAEGEEKFHSFHPVATILSYLTKAPLVPPGTPVVNALAKQRAMLENIMRACIGLAPENNMILEYK

SEQ ID NO: 48627 - DNA, 664 bp, Panicum virgatum
  misc_feature: Ceres CLONE 2044644
  misc_feature: Encodes the peptide sequence at SEQ ID NO. 48628
agatctaaggtcaggttatcatcagctcagagtgcgacaagaggacatctccaatacagccttcaggacccattatggccagtatgagttcacagtgatgccttttggtctgactaatgcccctgccttttttatgaccctcatgaataaggtgtttatggaagagttagatcggtttgtcgtggtattcatagatgacatactggtctactctaagagtgctgaggagcatggacaacatctcagaattgtgctgggaaagctcagaaaacaccagttgtatgccaagtttagcaagtgtgaattctagctgcagagggtcagttttctgggtcatgtcttaacagctgaaggtgttgaagtggacctagaaaaggtcaaggcagtatcagaatggaagcaaccaacctcagcctcggagatcaggagtttcttgggattagccggctattatcggagatttatcgaaggtttctctaagatagcccggcctatgaccgagttgctccggaaggacacgaagtttgtctggtctgaaacttgcgagagaagttttcaagagttgaagaggagactaacttctgccacagtgctagtcttgccagataatcagaaaagctttgtcgtttattgcgacgcatccagacaaggattgggttgtgtg

SEQ ID NO: 48628 - protein, 102 aa, Panicum virgatum
  misc_feature: Ceres CLONE 2044644
  misc_feature: SWISSPROT Homolog: EC 2.7.7.49 RNA-directed DNA polymerase
DLRSGYHQLRVRQEDISNTAFRTHYGQYEFTVMPFGLTNAPAFFMTLMNKVFMEELDRFVVVFIDDILVYSKSAEEHGQHLRIVLGKLRKHQLYAKFSKCEF

SEQ ID NO: 48629 - DNA, 618 bp, Panicum virgatum
  misc_feature: Ceres CLONE 2044647
  misc_feature: Encodes the peptide sequence at SEQ ID NO. 48630
aacaccaatacaaagtcccggctcgaactttttacacgcggacccccggcttcgccagaaatcgcctcggagcgggagatctcgcgggaggggaccatccgccggcgaggatgtccaccgcgaggcgcgcccacccgccgctgcagaacggcgctgggggcgacgacggggacgacgagcgggacgaggaggaggaggaggacggcgatggggaattggaggatgaggcggaggaggaggaggaggaggagccgcggctcaagtaccagcggctgggcgggagcgtgccggcgatcctctccaccgatgccgccgcgtccatcgccgtcgccgaccgcatggtcgcgctcggcacccacaacggcaccctccacatcctcgacttccagggcaatcaggtgaaggaaattgctgcccacacagcaactatcaatgacatcagttttgatgccgacggtgaatatataggcagttgctcagatgatggcacagtagcaataagcagcctcttcactgatgaaaaactgaagtttgagtaccatcgcccgatgaaagcaattgctctagaccctaattattcccggaactataggagatttgctactggtggattagcag

SEQ ID NO: 48630 - protein, 169 aa, Panicum virgatum
  misc_feature: Ceres CLONE 2044647
  misc_feature (94)..(132): Pfam Name: WD40 Pfam Description: WD domain, G-beta repeat
MSTARRAHPPLQNGAGGDDGDDERDEEEEEDGDGELEDEAEEEEEEEPRLKYQRLGGSVPAILSTDAAASIAVADRMVALGTHNGTLHILDFQGNQVKEIAAHTATINDISFDADGEYIGSCSDDGTVAISSLFTDEKLKFEYHRPMKAIALDPNYSRNYRRFATGGLA

SEQ ID NO: 48631 - DNA, 741 bp, Panicum virgatum
  misc_feature: Ceres CLONE 2044684
  misc_feature: Encodes the peptide sequence at SEQ ID NO. 48632
aagcaaagcacccaagagcagagagcaacgcaggaacaaactagcaggcgagccatcaatggcgacaacgacgccggtgaaggttgggctgatcggcggtgaatcaggcgatccaaaggacatctctccaagccagctgccgagaacccttgagaagatcgaaatttggagctcagatgacggaccgaggtccggcggagtcatcaatggcatccgcttcacttacgttgacaccaagggagtaaggcacgtcgtcccgagccggtcgggtgcggcttggggcacgacttctggtcgttttcacgagttcaagattgctacaggggcaaaagagtacgtgaggaggattgacggcaccactggtccctgtccggatggtgatactggcgtcacttccctgacaatcaccacctccacagggaaaacggcgacatacggggatccatgtaacgggactgcattctctgtgccactggataatgccggcatctttgccttcttcgctaacgctgacacctacctcaatgcactgggtttctacacccagccctacccatgaactgcaccgaaccaactgcgaggactcaactagtgtgagtatatatgcatactcgcatcccgcccttctgtaataccacttaaataaaatgggatctagtactcgcagctagttactgcagcatgcgctgcgatgcatatcgaatggatcctccaccatgcgtgcactgtatattcttgtgc

SEQ ID NO: 48632 - protein, 166 aa, Panicum virgatum
  misc_feature: Ceres CLONE 2044684
  misc_feature (36)..(164): Pfam Name: Jacalin Pfam Description: Jacalin-like lectin domain
MATTTPVKVGLIGGESGDPKDISPSQLPRTLEKIEIWSSDDGPRSGGVINGIRFTYVDTKGVRHVVPSRSGAAWGTTSGRFHEFKIATGAKEYVRRIDGTTGPCPDGDTGVTSLTITTSTGKTATYGDPCNGTAFSVPLDNAGIFAFFANADTYLNALGFYTQPYP

SEQ ID NO: 48633 - DNA, 458 bp, Panicum virgatum
  misc_feature: Ceres CLONE 2044686
  misc_feature: Encodes the peptide sequence at SEQ ID NO. 48634
agcgtcacaagcgaagtcagagaagagttagggtttcccagtcgcgacctctgccgccgccaccgccaccatgggacactccaacgtgtggaactcgcacccgaagaactacggccccggatcccgggtttgccgtgtgtgcgccaacccccacggcttgatccgaaagtacgggctcatgtgctgcaggcagtgcttccgcagcaacgccaaggacatcggcttcatcaagtaccgctaaaaacttgagaggtctgaagcatcacgaaaatgggagcatggatgaggagcatcttcgatccgtcttttgcttagtactgtgataatcataccatgtaatgaattatttgggtttgaaatggaccaagtcgtattctggctggcactctagtgcaccctagttgagcatgttgaaccgctatgatcagactagtacaatattgttactattgtggctc

SEQ ID NO: 48634 - protein, 56 aa, Panicum virgatum; identical to SEQ ID NO: 9888
  misc_feature: Ceres CLONE 2044686
  misc_feature (3)..(56): Pfam Name: Ribosomal_S14 Pfam Description: Ribosomal protein S14p/S29e
  misc_feature: Functional homolog of the protein sequence given in SEQ ID NO 50136
  misc_feature: Useful for making plants with modulated nitrogen use efficiency

SEQ ID NO: 48635 - DNA, 699 bp, Panicum virgatum
  misc_feature: Ceres CLONE 2044695
  misc_feature: Encodes the peptide sequence at SEQ ID NO. 48636
tttattagggatgctaggcagcaactcctcttggggataaggcgagcaaataggcaacctgttaacctctcatcatctgttttgtctagtgacagtatgcatattggtattcttgctgctgcagcccatgcagcagctaacaacagccaattcacggtattctataacccaagggcaagtccttcagaatttgtgattcctttcgccaagtaccagaaagctgtctatagcaaccaactatctcttggcatgcggtttaggatgatgtttgaaacagaagaatctgggacaagaaggtacatgggaacaataacaggtataagtgatatggatcctgtaaggtggaaaaactcccagtggcgcaatattcaggttgcatgggatgaagctgcgccaagtgagaggcgcaccagggtttccctctgggagattgaacctgtcattgctccattcttcatctatccctcaccattgttcactgcaaaacgtccaagacaaccagggataacagatgatgagacctctgacatggaaaatctttttaagcggaccatgccatggtttggtgaggagatttacaagaaagatctgaatactcagaataacttagttcctggattaagtttagttcagtggatgcaacagaacccctcgctcactagcacagttgggcagccggaattgctacactcattagct

SEQ ID NO: 48636 - protein, 232 aa, Panicum virgatum
  misc_feature: Ceres CLONE 2044695
  misc_feature (41)..(124): Pfam Name: Auxin_resp Pfam Description: Auxin response factor
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: Functional homolog of the protein sequence given in SEQ ID NO 50498
  misc_feature: Useful for making plants with modulated light quality sensitivity
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 100 in the 10/666,642 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
FIRDARQQLLLGIRRANRQPVNLSSSVLSSDSMHIGILAAAAHAAANNSQFTVFYNPRASPSEFVIPFAKYQKAVYSNQLSLGMRFRMMFETEESGTRRYMGTITGISDMDPVRWKNSQWRNIQVAWDEAAPSERRTRVSLWEIEPVIAPFFIYPSPLFTAKRPRQPGITDDETSDMENLFKRTMPWFGEEIYKKDLNTQNNLVPGLSLVQWMQQNPSLTSTVGQPELLHSL

SEQ ID NO: 48637 - DNA, 707 bp, Panicum virgatum
  misc_feature: Ceres CLONE 2044699
  misc_feature: Encodes the peptide sequence at SEQ ID NO. 48638
tcaagaaagactgaaggttgtacctggtgatgatgctatgagcattgaggctcagaagaatgcaaccttgttcttcaatatcctgcttcgtagcacatttgctagcaagagggtcttgaaggaatacaggcttacaaaggaagctttcgaatgggttattggtgagattgaatctaggttccttcagtctttggtggcccctggtgaaatgattggatgtgtggctgcacagtccattggagaaccagcaactcagatgactctgaataccttccattatgctggtgtcagtgccaagaatgtcactcttggggttcccaggttgagagagattattaatgttgccaagaaaataaagactccatctttgtctgtttacctgaagcctgaggtgaacaagatgaaagagtcggctaagaatgttcaatgtgctctagagtacaccacactgtgcagtgtaacccatgccactgagatatggtatgaccctgatcctctaggaaccatcattgaagaggatgtggagttcgtccggtcatattatgaaatgcccgatgaagatattgacccggatcagatttctccttggctgctgcgtattgagcttaaccgtgagatgatggttgataagaagttgagcatggctgatattgctgagaagatcaaccgtgaatttgatgatgacctgtcatgcatatttaatgatg

SEQ ID NO: 48638 - protein, 235 aa, Panicum virgatum
  misc_feature: Ceres CLONE 2044699
  misc_feature (148)..(235): Pfam Name: RNA_pol_Rpb1_7 Pfam Description: RNA polymerase Rpb1, domain 7
  misc_feature (1)..(63): Pfam Name: RNA_pol_Rpb1_6 Pfam Description: RNA polymerase Rpb1, domain 6
  misc_feature: SWISSPROT Homolog: EC 2.7.7.6 DNA-directed RNA polymerase
QERLKVVPGDDAMSIEAQKNATLFFNILLRSTFASKRVLKEYRLTKEAFEWVIGEIESRFLQSLVAPGEMIGCVAAQSIGEPATQMTLNTFHYAGVSAKNVTLGVPRLREIINVAKKIKTPSLSVYLKPEVNKMKESAKNVQCALEYTTLCSVTHATEIWYDPDPLGTIIEEDVEFVRSYYEMPDEDIDPDQISPWLLRIELNREMMVDKKLSMADIAEKINREFDDDLSCIFND

SEQ ID NO: 48639 - DNA, 710 bp, Panicum virgatum
  misc_feature: Ceres CLONE 2044707
  misc_feature: Encodes the peptide sequence at SEQ ID NO. 48640
gagttctaggctaccactgctgccactaggccccaggagaaaaggaaggggacctacctggaagtgtgaaccgccgcgtctctgcgagatccaaaccccctcctcaacacgacgccggcgacgaagggaggaggcgatgcacggccggccccggcgcccggccaagccggaggacgaggcggcgtcgtcagcgaaagccgccaagctccgggacctccaggcccaggtcctgcagaaccaccactcccgcacctacaccaaagaggcaattgggttgagcttcaaactgctcgagataaatcctgaggcctacactgcatggaactaccggaagcttgcgttccagcacaatatcaaggagctttctgacccagaggccatcaggtccgccgtcgacgatgagctcagagtggttgaggttgctttaaggcagaacccaaagtcctatggggcttggtatcaccagaagtggttgttaaaccaaaagctagccccagtggattccaagcgtgaatttggcctcttggataaactattaaaggtagatgccaggaatttccatggatggaattaccgaaggttccttgcaagattcatgggagtgccagatgaggaagagcttaagtacactatggataagatcagtgacaacttcagtaattactcagcatggcacaatcgtagtatacttctgtccaatctactaatcc

SEQ ID NO: 48640 - protein, 191 aa, Panicum virgatum
  misc_feature: Ceres CLONE 2044707
  misc_feature (160)..(190): Pfam Name: PPTA Pfam Description: Protein prenyltransferase alpha subunit repeat
  misc_feature (125)..(154): Pfam Name: PPTA Pfam Description: Protein prenyltransferase alpha subunit repeat
  misc_feature (88)..(118): Pfam Name: PPTA Pfam Description: Protein prenyltransferase alpha subunit repeat
  misc_feature: SWISSPROT Homolog: EC 2.5.1.60 Protein geranylgeranyltransferase type II
MHGRPRRPAKPEDEAASSAKAAKLRDLQAQVLQNHHSRTYTKEAIGLSFKLLEINPEAYTAWNYRKLAFQHNIKELSDPEAIRSAVDDELRVVEVALRQNPKSYGAWYHQKWLLNQKLAPVDSKREFGLLDKLLKVDARNFHGWNYRRFLARFMGVPDEEELKYTMDKISDNFSNYSAWHNRSILLSNLLI

SEQ ID NO: 48641 - DNA, 719 bp, Panicum virgatum
  misc_feature: Ceres CLONE 2044712
  misc_feature: Encodes the peptide sequence at SEQ ID NO. 48642
aaacctcgtctccggctcaagcagaggtggcagttaagtgcaccatgtgtcattccaagcagctggcgaaagtcgccatgcccatgcttatactattgccgttgctgctgctgtgctatggagttggaaacatccattgctcaaccgttcatgataacagcggagatctgaaggcactcctcgatttcaggcagggcattcccagtgatccatatggagccatgagcaattggaccatgaactcccacttctgtcagtggaatggtatcacgtgcacctggacacgacgacaatggcgtgtcctgtcgctcgccctcccagacaaaaatttagctggaaaaatcagctcctctctctgcaacctcaccttccttgtttatcttgacctctcctctaataacttcgtgagtcccttaccagactcacttacaaattgctccaacttaaactacttagatttatcatcaaacttactggtgggtacaattcctccaaaattaggcctgctgtcacatctaaactttctcgatttgcgttcaaatcacttcgagggaagcattcctggtgagcttggccaattggtgaatttacgaagcttgctcctaggagaaaatagtttgtcaggtgaaatcccacatgccatctttaataatctttcttctctacgatatctatatctgcattccaattccctaggcaaggcattgccatctaacata

SEQ ID NO: 48642 - protein, 224 aa, Panicum virgatum
  misc_feature: Ceres CLONE 2044712
  misc_feature (38)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MCHSKQLAKVAMPMLILLPLLLLCYGVGNIHCSTVHDNSGDLKALLDFRQGIPSDPYGAMSNWTMNSHFCQWNGITCTWTRRQWRVLSLALPDKNLAGKISSSLCNLTFLVYLDLSSNNFVSPLPDSLTNCSNLNYLDLSSNLLVGTIPPKLGLLSHLNFLDLRSNHFEGSIPGELGQLVNLRSLLLGENSLSGEIPHAIFNNLSSLRYLYLHSNSLGKALPSN

SEQ ID NO: 48643 - DNA, 524 bp, Panicum virgatum
  misc_feature: Ceres CLONE 2044735
  misc_feature: Encodes the peptide sequence at SEQ ID NO. 48644
  misc_feature (132)..(132): n is a, c, t, g, unknown, or other
  misc_feature (133)..(133): n is a, c, t, g, unknown, or other
acatgattatgtgagcctgtttgctttagacacggttgcctctctgttcgctgggctggagctggtggctggtgctagaggggtgggagagaaaaatattattggttggttggtaggtggaggctggtgctnnagcggtgtgagaggaaatcactattgggtggaggctggtggagctgccgaacagagcgggaatgtgttttctgcatccgcgcgaccgcacctcattgagttctgaaatcttttgtccgttttgggaaaatgagagttctgcggaggctgaatttttcaccgagtatggggacgcgagtcgatacaagattcaggaagtcattggtaagggaagctacggggtagtatgctctgcaatagatgtgcacacaggagagaaagtagcgatcaagaagatacatgacatctttgagcacatatccgatgctgctcggattcttcgcgagatcaagcttctgagactcctaagacatccggacattgttgagatcaaacatcttatgttgcctcca

SEQ ID NO: 48644 - protein, 109 aa, Panicum virgatum
  misc_feature: Ceres CLONE 2044735
  misc_feature: SWISSPROT Homolog: EC 2.7.11.24 Mitogen-activated protein kinase
  misc_feature: Functional homolog of the protein sequence given in SEQ ID NO 50346
  misc_feature: Useful for making plants with altered cell wall content and/or composition
MCFLHPRDRTSLSSEIFCPFWENESSAEAEFFTEYGDASRYKIQEVIGKGSYGVVCSAIDVHTGEKVAIKKIHDIFEHISDAARILREIKLLRLLRHPDIVEIKHLMLP

SEQ ID NO: 48645 - DNA, 618 bp, Panicum virgatum
  misc_feature: Ceres CLONE 2044746
  misc_feature: Encodes the peptide sequence at SEQ ID NO. 48646
cctcccctcctttttaatcggcaacgcctactcaacccgaccgcagctggtgagagaagggttcggtgccgaaaaccccaatcgccgccgcccccctcccctcctccggccgccgccgcctcccgcattccgccgcgccgatcgggttggtgagaggggtcgcgtgggatggcgtcgtcggcgtctgcgccggcgtccaagggtccgcgctacgcgcctcctgatccgacgctgcccaagccgtggagggcgctcatcgacggcaacaccgggtatctctacttctggaacccggagaccaaggtcacccagtacgagcgccccgtcgcggccgtaccctcctccccgccgcagccgcctggctactccaggcccgaggagagggcgaggagcagcgggccttccgagtcacgttcggaagctgcggtgagccgctcgcagtacgcgccttcctctgataacagaacgaggaatgatcactcagagagtgctcagttcaccaatcaattttctcaagccggcaatggaagccaaatgtcgacagaagcatatcgtgctaagcatgagattactattgttggcaacgaggcaccagcaccattcatgacatttcagtca

SEQ ID NO: 48646 - protein, 149 aa, Panicum virgatum
  misc_feature: Ceres CLONE 2044746
  misc_feature (22)..(52): Pfam Name: WW Pfam Description: WW domain
MASSASAPASKGPRYAPPDPTLPKPWRALIDGNTGYLYFWNPETKVTQYERPVAAVPSSPPQPPGYSRPEERARSSGPSESRSEAAVSRSQYAPSSDNRTRNDHSESAQFTNQFSQAGNGSQMSTEAYRAKHEITIVGNEAPAPFMTFQ

SEQ ID NO: 48647 - DNA, 737 bp, Panicum virgatum
  misc_feature: Ceres CLONE 2044748
  misc_feature: Encodes the peptide sequence at SEQ ID NO. 48648
atcccaagcagcagctagcatcaatggccacctcctcctcctcgatgaccctcctgctgctggtcctgggcgcctccttggcagccagcgccagcgccgcgatcttcaccatcaccaacaactgcgggttcacggtgtggccggcggcgacgcccgtgggcgggggcacgcagctgaacccaggcgggacgtggaccgtcaacgtgccggcgggcaccagctccggccgcgtgtgggcgcgcacgggctgctccttcaacggcaaccgcgggagctgccagacgggcgactgcggcggcgcgctcgcctgcacgctgtccggccagccgccgctgacgctggccgagttcaccatcggcggcagccaggactcctacgacatctcggtcatcgacggcttcaacgtcggcatggccttctcctgcagcaccggcgtcgggctggtgtgcagggactccggatgccctgacgcgtaccacaaccccaacgacgtcaagacccatgcctgtggcggcaacagcaactaccgggtcaccttctgcccgtgatcgatgagatgaggctgccgtaataatgtatcaagtgattatatatatatatatatatttgcagcaggaagaataatgcggacgcatcgtgcacggtatactgattgtgagagtagctacacgagtgtagataaaactcgtccatatatatgtagctggatctgtgtacgtatactccgtatacggtat

SEQ ID NO: 48648 - protein, 174 aa, Panicum virgatum
  misc_feature: Ceres CLONE 2044748
  misc_feature (32)..(174): Pfam Name: Thaumatin Pfam Description: Thaumatin family
MATSSSSMTLLLLVLGASLAASASAAIFTITNNCGFTVWPAATPVGGGTQLNPGGTWTVNVPAGTSSGRVWARTGCSFNGNRGSCQTGDCGGALACTLSGQPPLTLAEFTIGGSQDSYDISVIDGFNVGMAFSCSTGVGLVCRDSGCPDAYHNPNDVKTHACGGNSNYRVTFCP

SEQ ID NO: 48649 - DNA, 691 bp, Panicum virgatum
  misc_feature: Ceres CLONE 2044754
  misc_feature: Encodes the peptide sequence at SEQ ID NO. 48650
agttacacagagagttactcctcgtctcctcttccccccctgcggcttcgtcgtcgttgtcgcctcctcctcgcctgcgccccctgccctggtccgtcctcgtgcggttgtccaattccctccacggcaggaagcagctcccgcggtgaagcttgagtcgtgtagtggtgttacccatcaaggagaagttggactagtctgcagtccgcacaagtgctcgatgacagatcattttgctctaagtgttctacttctactggtgttaagtactacttgtttcagttcagacctagatgtccaatgcttgagagaagtacagaaatcggtgagtgatcccaatggtatactcaaatcctcatggatttttgaaaataacactgcgggttttatatgccgatttaccggtgtggagtgctggcacccagatgagaatcgagttctttcattgcacctcagcaaccttggtcttcagggtccattccctcaaggtcttaagaattgtaccagtatgacagggttggatctatcaagcaacaactttaccggccctattccttcagatatctctctgcaagtgccatttttgacatcgctggacctctcctataatggtttctcagcagaaattccactacttatctataacatgacatacctaaacacccttaatcttcaacataaccaattgagt

SEQ ID NO: 48650 - protein, 156 aa, Panicum virgatum
  misc_feature: Ceres CLONE 2044754
  misc_feature: SWISSPROT Homolog: EC 2.7.11.1 Non-specific serine/threonine protein kinase
MTDHFALSVLLLLVLSTTCFSSDLDVQCLREVQKSVSDPNGILKSSWIFENNTAGFICRFTGVECWHPDENRVLSLHLSNLGLQGPFPQGLKNCTSMTGLDLSSNNFTGPIPSDISLQVPFLTSLDLSYNGFSAEIPLLIYNMTYLNTLNLQHNQL

SEQ ID NO: 48651 - DNA, 690 bp, Panicum virgatum
  misc_feature: Ceres CLONE 2044765
  misc_feature: Encodes the peptide sequence at SEQ ID NO. 48652
cgtcagcttgctctgcaccgacaagatcccatgtagcggagtcaccatggacaatgtcaaggtcgagtacagcggcaaaaacaacaagaccatggccgtctgcaacaatgccaagggctcctccacaggctgcctcaaggagctcgcctgcctctgagggattcaagccaatgcaactcgttccctcctccgttgccatccatatatatgatggtaactactaccacacctacatttcctgcttgcacatgctcgtatgagatcgagcaatttaaatccagactggatggatactcttttactttcttgatttctctcgggagtcagttgacatagaataacaatgtgtgcagccgtatgaatgcatgtaaagcactgagatgtataccatgtatgtatttatgtactcaagtcccacgttttgccgattttgtttttataattttggcaaaaactagacatatataacactatgtataactagtgcctgtaagtggtcaaataatgtattcgaccacattctactagaagttgttgtcatgttatttccaaattctcttgagaaccattgcttagaagattttaaccttctattttttttaaaaaaaaacgagtgccttcaaaaaaataaaaagattagacagaaagaggtaactgcaacaactcctagtatgtaaagtaattttaatt

SEQ ID NO: 48652 - protein, 51 aa, Panicum virgatum
  misc_feature: Ceres CLONE 2044765
  misc_feature: SWISSPROT Homolog: EC 3.2.1.67 Galacturan 1,4-alpha-galacturonidase
VSLLCTDKIPCSGVTMDNVKVEYSGKNNKTMAVCNNAKGSSTGCLKELACL

SEQ ID NO: 48653 - DNA, 622 bp, Panicum virgatum
  misc_feature: Ceres CLONE 2044781
  misc_feature: Encodes the peptide sequence at SEQ ID NO. 48654
gacgcctgccgcttggcttggctcctctcctcctcctccacctccctctcgcctcgcgtcgcttctcccccactccactccgcctcccccctcgcgtcgcggatcgcggcgccctctgatctgatgccggggaggccctgatggcggcggcgggagctggagcggccggtggcggcgggggagccgggggcggggaggggtcctcctcctccccggcgggcgtcgcgatcgggccccaccaccacggggccgcggaagaggccatgtggcaaatgactttaggaggaggagaatctattgaacatggtcccttccctgagagaattggagaaccagactgtagttattatatgaggactggactttgtagatttggggcaacgtgcaagttcaatcacccgccaaacaggaagctggctgttgccgctgcaaggatgaaaggggagtatccttacagagttggtcaaccagagtgtcaatattatctgaagaccgggacatgcaagtttggagcaacatgcaagtttcatcaccccagagaaaaggctgcgattgcaacgcgagtacagttgaatgttctaggttacccaataaggccgaatgagaaggaatgtgcttatta

SEQ ID NO: 48654 - protein, 160 aa, Panicum virgatum
  misc_feature: Ceres CLONE 2044781
  misc_feature (62)..(88): Pfam Name: zf-CCCH Pfam Description: Zinc finger C-x8-C-x5-C-x3-H type (and similar)
  misc_feature (107)..(133): Pfam Name: zf-CCCH Pfam Description: Zinc finger C-x8-C-x5-C-x3-H type (and similar)
  misc_feature: Functional homolog of the protein sequence given in SEQ ID NO 50340
  misc_feature: Useful for making plants with modulated nitrogen use efficiency
  misc_feature: Functional homolog of the protein sequence given in SEQ ID NO 50341
  misc_feature: Useful for making plants with modulated low light sensitivity
MAAAGAGAAGGGGGAGGGEGSSSSPAGVAIGPHHHGAAEEAMWQMTLGGGESIEHGPFPERIGEPDCSYYMRTGLCRFGATCKFNHPPNRKLAVAAARMKGEYPYRVGQPECQYYLKTGTCKFGATCKFHHPREKAAIATRVQLNVLGYPIRPNEKECAY

SEQ ID NO: 48655 - DNA, 683 bp, Panicum virgatum
  misc_feature: Ceres CLONE 2044800
  misc_feature: Encodes the peptide sequence at SEQ ID NO. 48656
gcatcgcaaacacttctccgaacgcgcccggaccttttccgcttccgcccccggcgcccccacgaaatccccgaacgcgcggcgccaggaggagaggagaggaggagtcgaggagacccggaccgagacgcgtagcacgcggaaccctcgaggggccaggacgcgaaaaggtagagcgcacacagccacgcgcggcggcggcaggccggcggcgaggcgagggctctgctcccggcggcggcggcgtcctgggcgagggcggaggagccgatcgtgcgcgccattgggggcacgcggcgccgtgttgacccccgctccgcgaccggcgcgcgcggttcgtgcggcgcgtggcccctccccgcgcttcgggggcgcctgcggatttctccgccgtcctactcgccgtcctcggcgcgatggaggccggctactgcaaccgcaagaagacggacatctgcgagggcgtctgcgacaccgagtatggttcaaagtcagttctgagcatgtcaaggctgaagtgcgcactgcggggatttgatttgagggctctcttgatcatactgattggtgttcctattctgatcttcctcatatacgtgcatggacagaaggtcacttacttcctccgcccgatctgggaaaagcccccaaagcccttcaaaatacttcctcactactatcat

SEQ ID NO: 48656 - protein, 88 aa, Panicum virgatum
  misc_feature: Ceres CLONE 2044800
  misc_feature: Functional homolog of the protein sequence given in SEQ ID NO 50780
  misc_feature: Useful for making plants with altered carbohydrate content
MEAGYCNRKKTDICEGVCDTEYGSKSVLSMSRLKCALRGFDLRALLIILIGVPILIFLIYVHGQKVTYFLRPIWEKPPKPFKILPHYY

SEQ ID NO: 48657 - DNA, 615 bp, Panicum virgatum
  misc_feature: Ceres CLONE 2044802
  misc_feature: Encodes the peptide sequence at SEQ ID NO. 48658
gaagaggaagaggaagatggcattgtttgtcaagttcaacaatcacaagcaaagcaatctcatcatccctctgcagattactgtacattaaaagctgctttctcttgtgtcttccctcgtcttgttgctatttccaacctctgcctctctcgtccctctctctctctctctctctcctggatgttcatgtcctgaccacgccgctctacgcgcttcttcaaggtctctgacaattggttggtttcaaggcgattaggaagactgtctttggagcatgtatagggccaagagagctgcttcacttaaggtgaagcgccgcgttggcaagtatgagcttggccgcacaattggggaaggaacatttgcaaaggtccggattgcaaagaacatggaaactggggatcatgtagctatcaagatcattgacaaggcaaaggttcagaagcacaaattggttgaacagattaagagggaaatttgcacaatgaaattaatacagcatcccaatgttgtccgattgtatgaggtgatgggaagtaaaaggaggatctacattgttctggaatttgttatgggtggagagctccatgatatcgttgccacaagtggaagatt

SEQ ID NO: 48658 - protein, 113 aa, Panicum virgatum
  misc_feature: Ceres CLONE 2044802
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
MYRAKRAASLKVKRRVGKYELGRTIGEGTFAKVRIAKNMETGDHVAIKIIDKAKVQKHKLVEQIKREICTMKLIQHPNVVRLYEVMGSKRRIYIVLEFVMGGELHDIVATSGR

SEQ ID NO: 48659 - DNA, 548 bp, Panicum virgatum
  misc_feature: Ceres CLONE 2044808
  misc_feature: Encodes the peptide sequence at SEQ ID NO. 48660
tcctcgctctctcggtctctccggtagtctggtctctcctctctcgagtctcgccgtgatccacccccaaaaaaaaaaaagagtctcgccgtgacgccgtgttccccaatccccacccaaaccacgacatggcgcggccgccggatctgatcgacgacgccaccacagagatcctcctccgcctcccgccggacgacccggcgtgcctcgtgcgcgcctccctcgtctgcaaggcctggcgcgagctcctctccgaccccgccttcctccgccgctaccgcgcgttccacgccgcgccgcccctgctcggcttcctccgcaacatctacgacgacggtccctgcgctcgattcgtcgtcgccgccgccggcgcctcccccttccccgcgccgtcgttcgaccgccccaactggtgggtcgtcgagtgccgccacgggcgcgcgctgctccaaacgttcgagcagggtacgctcgcgggcctcgtcgtctgggaccccatcaccggcgaccagcgccacgtgcccgtgccagggtacccttacttctac

SEQ ID NO: 48660 - protein, 139 aa, Panicum virgatum
  misc_feature: Ceres CLONE 2044808
  misc_feature (2)..(52): Pfam Name: F-box Pfam Description: F-box domain
MARPPDLIDDATTEILLRLPPDDPACLVRASLVCKAWRELLSDPAFLRRYRAFHAAPPLLGFLRNIYDDGPCARFVVAAAGASPFPAPSFDRPNWWVVECRHGRALLQTFEQGTLAGLVVWDPITGDQRHVPVPGYPYF

SEQ ID NO: 48661 - DNA, 712 bp, Panicum virgatum
  misc_feature: Ceres CLONE 2044831
  misc_feature: Encodes the peptide sequence at SEQ ID NO. 48662
aggtgtcagttctttctccttccccggcacgccccctcctttctttcttcctcgcgctcatcccatctccgaccagactcccccccatcattcgccctcccaagattcgtttcagtatccaaatccccactatctccatggattcctcttccagttttaccaggaggcttggatgcgcctcccgttgtgtgcagccactagaagaacctgtcttccgttgcttctgtggggatcccgccttttctgtaacctcaggaactctccggaatcctggtcgcaagttctacatctgccacaaggcaggaatcggcaggggctgcaagctttggatttgggaggatgtgcttatgcgatttgttgatgaaatggtggagtactgcaccgcttcaacccttgactgcctgcatgaacaactttccttggcccgcgaagcgttggtcagcaatgaggagaagcttgacaagatccgccaggaagctgaggaagagcatgtcaaaatggtgctcaaagtccaggaattggaagtgaagctgcaagagtcagagcacaaggtgcagagtttgcgtcaggttcaggcaagctggggcaagacacttgccacttttgctgctctgttcgtgtttgctgtttggtgtgtgctgaactatcctaatcaagctaattcggataggtcagggggtgaagatggtcagttctagtcgatatgtgtgat

SEQ ID NO: 48662 - protein, 186 aa, Panicum virgatum
  misc_feature: Ceres CLONE 2044831
  misc_feature (26)..(70): Pfam Name: zf-GRF Pfam Description: GRF zinc finger
MDSSSSFTRRLGCASRCVQPLEEPVFRCFCGDPAFSVTSGTLRNPGRKFYICHKAGIGRGCKLWIWEDVLMRFVDEMVEYCTASTLDCLHEQLSLAREALVSNEEKLDKIRQEAEEEHVKMVLKVQELEVKLQESEHKVQSLRQVQASWGKTLATFAALFVFAVWCVLNYPNQANSDRSGGEDGQF

SEQ ID NO: 48663 - DNA, 703 bp, Panicum virgatum
  misc_feature: Ceres CLONE 2044845
  misc_feature: Encodes the peptide sequence at SEQ ID NO. 48664
tactgccggccgtccagccaccgcgagctcgaaccccctctcacgcagagtatgaccccagtcacgacaagctgaattgttcgagaacatgtggcaatacaagtattccattcccctttgggcttgaaccagactgttcagctaatgccaattttcaactcagttgcacatcaaatcaacccctgatccaaaaaccatattactcggagcagtatcaggtggtggaaaatatttctttagatgaaggactcatatttgtcaacaaaacatatgaccttaaagacatgtcaactattgatgatttaatagatgaaacagagcaacatggtatttggaaatgggctatcagcaacacaacttgtgacatggcccagaaccacacaagctatgcatgcatcagtgcaaacagtgagtgcacgaatgtcacccacggagatgcctacattggttatcgttgcaagtgttcacctggctatgaaggaaacccttacacccgcaggaatggtagttgccaagatatcgacgagtgtgtgaagataccctacgtatgtaatgaaacatgccataacctggaaggaagctacaattgcaccagctgccctcaaggcacatctttcgatcatgtagaaaggcaatgcacttacagtaaacatcacagctttgtttttgctgttgctactggacttggctctggttttggagt

SEQ ID NO: 48664 - protein, 233 aa, Panicum virgatum
  misc_feature: Ceres CLONE 2044845
  misc_feature (172)..(212): Pfam Name: EGF_CA Pfam Description: Calcium binding EGF domain
  misc_feature: SWISSPROT Homolog: EC 3.1.1.4 Phospholipase A(2)
LPAVQPPRARTPSHAEYDPSHDKLNCSRTCGNTSIPFPFGLEPDCSANANFQLSCTSNQPLIQKPYYSEQYQVVENISLDEGLIFVNKTYDLKDMSTIDDLIDETEQHGIWKWAISNTTCDMAQNHTSYACISANSECTNVTHGDAYIGYRCKCSPGYEGNPYTRRNGSCQDIDECVKIPYVCNETCHNLEGSYNCTSCPQGTSFDHVERQCTYSKHHSFVFAVATGLGSGFG

SEQ ID NO: 48665 - DNA, 702 bp, Panicum virgatum
  misc_feature: Ceres CLONE 2044851
  misc_feature: Encodes the peptide sequence at SEQ ID NO. 48666
agtcccaacaagacaattccttccatctcccgcgttccttattttccccttgctaccctgctctacccgaggctatcctcttttctgattcgttctcccccaatctcccctcctcttcccggcagcagatagaagctgtacctgttcctctgcgatttgggctcgtcttagctcctggtgctcaaaagctcaagcctttccagggctgggaggcgacaaatcggaggggattcggagcgcaaagttttgtatccaggggggaaaaggttttctgcatccaaagttgggcgcttttgcttatctgcttaacagaaatcgcttgcttttgtgtgggaaagccagatcttgtccacagattcgggtttgaaatctgtgagtgagtcgacgaacaagatttcgatagggttgttgctagcaggctcgctttgaagatcttgatcaccacaagaaatttgcagttattgtgccttatcactattcactggacatgtccttccgcagcatagtccgtgatgttagggaaagctttggtagcttatcaagacggagttttgaggttagaatttctggtctgcctggtcttggtcatcacagagggaaatctgttggatctgtgagcaacctgcacgatggacctatagtagttgatcaaagcaggtgggttggtcttcctcccgagttgcttcgagatgtaatgaaaag

SEQ ID NO: 48666 - protein, 71 aa, Panicum virgatum
  misc_feature: Ceres CLONE 2044851
  misc_feature: The sequence is a functional homolog of SEQ ID NO 458 in the 10/666,642 US patent application
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
MSFRSIVRDVRESFGSLSRRSFEVRISGLPGLGHHRGKSVGSVSNLHDGPIVVDQSRWVGLPPELLRDVMK

SEQ ID NO: 48667 - DNA, 691 bp, Panicum virgatum
  misc_feature: Ceres CLONE 2044861
  misc_feature: Encodes the peptide sequence at SEQ ID NO. 48668
aaagaccaccaccattcgacgcaaaaccgaggttctcccccccaccctgaaagcgtcgccgggcgcagatccggccaccagcgcgatctccgctgcagcgcagtgaaattagtcaagttactctcaatgcttcagatatagcacaaaaccatgggagaagttactgaaaataattcagacatgtctgttctacaaagaattgctacgagcggtatgccactgttgaaagactatggtctgaatggagttgttggtgctgtgctcctggctatagttattcctttattgcttacctcaatgtttggcaaaaagacaaagaaaagggcagtgcaagctgacgtgggtggagaggcgggacttgccatgcgaaacagtagattttcatccttagttcaagtcccatgggagggtgccaccacaatggcagctctattcgagatggccagcaaaaagtactctcgacggaggtgtcttggcacaagaaagctaattaataaggaatttgtcgagtcatctgatggtaggaagtttgagaaattgcatcttggtgaatatcaatgggatacctatgcagaagcttttaatcgtgcatgtaattttgcttctggacttatcaagatgggccacaaactagatagtcatgcagcaatcttttctgatacaagagctgagtggatcattgctgcccagg

SEQ ID NO: 48668 - protein, 180 aa, Panicum virgatum
  misc_feature: Ceres CLONE 2044861
  misc_feature: SWISSPROT Homolog: EC 6.2.1.3 Long-chain-fatty-acid--CoA ligase
MGEVTENNSDMSVLQRIATSGMPLLKDYGLNGVVGAVLLAIVIPLLLTSMFGKKTKKRAVQADVGGEAGLAMRNSRFSSLVQVPWEGATTMAALFEMASKKYSRRRCLGTRKLINKEFVESSDGRKFEKLHLGEYQWDTYAEAFNRACNFASGLIKMGHKLDSHAAIFSDTRAEWIIAAQ

SEQ ID NO: 48669 - DNA, 715 bp, Panicum virgatum
  misc_feature: Ceres CLONE 2044863
  misc_feature: Encodes the peptide sequence at SEQ ID NO. 48670
gtgcgccgcccatcgttcccgacgccgacgccaaccctccctcgccgccggcgacgggagtcgcccttccgtcgagcccctactctcgcgcctgggcccaggggtggagggaaaatccgtgactggcttcctctgctgttggctgagctgctccgattcaattaataaagaagggcgaaagactacgctagctcttgctgctgctggaacaacttaccccaggatcatggcgagccttgctgattcttttctagcggatcttgatgaactgtcagacaatgaaggctatcctgaagaagacaatgctgaggcagctggtatggaggatgatggtgatgatgatatgcctgaccttgagtcccttaattacgatgatctggatagtgtctcaaagttgcagaagacacaacgctataatgacataatgcaaaaagttgaagatgcacttcagaaaggcactgacttctccaatcaaggttccatcctggaggaggatccagagtaccagcttatcgttgattgcaatgctttatcagtagatattgagaatgagatcatcataatccataatttcatacgtgacaagtataggttgaagtttcctgaactggaatccctcgttcatcatccgatcgattatgcccgtgttgtcaaaaagattgggaatgagatggatttaacacttgtagatctggaaagggcttttaccttctgc

SEQ ID NO: 48670 - protein, 162 aa, Panicum virgatum
  misc_feature: Ceres CLONE 2044863
  misc_feature (95)..(147): Pfam Name: NOSIC Pfam Description: NOSIC (NUC001) domain
MASLADSFLADLDELSDNEGYPEEDNAEAAGMEDDGDDDMPDLESLNYDDLDSVSKLQKTQRYNDIMQKVEDALQKGTDFSNQGSILEEDPEYQLIVDCNALSVDIENEIIIIHNFIRDKYRLKFPELESLVHHPIDYARVVKKIGNEMDLTLVDLERAFTF

SEQ ID NO: 48671 - DNA, 675 bp, Panicum virgatum
  misc_feature: Ceres CLONE 2044880
  misc_feature: Encodes the peptide sequence at SEQ ID NO. 48672
aaataaagactccatctttgtctgtttacctgaagcctgaggtgaacaagatgaaagagtcggctaagaatgttcaatgtgctctagagtacaccacactgcgcagtgtaacccatgccactgagatatggtatgaccctgatcctctaggaaccatcattgaagaggatgtggagttcgtccggtcatattatgaaatgcccgatgaagatattgacccggatcagatttctccttggctgctgcgtattgagcttaaccgtgagatgatggttgataagaagttgagcatggctgatattgctgagaagatcaaccgtgaatttgatgatgacctgtcatgcatatttaatgatgataatgctgataagctcatcctccgtatccgcatcacaaatgatgacgctccaaagggagaaatacaagatgagtctgctgaggatgatgtcttcctcaagaagatagagggcaacatgttgacagaaatggctctaagaggcatcccagacatcaacaaagtgttcatcaaacttgggaaggtcaatagatttgagcaagacgatggtttcaaagcagatcaggagtggatgcttgatacagaaggcgtgaatctcttagccgtgatgtgtcatgaggatgtcgatgctacaagaacaacaagtaatcatttgattg

SEQ ID NO: 48672 - protein, 224 aa, Panicum virgatum
  misc_feature: Ceres CLONE 2044880
  misc_feature (31)..(165): Pfam Name: RNA_pol_Rpb1_7 Pfam Description: RNA polymerase Rpb1, domain 7
  misc_feature: SWISSPROT Homolog: EC 2.7.7.6 DNA-directed RNA polymerase
IKTPSLSVYLKPEVNKMKESAKNVQCALEYTTLRSVTHATEIWYDPDPLGTIIEEDVEFVRSYYEMPDEDIDPDQISPWLLRIELNREMMVDKKLSMADIAEKINREFDDDLSCIFNDDNADKLILRIRITNDDAPKGEIQDESAEDDVFLKKIEGNMLTEMALRGIPDINKVFIKLGKVNRFEQDDGFKADQEWMLDTEGVNLLAVMCHEDVDATRTTSNHLI

SEQ ID NO: 48673 - DNA, 691 bp, Panicum virgatum
  misc_feature: Ceres CLONE 2044890
  misc_feature: Encodes the peptide sequence at SEQ ID NO. 48674
aaccttggattaagctgaagaggaggatattgtaaggagccagaagcaccacgctgctgatgcgcctttgccatttctttccatcgagcttcaaggtacattcagcggcgcttcagttgaccataggatactttcagaaaggatgaagctattagctttcatgttagttttatcagggttcttacaatcttccattgcttctgagttccaagtccaggcactgtatgatatgaagatgcaactcaacgatacctatggtgtacttaaaggctggaaggataatcaaagccatggtggtgcccttaatgactggaaggataatcaaatgagcccatgctattgggaccatatcatttgtcattatagcaaggtcatagcaataattttgaactcatctggattaacaggagtcttgtcacccagtattggaaagctagagactctacaacagctgtcactggaagggaactacatatatggagagataccattggagcttggtaacctatcaaatttggaaattctgagtctaggaacaaatgattttagtgggtcaatacctgactcttttggccacctaaggaaactccaaaaactggatctaagaagaaaccgcttaagtgggaaggttccaaacactctgtcagatcttcaatccttgaactacatcaatctggcagataacaatctt

SEQ ID NO: 48674 - protein, 182 aa, Panicum virgatum
  misc_feature: Ceres CLONE 2044890
  misc_feature: SWISSPROT Homolog: EC 2.7.11.1 Non-specific serine/threonine protein kinase
MKLLAFMLVLSGFLQSSIASEFQVQALYDMKMQLNDTYGVLKGWKDNQSHGGALNDWKDNQMSPCYWDHIICHYSKVIAIILNSSGLTGVLSPSIGKLETLQQLSLEGNYIYGEIPLELGNLSNLEILSLGTNDFSGSIPDSFGHLRKLQKLDLRRNRLSGKVPNTLSDLQSLNYINLADNN

SEQ ID NO: 48675 - DNA, 721 bp, Panicum virgatum
  misc_feature: Ceres CLONE 2044891
  misc_feature: Encodes the peptide sequence at SEQ ID NO. 48676
acttgctctgtcctactcctactcccccaatcagtcagccaccacgagcagaacaggtgaagtcatcggcagctcgtcaccgttcgttcgcaaaagccaagccaagccaagccaatccacgcctgctccggcgatcccgcgcggcatggagagcctcggcgcgaacccggcgaactcgagcccgctcacgccgctgggctttctggagcgcgcggcgaccgtcttcggcgactgcccctccgtcgtctacaacgacaccgtcttcacttggtcccagacttaccggagatgcctccgcctcgcctccgcgctcgtctccctcggcgtctcccgccgcgacatcgtgtccgtgctcctgcccaacgtgccggcgatgtacgagatgcacttcggcgtgcccatgagcggcgccgtgctcaacaccatcaacacgcggctcgacgcgcacacggtcgccgtccttctccgccactccggctcaaagctcgtcttcgtcgacccagcgtcgctccagctgatccgcgacgcgctgcagctcctcccgccgggccacccggctccgcgcatcatccccgtcgaggacccccacgagaaggagctccctcctgccgatccctccctgttgacgtacgagaggcttctcgagaagggcgacccggagttctcgtgggtgcggccgaccagcgagtgggatcccatgatactcaactacacctccggc

SEQ ID NO: 48676 - protein, 191 aa, Panicum virgatum
  misc_feature: Ceres CLONE 2044891
  misc_feature: SWISSPROT Homolog: EC 6.2.1.12 4-coumarate--CoA ligase
MESLGANPANSSPLTPLGFLERAATVFGDCPSVVYNDTVFTWSQTYRRCLRLASALVSLGVSRRDIVSVLLPNVPAMYEMHFGVPMSGAVLNTINTRLDAHTVAVLLRHSGSKLVFVDPASLQLIRDALQLLPPGHPAPRIIPVEDPHEKELPPADPSLLTYERLLEKGDPEFSWVRPTSEWDPMILNYTS

SEQ ID NO: 48677 - DNA, 683 bp, Panicum virgatum
  misc_feature: Ceres CLONE 2044893
  misc_feature: Encodes the peptide sequence at SEQ ID NO. 48678
gaaaccatccgctcctcgaaaaaacggcagcagaggccgagcgccgccgcggacccaatcgcccccaatcccacccagtccccgccccgagccgagatccgggggccagccgcattgccgcggatcgaggggatggcgccgcagctcaccggcgcgcccggctcggcggcggcgggcggcggcgcggcggccgtcaagccgcagttccaccactaccaccaccaccgcctgcccccgcgccaccaccaccccgcgccggcctcgctcctctccaagctcgccttctggtccgtctgctccctctcgctcctcctcgccttcctcctcctctccccctcctccgcgcccgccccgcgcgccgcgcccgagtccccgcgccgctcgctccacgcgtccccctcgtccaccgccgcccgggagaagaaggtgcgggcgtcagcgcgcgtcaggcgcccccggggccactccgtcctcgtcacgggcgccgcagggttcgtcggctgccacgcggctgccgcgctgcgccgccgcggagacggcgtgctcggcctcgacaacttcaacgactactacgacaccgccctcaagcgcgggcgggccgcgctcctcgcccgctcgggggtctacgtcgtcgacggggacatcgcggactcagagctgctggccaagctgttcgacgtcgt

SEQ ID NO: 48678 - protein, 183 aa, Panicum virgatum
  misc_feature: Ceres CLONE 2044893
  misc_feature: SWISSPROT Homolog: EC 5.1.3.6 UDP-glucuronate 4-epimerase
  misc_feature: Functional homolog of the protein sequence given in SEQ ID NO 50973
  misc_feature: Useful for making plants with altered carbohydrate content
  misc_feature: Functional homolog of the protein sequence given in SEQ ID NO 51754
  misc_feature: Useful for making plants with altered cell wall content and/or composition
MAPQLTGAPGSAAAGGGAAAVKPQFHHYHHHRLPPRHHHPAPASLLSKLAFWSVCSLSLLLAFLLLSPSSAPAPRAAPESPRRSLHASPSSTAAREKKVRASARVRRPRGHSVLVTGAAGFVGCHAAAALRRRGDGVLGLDNFNDYYDTALKRGRAALLARSGVYVVDGDIADSELLAKLFDV

SEQ ID NO: 48679 - DNA, 588 bp, Panicum virgatum
  misc_feature: Ceres CLONE 2044915
  misc_feature: Encodes the peptide sequence at SEQ ID NO. 48680
atcttctcggcagtacactcgctagatagctaagctgctctataaattaaattaaagctagtagtactgatcgatcggcatcgccggccggagatcgacatgacgacgatgatgaagaagcagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagcttatctgtatctatacatacatacatacatatgatcgctcgctcgctcgctcgatcttagtcgtctacgtgtggcttgctgctgttcatccagccgctcgctgcgtgtgtgtctatatatatatatacacacacacgacggataaataaaagatgcatgggttgcctc

SEQ ID NO: 48680 - protein, 95 aa, Panicum virgatum; identical to SEQ ID NO: 40288
  misc_feature: Ceres CLONE 2044915
  misc_feature (30)..(95): Pfam Name: Tryp_alpha_amyl Pfam Description: Protease inhibitor/seed storage/LTP family
  misc_feature: Functional homolog of the protein sequence given in SEQ ID NO 50399
  misc_feature: Useful for making plants with modulated biomass

SEQ ID NO: 48681 - DNA, 661 bp, Panicum virgatum
  misc_feature: Ceres CLONE 2044923
  misc_feature: Encodes the peptide sequence at SEQ ID NO. 48682
acctcatcacttccgtcgctccctccctccattgttgcttcgtgtgcaagcgcccaggcgaggccagcttcatgcaccatatggcctaggtgccgtagagatcctgaaaaggccgagcaagaagccttcttcgccacccagcgtcatcactacactgtactgtctccttgcttccatggagcatttcttgatgcaacgcaccaccgcatggccacgccggttcttcccctgctcgcctgtcctggtcctgctgctcttcctatctccaaccaactcccagaaccagagctcctgccacccgggtgatcttaaagccctggagggcttctccaaaggtctcgaccgaggaggcgtcggcggctgggcattcccgaacacgacctccgacgcagccagctgctgtgcatggggccgtgtcacgtgcgacggcagcgggagggtcgtcgggctggacctccatggccggaggctggggggcgagctgcctccctcgctcgcgcagctggaccacctccagtcgctcaacctctccgacaacagcttccgtggcgccgtcccagagcccctgttccagcttcagaggctgcagcagctcgacctcagcttaaatgagctcacaggcacgttgccggacaacatgtctcttccgtcgatcgagctc

SEQ ID NO: 48682 - protein, 161 aa, Panicum virgatum
  misc_feature: Ceres CLONE 2044923
  misc_feature: SWISSPROT Homolog: EC 2.7.11.1 Non-specific serine/threonine protein kinase
MEHFLMQRTTAWPRRFFPCSPVLVLLLFLSPTNSQNQSSCHPGDLKALEGFSKGLDRGGVGGWAFPNTTSDAASCCAWGRVTCDGSGRVVGLDLHGRRLGGELPPSLAQLDHLQSLNLSDNSFRGAVPEPLFQLQRLQQLDLSLNELTGTLPDNMSLPSIE

SEQ ID NO: 48683 - DNA, 694 bp, Panicum virgatum
  misc_feature: Ceres CLONE 2044927
  misc_feature: Encodes the peptide sequence at SEQ ID NO. 48684
  misc_feature (611)..(611): n is a, c, t, g, unknown, or other
gtgggcatcttcgttctgaacacaagaggttgccttcatctcttctctagtagtgccctcaagatctctctgagtttcctgagatctggtgagttttctccctgatcctgtgctgcacttctcagttgattctagttttgagtctgttcatgcaagtatatattcgttctgtggctatagttgttcttccacaagttctctgccaaagtgcttccagatctgagttataggttaccttgtaagctgacaagatggtgaagatctgctgcctcggagctggctatgttggcggtcctacaatggctgtcattgccctcaagtgcccagatattgaggttgttgttgttgacatctccaagcctcgcattgaggcctggaacagcgacacactcccaatctatgagcctggtctcgatgatgttgtgaagcagtgcaggggcagaaacctcttcttcagcactgatgttgagaagcatgttgctgaggctgacatcatcttcgtttctgtgaacacccccacgaagacccgtggacttggagcaggcaaagctgctgaccttacctactgggaaagtgctgctcgcatgattgccgatgtctccaagtctgancagattgttgttgagaagtccactgttccccgtgagactgcagaggctattgagaagatcttgactcacaacagcaaaggcat

SEQ ID NO: 48684 - protein, 147 aa, Panicum virgatum
  misc_feature: Ceres CLONE 2044927
  misc_feature (2)..(147): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
  misc_feature (120)..(120): Xaa is any aa, unknown, or other
MVKICCLGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSXQIVVEKSTVPRETAEAIEKILTHNSKG

SEQ ID NO: 48685 - DNA, 618 bp, Panicum virgatum
  misc_feature: Ceres CLONE 2044936
  misc_feature: Encodes the peptide sequence at SEQ ID NO. 48686
actgctgctgcatttgcgttactggttgcgagcagaccaggataagtggcctccggaggcgaccctcctcgtcgccgcccactacggcgacatccgccgcctcaaggagatcgcaaagagcatcgatgtcgaggggaaagggcttcaggagaccctggccaatgccaacttcataggcatgtacgccctccatgcagtctgtgacagtggggacatgtatgccctccagtatctggtcgaggacctcaacatggacgtcaacaagcctgacactatgcgaggtttcacgccggcaatgcatgccgggttatacgggaaccttcctaccttgaggtttctttttgatcatggcgctagtctgcatggacagcacaagggacttagtcttctccatgcagctgcagaaggagggcggcctgagatagccaaatttctgctttctagaggagctcgtgctgatgtggaagtggaatcagctcccttcaccccactgttccttgctacttatagaggatatgctagtatcctgaagatgtttttggagcaaaatgcagatgtaatatgctaactatactatttctacctgacatctctcaagttcaattcttttctcctcgc

SEQ ID NO: 48686 - protein, 188 aa, Panicum virgatum
  misc_feature: Ceres CLONE 2044936
  misc_feature: SWISSPROT Homolog: EC 2.7.11.1 Non-specific serine/threonine protein kinase
LLLHLRYWLRADQDKWPPEATLLVAAHYGDIRRLKEIAKSIDVEGKGLQETLANANFIGMYALHAVCDSGDMYALQYLVEDLNMDVNKPDTMRGFTPAMHAGLYGNLPTLRFLFDHGASLHGQHKGLSLLHAAAEGGRPEIAKFLLSRGARADVEVESAPFTPLFLATYRGYASILKMFLEQNADVIC

SEQ ID NO: 48687 - DNA, 669 bp, Panicum virgatum
  misc_feature: Ceres CLONE 2044949
  misc_feature: Encodes the peptide sequence at SEQ ID NO. 48688
atcgatcgcttccttgcctgcagccattgagctgccccgtaattgaattgaatagctgcagctatgacgtggttggggtttgcctcgccatgtctgtccctctttgggttctaccgaccctcccctgcccatcgactgggagtagagcgggtagtgccactgccacggaggcgccaatcgtcgtgtcccaaacctcatgaactactgttcgcgcaaccacgaacgcgacgtgccgtgcacgacgccgcgcgcaacggcggcagcagcatggatgtgagagagctggaggacaggataaggataagggagcagctcgtgagcgccgagcctccgccgccgcctccgtcagcatacgacacggcatgggtcgccatggtgccggcgccggggtcccttcaggttccgcacttcccgcagtgcgtggactggatcctgcggaaccagcgcggcgacggctcgtgggggccgcaggctggctccggcgacggcccgtggtcgctggggaaggactcgctctcgtcgacgatggcgtgcgtcctcgcgctccggacgtggggcgtcggcgacgagcacgtcggcaaagggctccgcttcattgggaacaacgcgtccttggtgacggacggcagaagcgacacgccggcagggttcaacgtcatcttccccggc

SEQ ID NO: 48688 - protein, 133 aa, Panicum virgatum
  misc_feature: Ceres CLONE 2044949
  misc_feature: SWISSPROT Homolog: EC 4.2.3.19 Ent-kaurene synthase
MDVRELEDRIRIREQLVSAEPPPPPPSAYDTAWVAMVPAPGSLQVPHFPQCVDWILRNQRGDGSWGPQAGSGDGPWSLGKDSLSSTMACVLALRTWGVGDEHVGKGLRFIGNNASLVTDGRSDTPAGFNVIFP

SEQ ID NO: 48689 - DNA, 670 bp, Panicum virgatum
  misc_feature: Ceres CLONE 2044963
  misc_feature: Encodes the peptide sequence at SEQ ID NO. 48690
aacttaaaagtttgttcacgcactaccccttcaaaattcagcagaaacaacagccgtgttctgcgctagctccagcggagcagaggtgcccattctctctcatcctgattagctattccgtacggacaaattctttcttgcttctgcttcaactttcaagcgtcataatagttctgagtgtaaactgtagactcttgtggtgctttggattactagcggtttaggctacttgtaggatgaaattaaagcttgttttggccgcttcttttgcttattattacgggaatcttggttggttagagtctgtgatcctgagttcattcatggacatcaactagctagcaccgcatgcacatgaacataccgtgcaagtgttttattctatttgatttgctggtgcaggaccaagatgtcaaccaatcaaccagcgaaacttaccatacttatattactgccactgttgctattattccacggctctagtaaaatcagctgctcaacggtccctgataataccaccgatgtcctctcgctgctagctttcaaggcagccaacgatccaactggagtgctcaactcttggaactccagcaccagccactgcatgtggaagggagtcaagtgcagcgtgacgcacccggggcgagtcacggcgctggaattctccggg

SEQ ID NO: 48690 - protein, 86 aa, Panicum virgatum
  misc_feature: Ceres CLONE 2044963
  misc_feature (35)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MSTNQPAKLTILILLPLLLLFHGSSKISCSTVPDNTTDVLSLLAFKAANDPTGVLNSWNSSTSHCMWKGVKCSVTHPGRVTALEFS

SEQ ID NO: 48691 - DNA, 677 bp, Panicum virgatum
  misc_feature: Ceres CLONE 2044972
  misc_feature: Encodes the peptide sequence at SEQ ID NO. 48692
aatccgagttggtggatcgcctcgcctccgcgctgcgcctgcctgctcgctcctccgcatttcacggttcagcagctagcctatcggcatggctgaggagactgccaatgatgcccaggtggcccaagaaaacgcggttgctcccaatgatgaggcggtccaaacagatgaattggtccaaggtgaagatatggctcaggctgatgagttgatacaaggtgaagaaatcaatcaaggtgatgagttggtccatggtgatgatttcgtgcaaggaaatgagttggtcgttgctgaggaaacgacccctcgtactggaaccagacggaggagaaagaagtccttggtatgggagcacttcactatcgaagaagtcgctggaggggtcacacgggcatgctgcaacctctgcaagcaaacctttgcttacagctcgggctcaaagattgctgggactagccatctcaagaggcacatcaccttgggttcttgtcctaagataaagaatcaagagcagaggctggcactgccatcagcaggaggtactgacaatgatggtgagggaactgtggagcggcgaactaagagacgatacagatatactggttatgcaaatgctgcttttgatcaagaccgcagttgctcctacctggcgaagatgatcattcagcatgactacc

SEQ ID NO: 48692 - protein, 196 aa, Panicum virgatum
  misc_feature: Ceres CLONE 2044972
  misc_feature (84)..(135): Pfam Name: zf-BED Pfam Description: BED zinc finger
MAEETANDAQVAQENAVAPNDEAVQTDELVQGEDMAQADELIQGEEINQGDELVHGDDFVQGNELVVAEETTPRTGTRRRRKKSLVWEHFTIEEVAGGVTRACCNLCKQTFAYSSGSKIAGTSHLKRHITLGSCPKIKNQEQRLALPSAGGTDNDGEGTVERRTKRRYRYTGYANAAFDQDRSCSYLAKMIIQHDY

SEQ ID NO: 48693 - DNA, 668 bp, Panicum virgatum
  misc_feature: Ceres CLONE 2044997
  misc_feature: Encodes the peptide sequence at SEQ ID NO. 48694
aaaaattccaaatctaccatcccaaaccctaaaccacacaatccgcgctgcaatgctccgccgccgccgcgccccgctcctcctcgccgccgccgcggcgggtgtcgcgctggcgactgcctccccgtccggcgacaacggccgaagcgttgcctccacgctccggcacggcgtcgcccgctcctcccgtgccgtctacacgattgggttcgtggtgacggattacaagtactccctgagggggctggattctgggtcagcggattaccgggttaagctctctgaggttcatctgcgttcagcgaaaaagctacttaaactatgtgaagtgaatggagggttttatgtaaaagctggtcaatatgtttcatcactaagacaagtaccaaaggagtactcgtcaactctctcctgcttgcaagatcaggcaactccatccaagtttcaagatataaaaatcgttatagagcaaaattttggcaggagattgcatgaaatattcctggaatttgacgaacatccgattgctgctgcatcaattgctcaggttcatcgaggtcgattgcatgacaatcaagatgtagctgtcaaggttcagtatcctggattggagcagcgaatgaagatagacatcatgacaatgtcttttcttgtcaaatcagtctctt

SEQ ID NO: 48694 - protein, 205 aa, Panicum virgatum
  misc_feature: Ceres CLONE 2044997
  misc_feature (140)..(205): Pfam Name: ABC1 Pfam Description: ABC1 family
MLRRRRAPLLLAAAAAGVALATASPSGDNGRSVASTLRHGVARSSRAVYTIGFVVTDYKYSLRGLDSGSADYRVKLSEVHLRSAKKLLKLCEVNGGFYVKAGQYVSSLRQVPKEYSSTLSCLQDQATPSKFQDIKIVIEQNFGRRLHEIFLEFDEHPIAAASIAQVHRGRLHDNQDVAVKVQYPGLEQRMKIDIMTMSFLVKSVS

SEQ ID NO: 48695 - DNA, 706 bp, Panicum virgatum
  misc_feature: Ceres CLONE 2045006
  misc_feature: Encodes the peptide sequence at SEQ ID NO. 48696
aaccctcccctcgccccccaataaaaaaaaaaaccttccatctcccaccaccgcctccgcctcggcaggcactgccaatctcctctcccctctccctctccctctccctctccctcctcgatcccaaggcgagagaccagggaacccgcgacgaccgcgcgcacgagccgctgcagtgagtgacctcgcaacccgcgcgcgtgagaggggagatcgagcagaaggtgccgggacccgaccgagccgaggactcgagaccatgaagtacgtgctggtgaccggcggcgtcgtgagcgggctgggaaagggcgtgacggccagcagcatcggcgtcctgctcaaggcctgcggcctccgcgtcacctccatcaagatcgatccatacctcaacaccgatgcaggaaccatgtctccgttcgagcatggcgaagtgtttgttttggacgacggtggtgaggtggacttggaccttggaaattatgaacggtttctggacatcaagttgactcgtgacaacaacataaccacgggaaagatctaccagtctgttattgacaaagaacgtagaggagattacctgggaaaaactgttcaggttgtgccacacatcacagatgaaatacaagagtggattgaacgtgtcgcaatgaatccagttgatgggacagaagagccagctgacgtctgtgtcatagaacttggtggt

SEQ ID NO: 48696 - protein, 148 aa, Panicum virgatum
  misc_feature: Ceres CLONE 2045006
  misc_feature (1)..(148): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVLLKACGLRVTSIKIDPYLNTDAGTMSPFEHGEVFVLDDGGEVDLDLGNYERFLDIKLTRDNNITTGKIYQSVIDKERRGDYLGKTVQVVPHITDEIQEWIERVAMNPVDGTEEPADVCVIELG

SEQ ID NO: 48697 - DNA, 638 bp, Panicum virgatum
  misc_feature: Ceres CLONE 2045015
  misc_feature: Encodes the peptide sequence at SEQ ID NO. 48698
agctccgccacaatatctatatccatctacccacctacacaagatgggtaacaccgtcatgctgcgggcgttggtgctggcgctcgcggtggccgccgccgccgccgccgccgggaagcggaagacgtacatcgtccacatggccaagtcagcgatgccggcggcgtacgcggaccgcggcgagtggtacggcgcctcgctgcgctccgtgtccgcggccggcaagatgctgtacgcctacgacacggtcctgcacggcttctcggcgcggctcacgccggcggaggccgcgggcctggcgcgcgtggagggcgtcctcgccgtcaacccggaggcgcggtacgagctgcacaccacgcggacgcccgagttcctgggcatcgcgggcgccgacctgctcccgcagtccgggacggcggcggacgtcgtcgtcggggtgctcgacaccggggtgtggcccgagagcccgagctacggcgacgcggggctcggggtggtgccctcgttctggaagggccagtgcgcggcgggtgccgggttcaacgcctccgcctgcaaccggaagctcgtcggcgcgcggttcttcaaccgcgggtacgaggccgccatggggcccatggacaccgaccgggagtcgc

SEQ ID NO: 48698 - protein, 198 aa, Panicum virgatum
  misc_feature: Ceres CLONE 2045015
  misc_feature (27)..(103): Pfam Name: Subtilisin_N Pfam Description: Subtilisin N-terminal Region
  misc_feature: SWISSPROT Homolog: EC 3.4.21.25 Cucumisin
MGNTVMLRALVLALAVAAAAAAAGKRKTYIVHMAKSAMPAAYADRGEWYGASLRSVSAAGKMLYAYDTVLHGFSARLTPAEAAGLARVEGVLAVNPEARYELHTTRTPEFLGIAGADLLPQSGTAADVVVGVLDTGVWPESPSYGDAGLGVVPSFWKGQCAAGAGFNASACNRKLVGARFFNRGYEAAMGPMDTDRES

SEQ ID NO: 48699 - DNA, 689 bp, Panicum virgatum
  misc_feature: Ceres CLONE 2045045
  misc_feature: Encodes the peptide sequence at SEQ ID NO. 48700
ggagtccagggcgacgactcttatcttctccgtcgttcatagcgagactagacgacggtgaggcagaggcgcacggccgcgcgcataggctgatcgacaggcgcacaggcagcaggcaggctcgtcaatggcgggcgacggctgcaacggcaacggagccgcagcggcggcgggcgtggtggtgccggagatcaagttcaccaagctcttcatcaacggcgagttcgtcgacgccgtctccggcaagacgttcgagacccgggacccgcggaccggcgacgtgctggcccaagtcgccgaggccgacaaggctgacgtcgacctcgccgtcaaggccgcccgggacgccttcgaccacggcaagtggccccgcatgtcaggatatgagcgcggccgtctcctgagcaagttcgcggacctggtggaccagcacacggaggagctggcggcgctggacggcgccgacgccgggaagctgctgctggtgggcaaggtcatcgacgtcccctccgccacgcagatgctgcgctactacgcgggcgccgccgacaagatccacggcgaggtgctgcgcatctccggcaagtaccagggctactcgctgagggagcccgtcggtgtggccggcgtcatcatcccgtggaacttccccaccatgatgttcttcctcaaggtcagccccgcgctcg

SEQ ID NO: 48700 - protein, 187 aa, Panicum virgatum
  misc_feature: Ceres CLONE 2045045
  misc_feature (33)..(187): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Functional homolog of the protein sequence given in SEQ ID NO 50708
  misc_feature: Useful for making plants with altered carbohydrate content
MAGDGCNGNGAAAAAGVVVPEIKFTKLFINGEFVDAVSGKTFETRDPRTGDVLAQVAEADKADVDLAVKAARDAFDHGKWPRMSGYERGRLLSKFADLVDQHTEELAALDGADAGKLLLVGKVIDVPSATQMLRYYAGAADKIHGEVLRISGKYQGYSLREPVGVAGVIIPWNFPTMMFFLKVSPAL

SEQ ID NO: 48701 - DNA, 268 bp, Panicum virgatum
  misc_feature: Ceres CLONE 2045075
  misc_feature: Encodes the peptide sequence at SEQ ID NO. 48702
ctgtcggtattggaaacgtcttcagttctttgattcattccgtggcgcgaaatccttcattggctaaacaattatttggttatgctattttgggctttgctctcaccgaagctattgcattgtttgccctaatgatggcctttttgatcttattcgttttctagtgtctaacgaagaaaagaactacatatggtctgatacttacttccttgaaaagaggaagacaagttatgtaggcggtagccattcatgtagcggttgctcgacc

SEQ ID NO: 48702 - protein, 53 aa, Panicum virgatum
  misc_feature: Ceres CLONE 2045075
  misc_feature (1)..(52): Pfam Name: ATP-synt_C Pfam Description: ATP synthase subunit C
  misc_feature: SWISSPROT Homolog: EC 3.6.3.14 H(+)-transporting two-sector ATPase
VGIGNVFSSLIHSVARNPSLAKQLFGYAILGFALTEAIALFALMMAFLILFVF

SEQ ID NO: 48703 - DNA, 686 bp, Panicum virgatum
  misc_feature: Ceres CLONE 2045077
  misc_feature: Encodes the peptide sequence at SEQ ID NO. 48704
agacaactcgccgctctcgtccgccacctcccctccgggccctccggccagctcccaccgcgtccgcctgcggctcagcggttgcctcctccaggccgggcaacgacgcgcctcctccatccgcagcttactctgaagaaaccgcgccgcgctatcccgttctccgcctcgtcccccaaaataccatctccccgccgttcgacagccgagggcggaggcggataggttccggagatgtcggtgctcatcgtgaccagcgtgggcgacatcgaggtggatctccacaccgacaagtgccccctcaccaccaagaactttctcaagctctgcaaaatgaagtattacaatgggtgtctgttccacaaggtggagaaggatttcttggcacaaactggcgatccgactggaactggcactggcggtgattctgtgtacaaatttctctatggtgatcaagctcgattttttgatgatgagatccgtccagagttgaggcattcaaaaactggaacagttgctatggcaagtgctggtgaaaactgcaatgcctcacagttctacattactttgcgggatgatgtggactaccttgatgataaacacactgtgtttgggatggttgctgaaggttttgatacattgacaaaaataaatgaagcttatgttgatgataaaggaagaccatt

SEQ ID NO: 48704 - protein, 150 aa, Panicum virgatum
  misc_feature: Ceres CLONE 2045077
  misc_feature (2)..(150): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MSVLIVTSVGDIEVDLHTDKCPLTTKNFLKLCKMKYYNGCLFHKVEKDFLAQTGDPTGTGTGGDSVYKFLYGDQARFFDDEIRPELRHSKTGTVAMASAGENCNASQFYITLRDDVDYLDDKHTVFGMVAEGFDTLTKINEAYVDDKGRP

SEQ ID NO: 48705 - DNA, 718 bp, Panicum virgatum
  misc_feature: Ceres CLONE 2045099
  misc_feature: Encodes the peptide sequence at SEQ ID NO. 48706
gccagccagccagcccgcccgctcccagacccgacccctggcaagtggcaacggcaacccgcgtgctacggccgccggcggcgacatggtgttcgagcaggaggaggaggtggcgccgggggccgtgcacgggcaccggctgtccacggtggtgccgagctcggtgacgggggaggtggactacgcgctggcggacgccgacctcgccttcaagctgcactacctccgcggggcgtactactacccgcccggcgacgtggcgcgcggcctcaccaccaaggtgctcaaggaccccatgttcccgtggctcgacgactacttccccgtcgccggccgcgtccgccgcgccgaggaggcgccggcggggggccagcccgaggccgccgccgccgagggcgccgcgcgccgcgcctacatcaaatgcaacgactgcggggtgcgcatcgtggaggccaagtgcgaccgcgacatggccgagtggctccgcgacgacgcgcccggccgcctcagccagctctgctacgacaaggtgctcggcccggagctcttcttctcgccgctgctctacgtccagatcacgaacttcaaatgcggcgggctggcgctcggcttcagctgggcgcacctcatcggcgacgtgttctcggccgccacctgctttcacaagtgggcgcagatcctgagcggcaagaaagccggaagccaccgtcctcccccg

SEQ ID NO: 48706 - protein, 210 aa, Panicum virgatum
  misc_feature: Ceres CLONE 2045099
  misc_feature: SWISSPROT Homolog: EC 2.3.1.150 Salutaridinol 7-O-acetyltransferase
MVFEQEEEVAPGAVHGHRLSTVVPSSVTGEVDYALADADLAFKLHYLRGAYYYPPGDVARGLTTKVLKDPMFPWLDDYFPVAGRVRRAEEAPAGGQPEAAAAEGAARRAYIKCNDCGVRIVEAKCDRDMAEWLRDDAPGRLSQLCYDKVLGPELFFSPLLYVQITNFKCGGLALGFSWAHLIGDVFSAATCFHKWAQILSGKKAGSHRPP

SEQ ID NO: 48707 - DNA, 655 bp, Panicum virgatum
  misc_feature: Ceres CLONE 2045120
  misc_feature: Encodes the peptide sequence at SEQ ID NO. 48708
acgccacaccccacgtcttcaaatttaaaggccgccaggaccggatcacatcgatcaaatccattatcagaattaataataacaaagaaaaaagctaaaagaaaatcaaatccatcgctccatccatctccagcacctccgcgtgctcctctggatttcttctccgctgccccccgaactcctcgtgcgcctcgcgggacgaagacgacaagagggcgagggcgtggggggccgatcgcgatcgccagcgcgcagccatgtcgacgtcgcggaggcgaaccctcctcaaggtcatcgtcctcggcgacagcggggtcgggaagacgtccctgatgaaccaatatgtccacaaaaagttcagtcagcagtacaaagctacaattggtgcagatttcgtcacaaaggaggttctcatcgaagacaggctagtgactttgcagatctgggacacggcagggcaggagagattccagagtcttggtgttgcgttctacagaggggcagattgttgtgtgcttgtctatgatgtcaactctaacaggtcattcgatacactcaacacatggcatgatgagtttctcaatcaagtaagaatatcttatcttacaaattgtttgatattttgctcatggttttagatatcgaacgtagtggt

SEQ ID NO: 48708 - protein, 126 aa, Panicum virgatum
  misc_feature: Ceres CLONE 2045120
  misc_feature (11)..(123): Pfam Name: Ras Pfam Description: Ras family
  misc_feature: SWISSPROT Homolog: EC 2.7.11.1 Non-specific serine/threonine protein kinase
  misc_feature: Functional homolog of the protein sequence given in SEQ ID NO 50193
  misc_feature: Useful for making plants with modulated water use efficiency
MSTSRRRTLLKVIVLGDSGVGKTSLMNQYVHKKFSQQYKATIGADFVTKEVLIEDRLVTLQIWDTAGQERFQSLGVAFYRGADCCVLVYDVNSNRSFDTLNTWHDEFLNQVRISYLTNCLIFCSWF

SEQ ID NO: 48709 - DNA, 659 bp, Panicum virgatum
  misc_feature: Ceres CLONE 2045130
  misc_feature: Encodes the peptide sequence at SEQ ID NO. 48710
ggcagtgggagggaggaccacgtcgggcgccggaggagcgaggagtcgaggccgcggcgagatcgctctggtggtggtcgcgcggcggcggttctcgtccgcggagatggagagcacgctcaaggggatacggggctgcggcgcgcccggcgtgctggacgtggacgacgcggccaccgtgggcggcggcgtcggggacacctacggcgaggactgcgccaccgaggaccagctcgtcacgccctggaccgtctccgtcgccagtggttacaatttgatgagggacccccgctacaacaagggcctcgccttcacagagagggagcgcgagacgcactacctccgtggccttctgccaccagcaatagtatcccaagagcttcaggagagaaagatcatgaacaatatcagacaataccaggtgcctttgcagcgttacatggctatgatggacttacaggagaacaatgagaggcttttctacaagctcctcatcgacaatgtcgaggaattacttcctgtagtgtacacaccaactgttggtgaggcttgccagaagtatggttccatatttagtcgtcctcacggtctttttatcagcttgaaggagaagggaaagatccttgaggtgctcaagaactggccagagaggagcattc

SEQ ID NO: 48710 - protein, 184 aa, Panicum virgatum
  misc_feature: Ceres CLONE 2045130
  misc_feature (118)..(183): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MESTLKGIRGCGAPGVLDVDDAATVGGGVGDTYGEDCATEDQLVTPWTVSVASGYNLMRDPRYNKGLAFTERERETHYLRGLLPPAIVSQELQERKIMNNIRQYQVPLQRYMAMMDLQENNERLFYKLLIDNVEELLPVVYTPTVGEACQKYGSIFSRPHGLFISLKEKGKILEVLKNWPERSI

SEQ ID NO: 48711 - DNA, 638 bp, Panicum virgatum
  misc_feature: Ceres CLONE 2045138
  misc_feature: Encodes the peptide sequence at SEQ ID NO. 48712
aattttatgcaggggatatgtggcaccagaacgctacgatggagtcatcacattcaagtcagacatatatagtcttggtgttatattcgcggagttactgacaggacagaaaggtcattccccggttgataatgtagtggaaagctggagggagaggttgggtatgtcatcgccaaacacattattggaacaagtaaaattatgcgctgagatatgcatagactgcacagaccgagagcgaaagaacagaccatctatggaccgtataatccagaagcttactgaaacagaaaccaatgtggcacaggtagaagagataacagttttatccgacccagaagatagcaccatgccttcacatataactactcgtgatactcctcgggatggcctaccatctatgtcagaagaagaaccatctcctcgggtattacacatgattaccggtccaagagcaccctatatcccagggctattccttgctattatgaagattgatgcagttttagcagataaaactaccaagattgtggtggcaaaactttctgcaaaaggtagtagtagactaaggggcctcgaagtcaatattcagaaagtaagggatcaactcacagtcctgatgactaagacagccctgt

SEQ ID NO: 48712 - protein, 212 aa, Panicum virgatum
  misc_feature: Ceres CLONE 2045138
  misc_feature: SWISSPROT Homolog: EC 2.7.11.1 Non-specific serine/threonine protein kinase
ILCRGYVAPERYDGVITFKSDIYSLGVIFAELLTGQKGHSPVDNVVESWRERLGMSSPNTLLEQVKLCAEICIDCTDRERKNRPSMDRIIQKLTETETNVAQVEEITVLSDPEDSTMPSHITTRDTPRDGLPSMSEEEPSPRVLHMITGPRAPYIPGLFLAIMKIDAVLADKTTKIVVAKLSAKGSSRLRGLEVNIQKVRDQLTVLMTKTAL

SEQ ID NO: 48713 - DNA, 672 bp, Panicum virgatum
  misc_feature: Ceres CLONE 2045155
  misc_feature: Encodes the peptide sequence at SEQ ID NO. 48714
aaaacaacaactgatcctctctagttggaatccctcagttctgcctccctccctcggaacggaaggaacagaccggaggcgagcacgaggggaggagacgcgacaaggcgccacctttccccgccccgggggcgccttgtcgtgtgggaacgccgcgacaagaaaggggaagcccagccagcgcacgcaacgggcaatcacacgcgcgccgccgtacggcgcctcgaccgcttgctgcctcgccaatcatcaccggcgtcggggcgggcagccagacagcccgggagggagaagctgacacggctgtaaatccaccctcctccaccttcctgagcgagcgagctcagcgtcgtcgtcgtcgtcgtcctcctcctcctcctgctgcgtgccaccgaaagccaagccaagccagcccagcgcggccagagcggcagagacttcctccgtggcgccgccgcttcgtccccttccctcgacccggcttcagccgctggcggcgagcggcgcccacccggggcggtacgcgaacgcgaccccctccgcggcggcggcggccggcgcgggggccatgggggtctacgggctccagcgccaccagatggtggcggccggcgcgtggggggacccgttccggcccgacggcggcgcgctggttgcccctctcgccgccgt

SEQ ID NO: 48714 - protein, 34 aa, Panicum virgatum
  misc_feature: Ceres CLONE 2045155
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
MGVYGLQRHQMVAAGAWGDPFRPDGGALVAPLAA

SEQ ID NO: 48715 - DNA, 636 bp, Panicum virgatum
  misc_feature: Ceres CLONE 2045188
  misc_feature: Encodes the peptide sequence at SEQ ID NO. 48716
atagcgacttgttctttgtgcctccgctcagcttccatccccggcccccctactaatacccaccgtcgtggtgctttgcttcgccggtcgcccatggggtccctggccgccgccgacgagccgctgccgccgctcaagtatcctcaggcccgccgcgacgacggcattgtagacgactaccatggcgtcctcgtgccggacccatacagatggatggaggagctggagtcggaggaggtgaagcagttcgtggacgcgcaggcggccgtgtccgacgccgtgctgtccacctgcgaccaccgcgggcgcctgcgcgggcagctcaccgcgctcttcgaccacccgcgcttccgcgcgccgttcaagcgcggcggcagctacttctacttccacaacccggggctccggccgcacagcgccctctacgtgcagcacgggctgggcggcgacccccgcgtgctgttggaccccgccgccttcagcgaggatggcacggtgtcgctcggcgtggtcggcgtcagcgacggcggcgaccacctggcctacggcaccagcgccagcggcagcgactgggtcaccatcagggtcatgcgcgtgcgcgacggggagcacctgcccgacacgctgtcctgggtg

SEQ ID NO: 48716 - protein, 180 aa, Panicum virgatum
  misc_feature: Ceres CLONE 2045188
  misc_feature (16)..(180): Pfam Name: Peptidase_S9_N Pfam Description: Prolyl oligopeptidase, N-terminal beta-propeller domain
  misc_feature: SWISSPROT Homolog: EC 3.4.21.26 Prolyl oligopeptidase
MGSLAAADEPLPPLKYPQARRDDGIVDDYHGVLVPDPYRWMEELESEEVKQFVDAQAAVSDAVLSTCDHRGRLRGQLTALFDHPRFRAPFKRGGSYFYFHNPGLRPHSALYVQHGLGGDPRVLLDPAAFSEDGTVSLGVVGVSDGGDHLAYGTSASGSDWVTIRVMRVRDGEHLPDTLSW

SEQ ID NO: 48717 - DNA, 158 bp, Panicum virgatum
  misc_feature: Ceres CLONE 2045206
  misc_feature: Encodes the peptide sequence at SEQ ID NO. 48718
catcgctactagaattggatttgtccttcaacaacctgcaaggggaggtgcctcaagagggagttttcaaaaatttagctaacttctcaattatagggaataaagagctttgtggtggaatacctcagcttcgtttagctccatgccacacgaactcc

SEQ ID NO: 48718 - protein, 51 aa, Panicum virgatum
  misc_feature: Ceres CLONE 2045206
  misc_feature: SWISSPROT Homolog: EC 2.7.11.1 Non-specific serine/threonine protein kinase
SLLELDLSFNNLQGEVPQEGVFKNLANFSIIGNKELCGGIPQLRLAPCHTN

SEQ ID NO: 48719 - DNA, 695 bp, Panicum virgatum
  misc_feature: Ceres CLONE 2045209
  misc_feature: Encodes the peptide sequence at SEQ ID NO. 48720
aatcaaggcagtctgcagctgaaactgaacagacgacgaaagcggaggaaaagccgagggaggcggaggcatagccttctccgacacatgacaagatccgcgcgaaatccaaatccaattgtgcacccgcctcctcttctcatggcccgcagctcgccggcggttttgctcctgctgttggcgctcgccggcgtggccgccgccggggacatcgtccaccaggacgacgaggccccgaagatccccggctgcgccaacgatttcgtcctggtaaaagtgcagacctgggtcaacaagaaagagaaagatgaatttgttggtgtaggtgctcggtttggccccaagatagagtcaaaggaaaagcatgccaaccgaacaagactgttgttagcacagccttctgattgctgcacccctcccacagcgaaggtttctggagcgaaggtttctggagatattttgttagtggagaggggactctgtaggttcactaaaaaagctaaggttgctgaatctgccggtgcttctgccattgtaatcatcaatgataagcatgagttatacaagatggtatgtgaccgcaatgaaacagatctagatattggtatacctgcggttcttctgccaaaagacgcaggctctaaattacgaagtcttctctcaagtggtgaagtcttagtgcagctgtactctcc

SEQ ID NO: 48720 - protein, 184 aa, Panicum virgatum
  misc_feature: Ceres CLONE 2045209
  misc_feature (72)..(173): Pfam Name: PA Pfam Description: PA domain
MARSSPAVLLLLLALAGVAAAGDIVHQDDEAPKIPGCANDFVLVKVQTWVNKKEKDEFVGVGARFGPKIESKEKHANRTRLLLAQPSDCCTPPTAKVSGAKVSGDILLVERGLCRFTKKAKVAESAGASAIVIINDKHELYKMVCDRNETDLDIGIPAVLLPKDAGSKLRSLLSSGEVLVQLYS

SEQ ID NO: 48721 - DNA, 621 bp, Panicum virgatum
  misc_feature: Ceres CLONE 2045218
  misc_feature: Encodes the peptide sequence at SEQ ID NO. 48722
gtggcaagcagcaagcaggggggagctcggcctccgtgcccggcgacggtcaggcgccgccgctgtttcggcgaagccagccagcacccgcccccgcctcggagctcgagctgccggtccccagggccgccgccgccgccatggagcagcagcgcggcgcggcgccgccgggcgggcacgagatcgagaagacgccctccggccccgccgcgccggacatggagtcggagcccgcggcggcgcgcgcggcggagcgcgtcccgccgtggcgcgagcagatcacggcgcgcggcatggtggccgcgctgctcataggcttcgtcttcacggtcatacagatgaagatcagcctcagcacggggctcaatcctacgatgaacgtctccgccgctctgctcgccttcctcgcgctccgcggctggacgcgcgccctcgaccgcctcggcattgcctgccgccccttcacccgccaggagaacaccgtcgtccagacatgcgtcgtcgcctgctacaccatcgcgtacggcggtgggtttgggtcctacttgttgggcctgaacaagaagacgtacgagctgtccggggtgagcacgccgggcaacgcgccggggagctacaagg

SEQ ID NO: 48722 - protein, 160 aa, Panicum virgatum
  misc_feature: Ceres CLONE 2045218
  misc_feature: The sequence is a functional homolog of SEQ ID NO 214 in the 10/412,699 US patent application
MEQQRGAAPPGGHEIEKTPSGPAAPDMESEPAAARAAERVPPWREQITARGMVAALLIGFVFTVIQMKISLSTGLNPTMNVSAALLAFLALRGWTRALDRLGIACRPFTRQENTVVQTCVVACYTIAYGGGFGSYLLGLNKKTYELSGVSTPGNAPGSYK

SEQ ID NO: 48723 - DNA, 540 bp, Panicum virgatum
  misc_feature: Ceres CLONE 2045226
  misc_feature: Encodes the peptide sequence at SEQ ID NO. 48724
gaggacctcgccagccagcgaaacgcggacgcaaatcaccaccgggcgggatccgaatcagccaccccaccacaccagaaggcaaaagcatggccgcctcgcgcgcgctgctccccacaccgcacgcggccgcggccgcgagccccgcgggggcgcgggcccgcctcgccgccgcctcggcctcgctccggtccgcggcgcgggtccgcgtccggtgcgcgaccctgtcggcgcccgcgcccgcgcccgtggcggcggaggcgccggcgcggcggatctcgcgggacgggtcgggcggggcgccgcggcccaagcccgcggtgctggtggccgagaagctgagcgaggccgggctggcggcgctgcaggagttcgcggacgtcgagtgcgcgtccggcatggcacccgcggacctcctcgccagggtggcccagttcgacgcgctcatcgtgcgcagcggcaccaaggtgacgcgggaagtgctggaggccgggcgcggcctgctccgggacgggggccgcgcgggcgtcgggatccgac

SEQ ID NO: 48724 - protein, 150 aa, Panicum virgatum
  misc_feature: Ceres CLONE 2045226
  misc_feature: SWISSPROT Homolog: EC 1.1.1.95 Phosphoglycerate dehydrogenase
MAASRALLPTPHAAAAASPAGARARLAAASASLRSAARVRVRCATLSAPAPAPVAAEAPARRISRDGSGGAPRPKPAVLVAEKLSEAGLAALQEFADVECASGMAPADLLARVAQFDALIVRSGTKVTREVLEAGRGLLRDGGRAGVGIR

SEQ ID NO: 48725 - DNA, 626 bp, Panicum virgatum
  misc_feature: Ceres CLONE 2045227
  misc_feature: Encodes the peptide sequence at SEQ ID NO. 48726
aacgaaccaagcatcacaaagaacgcgcacaaacttgattagattgctgtgtcgtcgtcgtctccgatcatcatcaccaacaagcacccagcacttctgttctaactaattcagccggcatccacaccgtccaaatggcgcaccacttcctgggcaagcaccacaacaaggccggcggcggcggcggcgaggcgcccaaggtcaccgactggcgcaaggaggagaagcaccacaagcacatggagcagctcgcccagctgggcgccgttgcagcgggagcgtacgccatgcacgagaagcacaaggccaagaaggaccccgaccacgggcactcccacaaggtcaaggaaggtgtcgccgccgccgtcgccgtcggcagcgccggctttgccttccacgagcaccacgagaaggacgccaagaagcaccgccgcaacggccacccccattagtgtagcatatactatagtatagcacaataaattggacgtagatcgttctactactgtatgtgtgtcctgtactgcttattcacatttcattgagtacattgatttattatttgttcatgttactgtttttttctccttattcgggatctctataacaattcagtatatatgttg

SEQ ID NO: 48726 - protein, 105 aa, Panicum virgatum
  misc_feature: Ceres CLONE 2045227
  misc_feature (24)..(102): Pfam Name: ABA_WDS Pfam Description: ABA/WDS induced protein
MAHHFLGKHHNKAGGGGGEAPKVTDWRKEEKHHKHMEQLAQLGAVAAGAYAMHEKHKAKKDPDHGHSHKVKEGVAAAVAVGSAGFAFHEHHEKDAKKHRRNGHPH

SEQ ID NO: 48727 - DNA, 711 bp, Panicum virgatum
  misc_feature: Ceres CLONE 2045234
  misc_feature: Encodes the peptide sequence at SEQ ID NO. 48728
accgaagaacacacgacaccaccagagagataacaaagccttcttcctacagcactcttgcaatccacagagctagctcagttcatccaagcacacagaagcatcagcaatgtcgctcgtcaggcgcggcaacgtgttcgaccccttctccatggacctctgggaccccttcgacagcatgttccgctccatcgtcccatcgtcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaatgtgctggtcatcagcggccagcgcagcaaggagaaggaggacaagaacgacaagtggcaccgcgtcgagcgcagcagcggccagttcatgaggcgcttccgcctgccggaggacgccaaggtggagcaggtgaaggccgggctggagaacggcgtgctcacggtcaccgtgcccaaggccgagggcaagaagccggaggtgaagagcatccagatctccggttaagcggccgtggagacggatggtgaggtgacaggggaggaccgccggttcgcgctactacagtctgtcgttgctctgctttggtgtgtttggtgtgtgtactgttgttcagcctgccatggtagtgcctgctactggtgtcatgtgct

SEQ ID NO: 48728 - protein, 151 aa, Panicum virgatum; identical to SEQ ID NO: 46529
  misc_feature: Ceres CLONE 2045234
  misc_feature (47)..(150): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity

SEQ ID NO: 48729 - DNA, 685 bp, Panicum virgatum
  misc_feature: Ceres CLONE 2045251
  misc_feature: Encodes the peptide sequence at SEQ ID NO. 48730
acgcattccccgcttcacccggccccggcgcccagcgagaggaaaaaaaaacaaatcaggaattccgcgagggcaccaccatggcggccgccgccaccgcctctgcctcggccgccttccccgcggcctcccccctccgccgcgacggccgcaggccctcccgcgtggccgtcagcgccgcggcgacgacgcccgcggaggcggcgtcggcggcgctcgcggccgccccggcggcgccggcgccgatggtgcgggtggcgccggagtcgctgcagagggagagcgggtgcctcgtggcggggttccgggagcgcaacgcgggcgcggcggacggggaggggttcggtggggacggcggcgcggcggggggaggagggcccggcgcgatggagtacctgaccagcgtgctgtcgtccaaggtgtacgacgtggcaatcgagtcgccgctgcagctcgccaccaagctctccgaccgcctcggggtcaacctctggatcaagcgcgaggacctgcagccggtattctcattcaagttgcggggtgcatataatatgatggcaaaactctctcctgagcagttggagaggggcgtcatctgctcctctgctggaaaccatgctcagggagttgctctttctgctcagagactgggatgcgatgccgtcatcgtcatgccggtgacaac

SEQ ID NO: 48730 - protein, 201 aa, Panicum virgatum
  misc_feature: Ceres CLONE 2045251
  misc_feature: SWISSPROT Homolog: EC 4.3.1.19 Threonine ammonia-lyase
MAAAATASASAAFPAASPLRRDGRRPSRVAVSAAATTPAEAASAALAAAPAAPAPMVRVAPESLQRESGCLVAGFRERNAGAADGEGFGGDGGAAGGGGPGAMEYLTSVLSSKVYDVAIESPLQLATKLSDRLGVNLWIKREDLQPVFSFKLRGAYNMMAKLSPEQLERGVICSSAGNHAQGVALSAQRLGCDAVIVMPVT

SEQ ID NO: 48731 - DNA, 667 bp, Panicum virgatum
  misc_feature: Ceres CLONE 2045291
  misc_feature: Encodes the peptide sequence at SEQ ID NO. 48732
ttcacaagactattgcagcggcaattgtggttggtgttatccttcatgcagggaaccaccttgtatgtgattttccgcggctcataagttcaccggaggagaagtatgctccgctgcacgactactttggggataagaagccaacatatttagacctggtcaaaggagtggagggcataacaggggtaatcatggttgtgtgcatgcttattgcatttactctagcaacaaggtggttccgccgtagcctggtgaagcttccaaggccatttgacaaattaactggcttcaatgcattctggtactcccatcatctattcatcattgtgtacatagcactcgttattcatggagagtgtttataccttatccaccactggtacaaaaagacgacatggatgtatctctcggtgcctgttggtctgtatgttggggagaggactcttaggttcttcagatcgggcagttattctgtccggctattgaaggtggccatatatcctggtaatgttttgacattgcagatgtccaagcctcccacattccgttacaagagcgggcagtatatgtttgttcagtgccctgctgtttcaccctttgaatggcatcctttctcaataacttcggcacctggggatgactatctaagcattcatgttcggcaact

SEQ ID NO: 48732 - protein, 221 aa, Panicum virgatum
  misc_feature: Ceres CLONE 2045291
  misc_feature (155)..(221): Pfam Name: FAD_binding_8 Pfam Description: FAD-binding domain
  misc_feature (1)..(114): Pfam Name: Ferric_reduct Pfam Description: Ferric reductase like transmembrane component
  misc_feature: SWISSPROT Homolog: EC 1.6.3.1 NAD(P)H oxidase
HKTIAAAIVVGVILHAGNHLVCDFPRLISSPEEKYAPLHDYFGDKKPTYLDLVKGVEGITGVIMVVCMLIAFTLATRWFRRSLVKLPRPFDKLTGFNAFWYSHHLFIIVYIALVIHGECLYLIHHWYKKTTWMYLSVPVGLYVGERTLRFFRSGSYSVRLLKVAIYPGNVLTLQMSKPPTFRYKSGQYMFVQCPAVSPFEWHPFSITSAPGDDYLSIHVRQ

SEQ ID NO: 48733 - DNA, 607 bp, Panicum virgatum
  misc_feature: Ceres CLONE 2045292
  misc_feature: Encodes the peptide sequence at SEQ ID NO. 48734
acaaaaaaaaaaagaaaaagcaagcagcagagcaggcaggctccagaccgatagagagagagaacgcagcgcggggatgggttgagaaagatggagggagaaagcgggcagcttggtggatctcggcatcgcgcctccgccgccgctcctcccgagaggctccacctggttactgacttgctgcagtgctaattatacatacatctttatatttttctggcagttgtactactaactcactgactggtaaaagcactaacagattggatgggagcttgctgaattataactgtgcaagctaattccatcgaccccacattctgaaaagtgggcaaattcagaaatttcacgattttgaggataaaatattgcatctctgcacttttttgagtactgaggaagcgaggcattatttactggttggagtggtctgtgtttctatctagtaccaatggcagctctggctcgtcatgactcaaggcagtactcatggttgtgggtcagccatatcagccccaagaactccaaatggctccaggaaaatctcagcgatatggacacaaaggttaaagcaatgatcaaacttatcaatgaagatgctgattct

SEQ ID NO: 48734 - protein, 51 aa, Panicum virgatum
  misc_feature: Ceres CLONE 2045292
  misc_feature (13)..(51): Pfam Name: KIP1 Pfam Description: KIP1-like protein
MAALARHDSRQYSWLWVSHISPKNSKWLQENLSDMDTKVKAMIKLINEDAD

SEQ ID NO: 48735 - DNA, 693 bp, Panicum virgatum
  misc_feature: Ceres CLONE 2045303
  misc_feature: Encodes the peptide sequence at SEQ ID NO. 48736
agaatcgctagctttttgccaacgaccaagaggtagctagctcctgctcctcacgtttgtagcgtgagccatcctactatacggcagcaataaccaaagagccaaagcaaagctccaagcgatcgacctgcaactactcgagctaattaactggcttattggtagctcagacagaagccggttgcggccggcggcgagcggatgggcaacgccctggggtgcgccggactcggcgagcggctggcggccgccgcgagggacggcgacgcggcggaggtgcggcggctgctggaggcgaacccggggctcgcgcggtgcgccgccttcggcagcctcaactcgccgctccacctcgccgccgccaaaggacaccacgagatcgctgcgttgctgctgcagaacggagctgacgtgaacgcccgaaacatttacggacagacggcgttgatgcaagcgtgccggttcggccactgggaggtggttcagacgctgctggttttcagatgcaacgtgtcgaaggtggacagcctcagcagccggacggcgctgcacctcgcggcggccggcgggcacgtcaagtgcgccaggctgctgctggccgcggccgccggcgacggcggcaggttcgtgaacagggcgggcagcggcggcgtcacggcgctgcacctcgcggcgctgcacggccacgccgac

SEQ ID NO: 48736 - protein, 163 aa, Panicum virgatum
  misc_feature: Ceres CLONE 2045303
  misc_feature (44)..(76): Pfam Name: Ank Pfam Description: Ankyrin repeat
  misc_feature (77)..(109): Pfam Name: Ank Pfam Description: Ankyrin repeat
  misc_feature: SWISSPROT Homolog: EC 2.7.11.1 Non-specific serine/threonine protein kinase
MGNALGCAGLGERLAAAARDGDAAEVRRLLEANPGLARCAAFGSLNSPLHLAAAKGHHEIAALLLQNGADVNARNIYGQTALMQACRFGHWEVVQTLLVFRCNVSKVDSLSSRTALHLAAAGGHVKCARLLLAAAAGDGGRFVNRAGSGGVTALHLAALHGHA

SEQ ID NO: 48737 - DNA, 631 bp, Panicum virgatum
  misc_feature: Ceres CLONE 2045354
  misc_feature: Encodes the peptide sequence at SEQ ID NO. 48738
agctgcttcaggtaatcaagttttctccagcggcttcctccgttcatccgccgccggccggccatcagcaccagcgcgcagacatgaagatcgggtgcgacgcgtgcgggcgggcggaggcggcggtgctgtgctgcgccgacgaggccgcgctctgccgccgctgcgacgccgccgtccactccgccaacaggctcgccggcaggcacagccgcgtcgcgctgctcccgtccaccgccatcgtcgacggcagcggcagccacccaacctgtgacatctgccaggtagtacgtgcgtaccctctagctttgctgctgaaccttcatagtaactcttactaacagcggtgtaggtccagttttcatcaaaacagagtgagtagttaacagaaccagcaggggattacccctcctgtttcataaaaaaaattatgtaataataggacttcattagatcaatatgggttctacttttacagtaagtttatctctggagactaggcatttcagaatcttacattctcagcactttcatatctatagtgttgttatcatgatgtcaactgtgtattatacaaatcatatcattgatgtttgggaatagttggctcaacctgtatatataccaaaag

SEQ ID NO: 48738 - protein, 85 aa, Panicum virgatum
  misc_feature: Ceres CLONE 2045354
  misc_feature (1)..(47): Pfam Name: zf-B_box Pfam Description: B-box zinc finger
  misc_feature: The sequence is a functional homolog of SEQ ID NO 1023 in the 10/666,642 US patent application
  misc_feature: The sequence is a functional homolog of SEQ ID NO 1645 in the 10/374,780 US patent application
  misc_feature: The sequence is a functional homolog of SEQ ID NO 1671 in the 10/412,699 US patent application
  misc_feature: The sequence is a functional homolog of SEQ ID NO 236 in the 10/666,642 US patent application
  misc_feature: The sequence is a functional homolog of SEQ ID NO 908 in the 10/412,699 US patent application
  misc_feature: Functional homolog of the protein sequence given in SEQ ID NO 50993
  misc_feature: Useful for making plants with altered lignin content
  misc_feature: The sequence is a functional homolog of SEQ ID NO 1024 in the 10/666,642 US patent application
  misc_feature: The sequence is a functional homolog of SEQ ID NO 1646 in the 10/374,780 US patent application
  misc_feature: The sequence is a functional homolog of SEQ ID NO 1672 in the 10/412,699 US patent application
  misc_feature: The sequence is a functional homolog of SEQ ID NO 465 in the 11/479,226 US patent application
  misc_feature: The sequence is a functional homolog of SEQ ID NO 1961 in the 11/479,226 US patent application
  misc_feature: The sequence is a functional homolog of SEQ ID NO 234 in the 10/666,642 US patent application
  misc_feature: The sequence is a functional homolog of SEQ ID NO 288 in the 10/374,780 US patent application
  misc_feature: The sequence is a functional homolog of SEQ ID NO 582 in the 10/225,066 US patent application
  misc_feature: The sequence is a functional homolog of SEQ ID NO 662 in the 11/435,388 US patent application
  misc_feature: The sequence is a functional homolog of SEQ ID NO 906 in the 10/412,699 US patent application
  misc_feature: The sequence is a functional homolog of SEQ ID NO 1478 in the 10/666,642 US patent application
  misc_feature: The sequence is a functional homolog of SEQ ID NO 1890 in the 10/412,699 US patent application
  misc_feature: The sequence is a functional homolog of SEQ ID NO 2148 in the 10/374,780 US patent application
  misc_feature: The sequence is a functional homolog of SEQ ID NO 454 in the 11/435,388 US patent application
  misc_feature: The sequence is a functional homolog of SEQ ID NO 676 in the 10/225,066 US patent application
  misc_feature: The sequence is a functional homolog of SEQ ID NO 1300 in the 11/479,226 US patent application
  misc_feature: The sequence is a functional homolog of SEQ ID NO 602 in the 10/412,699 US patent application
  misc_feature: Functional homolog of the protein sequence given in SEQ ID NO 51357
  misc_feature: Useful for making plants with altered alkaloid content
  misc_feature: Useful for making plants with modulated flowering time
MKIGCDACGRAEAAVLCCADEAALCRRCDAAVHSANRLAGRHSRVALLPSTAIVDGSGSHPTCDICQVVRAYPLALLLNLHSNSY

SEQ ID NO: 48739 - DNA, 679 bp, Panicum virgatum
  misc_feature: Ceres CLONE 2045407
  misc_feature: Encodes the peptide sequence at SEQ ID NO. 48740
atccagctcatactcccagttcaaacatcgtttccaggcaaagaccaacccgatcagaaaggccgccgtctccggcacaagcagaggtggcagttaagtgcaccatgtgtcattccaagcggctggcgacagtcgccatgcccatgcttatactattgccgttgctgctgctgtgctatggagtcggaaacgtctgctcaacggttcatgacaacagcagggatctgcaggcactgctcgatttcaagcagggcgtcagcgacccatctggagccttgagcaattggaccaaaaacacccacttctgtctgtggactggtatcacgtgcaccttgacgcgacgaccattgcgcgtcctgtcgctcaccctccgaggcaaaaatttagctggaaaaatcagctcctctcttggcaacctcaccttccttagttatcttgacctctcctctaataatttcgtgagtccgttaccagacgcacttacaaattgctccaacttatactacttagatttatcatcaaacttactggcgggttcaattcctccaaaattaggcctgctgtcaaatctaaactatctcaatttgcgtacaaatcaattcgacggaagcattcctggtgagcttggccaattggtgaatttacgaagcttgctcctagccgaaaatagtttgtcaag

SEQ ID NO: 48740 - protein, 191 aa, Panicum virgatum
  misc_feature: Ceres CLONE 2045407
  misc_feature (37)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MCHSKRLATVAMPMLILLPLLLLCYGVGNVCSTVHDNSRDLQALLDFKQGVSDPSGALSNWTKNTHFCLWTGITCTLTRRPLRVLSLTLRGKNLAGKISSSLGNLTFLSYLDLSSNNFVSPLPDALTNCSNLYYLDLSSNLLAGSIPPKLGLLSNLNYLNLRTNQFDGSIPGELGQLVNLRSLLLAENSLS

SEQ ID NO: 48741 - DNA, 652 bp, Panicum virgatum
  misc_feature: Ceres CLONE 2045408
  misc_feature: Encodes the peptide sequence at SEQ ID NO. 48742
acagttcatgtcgtgtcgttataatcattagtgccttctatgtttgacggcgccgtacatacttacgagctactcaaactgcagctgcttgctcgggatagagatgcgcctgtttagctgtttaacactccggccggctcatctccttgtccctaattttgcatagccttacaacctgcaagtcataattctgcatatgtgcagtcctttgttgttgactaaagttcaagtattttgccattcaagcagatgtatccaccgacggacactggtgttttgtggtgttctgggtcgtgccccgctcctcatccatcaaaatccggtgggcgagcctcaagaaccgcctcatgtccatgtgcccttcctcatactcagtccctttctaccctgaaatcagccagccagggccccccaagttctacctcctcaagctcatgctacctgaccgcaaaggactgttacatgacgtgacacatatactatcggagctggagcttttaatccacagagtgaaggtgtccaccacgcctgatggaagagttgtggatctcttctttatcactgacggcatgtaagctgtcatattaacctcagttttaacacgctgattgttccaaatggtgtgggttatttgcattgcacacagtaattc

SEQ ID NO: 48742 - protein, 75 aa, Panicum virgatum
  misc_feature: Ceres CLONE 2045408
  misc_feature: SWISSPROT Homolog: EC 2.7.7.59 [Protein-PII] uridylyltransferase
MSMCPSSYSVPFYPEISQPGPPKFYLLKLMLPDRKGLLHDVTHILSELELLIHRVKVSTTPDGRVVDLFFITDGM

SEQ ID NO: 48743 - DNA, 698 bp, Panicum virgatum
  misc_feature: Ceres CLONE 2045413
  misc_feature: Encodes the peptide sequence at SEQ ID NO. 48744
atgagtagtcctagtttgttagagcagactcccaaagaatataactccatcgtgcgataaaaacccctcagttcaccaaaaacgaagggtcataaactgcaagagtcggttccaatcaggattctggagtctgcaacgagatatcagtacaaaacagaattgaagaggccctaaccttaaggctgcaatatcttcattgcagatgtatcatcatcaacaacagctccagagccacagccatttcctgtcttctaggcagacattccctccagaaaggcacttgcttctgcagggagggactattccagcagagccagggcttgtgctttcgactgatgctaagcctaggttaaaatggacacctgaactacatgagcgctttgtggatgcggtaaatcaacttggtggacctgataaagctacaccaaagacgatcatgagactcatgggtgtccctggactaacactatatcaccttaagagtcatcttcaggtagacatggaattcctagtatagtgtattcccttgtacatgccttgtgacaagaaactaagttgatttgtctcttactagaaatacagactaagcaaaaatattcacactcaagctaatggtataaatgcaaaaaatggtaagtataacattctcagattacctagcagttatcagcctcctgttaagcttaacattgaacgtc

SEQ ID NO: 48744 - protein, 104 aa, Panicum virgatum
  misc_feature: Ceres CLONE 2045413
  misc_feature (49)..(100): Pfam Name: Myb_DNA-binding Pfam Description: Myb-like DNA-binding domain
  misc_feature: Functional homolog of the protein sequence given in SEQ ID NO 51559
  misc_feature: Useful for making plants with modulated flowering time
  misc_feature: Functional homolog of the protein sequence given in SEQ ID NO 50244
  misc_feature: Useful for making plants with altered alkaloid content
  misc_feature: Useful for making plants with altered lignin content
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
MYHHQQQLQSHSHFLSSRQTFPPERHLLLQGGTIPAEPGLVLSTDAKPRLKWTPELHERFVDAVNQLGGPDKATPKTIMRLMGVPGLTLYHLKSHLQVDMEFLV

SEQ ID NO: 48745 - DNA, 665 bp, Panicum virgatum
  misc_feature: Ceres CLONE 2045414
  misc_feature: Encodes the peptide sequence at SEQ ID NO. 48746
aaaaacagaggaggaaaaaaccaagaaaaaaatatcacgctctcttcctccgttcccctgctcgattccccgcgaggaattcgcccccaaatctatcgatctgctctgcccagtccaccaatccgtggatcaatccgcgcgcgtgtccggtttgccccggggttccgatctggtcttcgcctcgttaggggaggagccggaggaggagatgaacggcgccgggggcagccaccagcaacagcagcagaggctccggcagcagcagcagcagcaggcgctcctgatgcagcaggcactgcagcagcagcagcagcagtaccagtccggcgtcctcgcggcagcgacagcggccgccatgacccaggtatgttgggaatgtaaacccaaacgtcaccgagacccttctgattgaagttttccagagtgctggccttgtggaaagatgcaagctcatcaggaaagagaagtcttcctttgggtttgtggattactatgatcgaagatctgctgctctagcaataatgacccttcatggtcgtcacatatatggacaagcaatcaaggtgaactgggcgtacgccagtacacagagggaggacacatctgggcatttccatatttttgttggtgatttaagttctgaagtgaatgatgcaactctttat

SEQ ID NO: 48746 - protein, 47 aa, Panicum virgatum
  misc_feature: Ceres CLONE 2045414
  misc_feature: Functional homolog of the protein sequence given in SEQ ID NO 50307
  misc_feature: Useful for making plants with altered lignin content
MTLHGRHIYGQAIKVNWAYASTQREDTSGHFHIFVGDLSSEVNDATL

SEQ ID NO: 48747 - DNA, 671 bp, Panicum virgatum
  misc_feature: Ceres CLONE 2045429
  misc_feature: Encodes the peptide sequence at SEQ ID NO. 48748
atccaaagttgaagttcacagtgcaggcgcttgcgcttacacacaccaccacggcaccacaccgcagcaacgacatcaaaagggctgctgcgtgtgatctgcgctccagcagggcagaggtgacaagtgcgttatgtactccaagcagctggcgaagttcgctatgcttatactactggtgctgctactcctgtgctatggagttggaaacgtccaatgcgttcatgagaacagcatggacctgcactcactgctagagttcaagcagggcgtcaccagcgatccaaatgaagtcctgagctcctggaaaaacaatacccattactgccagtggagcggagttacatgcacgccgacgcaaccatggcgcgtcatgaggcttaacctaactggccaaaacttggaaggtgaaatcgcctcctctctggcaaatctgacgctccttagtgttcttgacttgtcctccaatcgcttttttggccagttacctccccagctgggtcgtctccaactgctgaacaccatttatctgaatgacaattcactcaatgggactatccctgacgcactcacaaactgctccaaactaatcaatttagatctccataaaaatcagctatcgggtacaatccctccgcaaatagactccctttcccatctagaatatctag

SEQ ID NO: 48748 - protein, 179 aa, Panicum virgatum
  misc_feature: Ceres CLONE 2045429
  misc_feature (33)..(73): Pfam Name: LRRNT_2 Pfam Description: Leucine rich repeat N-terminal domain
  misc_feature: SWISSPROT Homolog: EC 2.7.11.1 Non-specific serine/threonine protein kinase
MYSKQLAKFAMLILLVLLLLCYGVGNVQCVHENSMDLHSLLEFKQGVTSDPNEVLSSWKNNTHYCQWSGVTCTPTQPWRVMRLNLTGQNLEGEIASSLANLTLLSVLDLSSNRFFGQLPPQLGRLQLLNTIYLNDNSLNGTIPDALTNCSKLINLDLHKNQLSGTIPPQIDSLSHLEYL

SEQ ID NO: 48749 - DNA, 530 bp, Panicum virgatum
  misc_feature: Ceres CLONE 2045438
  misc_feature: Encodes the peptide sequence at SEQ ID NO. 48750
atttttgccgcgctcgcgcgctcccgccccccacacacacaccccgaccttccacgcttctccagcctcactcttcctggtcaggtgggagcgcaggagacagggctgggaggatggcgtcggtttccagggctgtctgcggcctgcagatgccgtgcttgaacggcagggaggcgcccgccggccgccgatcggtcgcggcgccgagggcccggaacgccaaacggggcgtcatccgcgccgtgtccgcctccgcctccgcctccggctccggctccgtgtccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggccgggcggtcgctgcccgcg

SEQ ID NO: 48750 - protein, 138 aa, Panicum virgatum
  misc_feature: Ceres CLONE 2045438
  misc_feature: SWISSPROT Homolog: EC 2.7.9.1 Pyruvate, phosphate dikinase
MASVSRAVCGLQMPCLNGREAPAGRRSVAAPRARNAKRGVIRAVSASASASGSGSVSGRGQHCAPANAVADAAPITATKRVFPFGKGKSEGNRGMKDLLGGKGANLAEMSSIGLSVPPGFTVSTEACQQYQEAGRSLP

SEQ ID NO: 48751 - DNA, 672 bp, Panicum virgatum
  misc_feature: Ceres CLONE 2045454
  misc_feature: Encodes the peptide sequence at SEQ ID NO. 48752
tttttttttttttttttcggctaattggcagcttgttggttttgggaggggggagaagctgcttgctcgtcagattcagctgtcttcctccaattcaggttttttgctttcttcttaaattggttgtcaaatcgcaggattcggggcacccgctaacgcggccggctccagcatggacacggcgtttcttcgttctccgcttgctcgcaatctagtttatgacgagtttgccgtgcttcactccccaagctaccgtttccatcctctgcggtattccaggtgcaatccgacaaactcgacgccctgccaaacgttgtctgcttcgccatcaaggggcttgactcagcgagtggccgcattacctaatgttgatgattttttctgggagaaggatcctactccgatcctggacacaattgatgagcccattcatttgaaaaatctatctagtaaggagctcaagcagttagctgatgaagttcattctgaaatatctttcataatgtccagaaaatgccagccatgtggtcctggtcgctcagttgtggagctgacaattgctatacattatgtgttcaatgcaccaatggataagatactgtgggatgctggtcagcatgcgtatgcacacaagattctcacaggaaggcgctctctctttcatactattca

SEQ ID NO: 48752 - protein, 166 aa, Panicum virgatum
  misc_feature: Ceres CLONE 2045454
  misc_feature: SWISSPROT Homolog: EC 2.2.1.7 1-deoxy-D-xylulose-5-phosphate synthase
MDTAFLRSPLARNLVYDEFAVLHSPSYRFHPLRYSRCNPTNSTPCQTLSASPSRGLTQRVAALPNVDDFFWEKDPTPILDTIDEPIHLKNLSSKELKQLADEVHSEISFIMSRKCQPCGPGRSVVELTIAIHYVFNAPMDKILWDAGQHAYAHKILTGRRSLFHTI

SEQ ID NO: 48753 - DNA, 646 bp, Panicum virgatum
  misc_feature: Ceres CLONE 2045456
  misc_feature: Encodes the peptide sequence at SEQ ID NO. 48754
acgtgctccgccgcgccacggctcgtcgtcgaggccgccattctgcctccaccgcgtgctccgctcctcctccgccccgccgcccccttcatacgaggagtgctggtggcatggctaagatgcagtcaagttccaaggagcaagaggttcataaagtggcaggcaaatcccgtgagcagagtcccctgaaacaagggtctgttgatgatgaagactctggtagtaccaccccctctgctggtgaaaacaggtatcctggttggcctggaaccagtgtcttcaggatgctgattccttcacataaagtcggtgcgataattggccacaaaggagaaagggttagaaggctgtgtgaggaaacaaaagcctgtgtccgaattataggtggccatctttgtgcggcagagcaagctgtaataattttcggaaaggagcagcctgatgcgccattacctccggccatggatgcactactaagagtatatcagcaaacaattaaagatgatgatttagatttgggatccaatagtacaattgtgacacgaattcttacaccaagtgaacaggcaacaagccttattgatggtgacctgccgcctgttgcactggaagaagataaagttattgaaatatggggactgcctgc

SEQ ID NO: 48754 - protein, 178 aa, Panicum virgatum
  misc_feature: Ceres CLONE 2045456
  misc_feature (56)..(104): Pfam Name: KH_1 Pfam Description: KH domain
MAKMQSSSKEQEVHKVAGKSREQSPLKQGSVDDEDSGSTTPSAGENRYPGWPGTSVFRMLIPSHKVGAIIGHKGERVRRLCEETKACVRIIGGHLCAAEQAVIIFGKEQPDAPLPPAMDALLRVYQQTIKDDDLDLGSNSTIVTRILTPSEQATSLIDGDLPPVALEEDKVIEIWGLP

SEQ ID NO: 48755 - DNA, 638 bp, Panicum virgatum
  misc_feature: Ceres CLONE 2045482
  misc_feature: Encodes the peptide sequence at SEQ ID NO. 48756
caactcttcaatggcggccggcgggtcgatggttgggcggctctacctctccgtgtacaactgggttgccttctatggatgggcccaggttctgtactacgcaacgttagcattgttggccagtggacatgagactgtctatgatgctgttgagcagccactgctgttcgcacagaccgctgccttactggaggttccttgaagcattagatacttttgcaatgaattgaataccacacgagagttctagaatttaaatctctatggaatcttcttaggtcgattttttttaaaaaaaattgtgccaagtacaacaataaagtctcgtgggatactccccttcttttatttacattgtcatgtattaggttttttctaagtcaaatttagccaactttgatcaaatttatagaaaaatgatatttgcaatactaaatttgtttcattgaacttattaccatgaaatatattttgatagtacatatgttgggtagtatagttgttgctatatttttctacatgcttagttaaagttagctaaatttgacttaagacaaacctaacacgatatgtaaataaaaacggagggggtaatagaaactcgtacactcaaaagaagagccatgctcaccaacctt

SEQ ID NO: 48756 - protein, 63 aa, Panicum virgatum
  misc_feature: Ceres CLONE 2045482
  misc_feature: Functional homolog of the protein sequence given in SEQ ID NO 50911
  misc_feature: Useful for making plants with modulated drought sensitivity
MAAGGSMVGRLYLSVYNWVAFYGWAQVLYYATLALLASGHETVYDAVEQPLLFAQTAALLEVP

SEQ ID NO: 48757 - DNA, 606 bp, Panicum virgatum
  misc_feature: Ceres CLONE 2045492
  misc_feature: Encodes the peptide sequence at SEQ ID NO. 48758
atccgccgccctctcccgttccttcctctcttttctccctcctccccgccgcccgctttttgcgccgcgcctgctccggcaccgccgccgccgcgacaacccccacctcctcctctcccgtcctccggttgcagctctctcccttgatcccccaccccccgctccccaagggagcccctcaccgctcattccgtttggatccgacgattagggtttcgcccgctcgccgccgatgaagggcggccgcctgcaccgtccggagccgccgcagaaccatctcgccacggcggcggcggccccagtcccagcccccaatcccgccgatgactgggttgacggctcgtggacggtggactgctcctgcggcgtcacgttcgacgacggcgaggagatggtcagctgcgacgagtgcagcgtgtgggtgcacacgcggtgcgcgcgctacgtacgcggcgtccacacctccttctcgtgccacaaatgccggaggtctaagcgcgccccttcctctgccgacgaggccgaggttgccgagctcctagccgagctgcccacccactgcccgcccccgctgtaccgccgctgggccgaggttccgctgcccgc

SEQ ID NO: 48758 - protein, 124 aa, Panicum virgatum
  misc_feature: Ceres CLONE 2045492
  misc_feature (41)..(87): Pfam Name: PHD Pfam Description: PHD-finger
MKGGRLHRPEPPQNHLATAAAAPVPAPNPADDWVDGSWTVDCSCGVTFDDGEEMVSCDECSVWVHTRCARYVRGVHTSFSCHKCRRSKRAPSSADEAEVAELLAELPTHCPPPLYRRWAEVPLP

SEQ ID NO: 48759 - DNA, 692 bp, Panicum virgatum
  misc_feature: Ceres CLONE 2045494
  misc_feature: Encodes the peptide sequence at SEQ ID NO. 48760
gaaattcgctgttcaatttcatcttgtacaagtcttggagcgttttgggggagcattttaatctccgttcttatccgtgtgacagagggtaggaatttcgtttggcctttatgaatcccgagggttctgcttgctaaagggagggcaaggcaagttggaatccgagatgaggggaagaaatgacgcagggcagagcaagaggcccattgtgctgtgctgcatgatgattgtgtgcctatgcctactcttcctatatttctcgggctccaacgggcaggctaagagcaccgcgtttgagtatggaaccaaattctcgcgtacacttggatggggcagtgatgacggtgaggatggctctgaagaatccatttttgggactggggatgcagatgatattaagcccaagagcttccctgtgtgtgatgaccggcactcagagctgatcccctgcttggataggaacttgatatatcaaatgaggctaaagctggatttaaacctgatggagcactatgagaggcattgccctccaactgaaaggcgctttaattgcttgattcctccaccacatggctataaggttcctataaaatggccgaaaagtcgtgatgtagtgtggaaagcaaatattccacacactcaccttgcaaaacagaagtcagaccagaactggatggttgaagcaggtgaaa

SEQ ID NO: 48760 - protein, 175 aa, Panicum virgatum
  misc_feature: Ceres CLONE 2045494
  misc_feature: Functional homolog of the protein sequence given in SEQ ID NO 51755
  misc_feature: Useful for making plants with altered cell wall content and/or composition
  misc_feature: The sequence is a functional homolog of SEQ ID NO 1236 in the 11/479,226 US patent application
MRGRNDAGQSKRPIVLCCMMIVCLCLLFLYFSGSNGQAKSTAFEYGTKFSRTLGWGSDDGEDGSEESIFGTGDADDIKPKSFPVCDDRHSELIPCLDRNLIYQMRLKLDLNLMEHYERHCPPTERRFNCLIPPPHGYKVPIKWPKSRDVVWKANIPHTHLAKQKSDQNWMVEAGE

SEQ ID NO: 48761 - DNA, 596 bp, Panicum virgatum
  misc_feature: Ceres CLONE 2045497
  misc_feature: Encodes the peptide sequence at SEQ ID NO. 48762
cttaaaccccaagctgcgccgccgccgccgctttcgctcgccctcatcccattcccaccctcctctccgtcgggcctcccgtccccttctcttctcccgctgatcatggcggccttcaacaagctcggcagccttctgaggcacaatgccctgacgagtgggtcctctgccgtctcatctcctgcggtgttcaacgctgtccggctcatgtccaccaagcttttcgttggtggtctttcctggggtactgatgaccagtctctgaaagaagcatttagcagttttggggaggttactgaagcgcgtgtgatcacagacagggagtctggaaggtcaagaggctttggctttgtgaccttcaacagcgacgaagatgccaagtctgctataactgccatggacggtcaggaacttgatgggcggagcgtccgtgtgaacgtagctaatgagagacctgcaggacctcgaagcggtggcggctatggtggaggtggctacggtggtggtggtggctatggcggaggtagctacggcggtggcgacggtggccgctacggtggtggcaacaaagctatggaggccaggactcgttttga

SEQ ID NO: 48762 - protein, 163 aa, Panicum virgatum
  misc_feature: Ceres CLONE 2045497
  misc_feature (39)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 50182
  misc_feature: Useful for making plants with modulated biomass
  misc_feature: Functional homolog of the protein sequence given in SEQ ID NO 50183
  misc_feature: Useful for making plants with altered alkaloid content
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50185
  misc_feature: Useful for making plants with modulated flowering time
MAAFNKLGSLLRHNALTSGSSAVSSPAVFNAVRLMSTKLFVGGLSWGTDDQSLKEAFSSFGEVTEARVITDRESGRSRGFGFVTFNSDEDAKSAITAMDGQELDGRSVRVNVANERPAGPRSGGGYGGGGYGGGGGYGGGSYGGGDGGRYGGGNKAMEARTRF

SEQ ID NO: 48763 - DNA, 673 bp, Panicum virgatum
  misc_feature: Ceres CLONE 2045498
  misc_feature: Encodes the peptide sequence at SEQ ID NO. 48764
atttcgttgtcggcatgtcaaccctccctccctccctccctccctccctctctctttctcccgtgcactccatcagccatactttctcgctctaaaaatgggagccgggcagtgaggacgaagaacaggaaccaggtgcccttcacccattagctagccgacgaggtgatttctgaaccaggagcaccacattccacaggaatggagcagtacgaggtgttagagcagattggcaagggttcatttgggtctgcgctcctggtgaggcacaaagttgagaagaagaggtatgtcttgaagaagatccgcctcgcccgccagaccaaccggtgccgccgatcagcacaccaggagatggagctcattgcaaaagtaaggaacccttacattgtggagtacaaagaggcttgggtagagaagggttgctacgtgtgtattgtcatcggttactgcgagggaggggacatgtcagatgccattaagaaggctaagagcaaccatttctcagaagagaggctttgtatgtggcttgtgcagctcctgatggcacttgattacttgcatgtcaatcatatcctgcatcgcgatgtcaagtgctcaaatatatttctcacaaaggaccaaaacatacggcttggtgattttggtcttgctaaagtattgacttctgacg

SEQ ID NO: 48764 - protein, 157 aa, Panicum virgatum
  misc_feature: Ceres CLONE 2045498
  misc_feature (4)..(157): Pfam Name: Pkinase Pfam Description: Protein kinase domain
  misc_feature: SWISSPROT Homolog: EC 2.7.11.1 Non-specific serine/threonine protein kinase
MEQYEVLEQIGKGSFGSALLVRHKVEKKRYVLKKIRLARQTNRCRRSAHQEMELIAKVRNPYIVEYKEAWVEKGCYVCIVIGYCEGGDMSDAIKKAKSNHFSEERLCMWLVQLLMALDYLHVNHILHRDVKCSNIFLTKDQNIRLGDFGLAKVLTSD

SEQ ID NO: 48765 - DNA, 687 bp, Panicum virgatum
  misc_feature: Ceres CLONE 2045512
  misc_feature: Encodes the peptide sequence at SEQ ID NO. 48766
agttggtctccgccctctctcttcctctctatcttccatgtcgtctccaccaagtctccacccctgagcaactacaagatttgccaaaccaacacacacggcgagggcccaagtccaagagctacggcaataatggcgctccacgaacacagccacgagcttaggctcgccgccgcggcgtgcgcatggctcgccgtgtccatgatggcgagcctggcgtcggcgcggttcatcgtcgagaagaacagcgtcaaggtgctgtccccgcgctcgctgcgcggccaccacgaggccgcgatcgcaaactacggcgtcccggagtacggcggcacgctgaccggcgtggtgctgtacttggaggacccgaagctggccacggtctgcgggcccttgggcgacaagaagctgaggtcgccgtcgggccgccccgtggtcctcctcgtggaccgcgggggctgctacttcgcgctcaagacgtggaacgcgcagatggccggcgcggcggccgtgctggtggccgacaccgccgacgagccgctgctgacgatggacagccccgagaacgagacccccgacatggcgttcctcgccaacatcacggtcccctcggcgctggtcaccaagcggttcggcgacgccctccgccgcgccgcgtcctcctcgtcggcggcggcggcggcggcgagg

SEQ ID NO: 48766 - protein, 184 aa, Panicum virgatum
  misc_feature: Ceres CLONE 2045512
  misc_feature (63)..(174): Pfam Name: PA Pfam Description: PA domain
MALHEHSHELRLAAAACAWLAVSMMASLASARFIVEKNSVKVLSPRSLRGHHEAAIANYGVPEYGGTLTGVVLYLEDPKLATVCGPLGDKKLRSPSGRPVVLLVDRGGCYFALKTWNAQMAGAAAVLVADTADEPLLTMDSPENETPDMAFLANITVPSALVTKRFGDALRRAASSSSAAAAAA

SEQ ID NO: 48767 - DNA, 560 bp, Panicum virgatum
  misc_feature: Ceres CLONE 2045525
  misc_feature: Encodes the peptide sequence at SEQ ID NO. 48768
aagcaagcgcctcctgcggcccgcaggctccggcgctcgtccacctctcatggccaccgccaccgcctcccgcctcgccgtcctcgcgccgcggccgttgccgcccgcgctggggcgccggcggcacgcccccgctccgggctgcgccccttcccgcccgcgcgctctctctgccgccccgcgcggccgcgtcctctgcctcgcggcccccgcgcccgccgcggcctccaccaccgacgccggccaggaccgtctccagaaggtacccatttcgaatatcaggaacttctgcatcatcgcgcacatcgaccatggcaagtcgacactggcggataagttgctcgagctcacgggcacggtgcagaagagggagatgaaggagcagttcctggataacatggacctggagagggagagggggatcaccatcaagttgcaggcagctcggatgcgttacgtcatgaataacgagccttactgcctgaatttaattgatacaccaggccatgtcgatttctcatatgaggtgtcccgttctcttgctgcttgtgagggtgcac

SEQ ID NO: 48768 - protein, 170 aa, Panicum virgatum
  misc_feature: Ceres CLONE 2045525
  misc_feature (75)..(170): Pfam Name: GTP_EFTU Pfam Description: Elongation factor Tu GTP binding domain
MATATASRLAVLAPRPLPPALGRRRHAPAPGCAPSRPRALSAAPRGRVLCLAAPAPAAASTTDAGQDRLQKVPISNIRNFCIIAHIDHGKSTLADKLLELTGTVQKREMKEQFLDNMDLERERGITIKLQAARMRYVMNNEPYCLNLIDTPGHVDFSYEVSRSLAACEGA

SEQ ID NO: 48769 - DNA, 513 bp, Panicum virgatum
  misc_feature: Ceres CLONE 2045535
  misc_feature: Encodes the peptide sequence at SEQ ID NO. 48770
gaccgcgtctcgtccctcctcccctctcgggctcgtttcccccgccgcctcgatggggtcatcggaggccgacgacgaccagctcctcaagagcttcctcgcggaggtcagcgaggctgagcgcgacaacgaagtcatcaggatacttggttgcttcaagttaaatccattcgagcatttgaagttgtcatttgattcatctccagatgaggtgaagaagcaatatagaaagttgtcattgttggtccatcctgataaatgcaagcatccaaaggcacaagaagcttttgcaggtctctatcattaccccagcaatgacattagtagaggacataagtatggtgatgttaattctgtaccacaacaaattgggagacagtattgcagtatgtctggatattttttttcaatatgacttgtatactgatataaaccatcaagggacatatacccgtggctaattctgtatgttagcctacaaaccagagaaaactaattggaatttcgaaggga

SEQ ID NO: 48770 - protein, 120 aa, Panicum virgatum
  misc_feature: Ceres CLONE 2045535
  misc_feature (38)..(96): Pfam Name: DnaJ Pfam Description: DnaJ domain
MGSSEADDDQLLKSFLAEVSEAERDNEVIRILGCFKLNPFEHLKLSFDSSPDEVKKQYRKLSLLVHPDKCKHPKAQEAFAGLYHYPSNDISRGHKYGDVNSVPQQIGRQYCSMSGYFFSI

SEQ ID NO: 48771 - DNA, 614 bp, Panicum virgatum
  misc_feature: Ceres CLONE 2045543
  misc_feature: Encodes the peptide sequence at SEQ ID NO. 48772
  misc_feature (222)..(222): n is a, c, t, g, unknown, or other
aaggccgacctgcactcctactggccggtggtggactggtggtctccctccgctccgcaccaaccactcgcccccactcccgcggctcctccggccgccggccatggcgctccgctgccaggcgcctccccgccccgccgaccgggtgtggtagcgagcccagagcgagggcggccgggaaaggagccccccccccccaccccccctccaccttcccatcanctgctggatcctccgcccgccgccgcggccgcgtggagcggagtgccgacggggatctgcccgtgcgggcttcggccggttcccccctctgctaccggattctgctctcccatgctacaatagtacaacattgaaggcttcaaaagtctacaagaactagatgatacttgcataatgcagccctcaaatatttggaaggcgcatgcaggttcctcgcagtcagagggttcagctctggatatggagagaaacggatgcaatcataattgttgcccatctcctctccaaccaatcgcctcagctggtcagcactctgaaagcagcgctgcatacttttcttggcctacatctactctaatgcacggctcagccgaaggccgtgctaattactt

SEQ ID NO: 48772 - protein, 72 aa, Panicum virgatum
  misc_feature: Ceres CLONE 2045543
  misc_feature: Functional homolog of the protein sequence given in SEQ ID NO 51147
  misc_feature: Useful for making plants with altered protein content
MQPSNIWKAHAGSSQSEGSALDMERNGCNHNCCPSPLQPIASAGQHSESSAAYFSWPTSTLMHGSAEGRANY

SEQ ID NO: 48773 - DNA, 640 bp, Panicum virgatum
  misc_feature: Ceres CLONE 2045565
  misc_feature: Encodes the peptide sequence at SEQ ID NO. 48774
gacacttcgacaggctttcttcatcctcttcgtcttccttcccctggactcttcgccgtcgtctccaccgacaagttgtccgtcaaatacctcggcagccatcaccatggccacgacgtcggggtcgtgcaagccgaccgccccgcgcccacgcgccgggccgtgtactactttgagatgcgggtcaagaacgccggctacaaggggcagacctcaatcgggttcacaagcgaaagcttcaagatgcggcgacaaccgggttgggagcctaacagttgtggataccatggtgatgatggccatctttaccgaagtcaagggaaaggtgaaccattcgggcccaaatttacatctggcgacacaatcggtgctggcatcaactacctgtcacaagaatttttcttcacgaaaaatggatctctggttggagcctttccaaaagaaattaaaggtccactatatcctaccgttgcagttcatagtcagggtgaagaattgactgtgaactttggtaaagaaccattctgttttgacattgagggttatatactcgaagagaaaatgaggcaacaatcgatgacgaacaaattgaagttggaagagaacatcagtcatgtgattgtccgttcatatctgctac

SEQ ID NO: 48774 - protein, 213 aa, Panicum virgatum
  misc_feature: Ceres CLONE 2045565
  misc_feature (53)..(174): Pfam Name: SPRY Pfam Description: SPRY domain
  misc_feature: SWISSPROT Homolog: EC 2.7.10.2 Non-specific protein-tyrosine kinase
DTSTGFLHPLRLPSPGLFAVVSTDKLSVKYLGSHHHGHDVGVVQADRPAPTRRAVYYFEMRVKNAGYKGQTSIGFTSESFKMRRQPGWEPNSCGYHGDDGHLYRSQGKGEPFGPKFTSGDTIGAGINYLSQEFFFTKNGSLVGAFPKEIKGPLYPTVAVHSQGEELTVNFGKEPFCFDIEGYILEEKMRQQSMTNKLKLEENISHVIVRSYLL

SEQ ID NO: 48775 - DNA, 582 bp, Panicum virgatum
  misc_feature: Ceres CLONE 2045575
  misc_feature: Encodes the peptide sequence at SEQ ID NO. 48776
atcgatctgtacgccctcccccaccggccgccggtcgcgcgcctccgcctacctcccctccccgcccgtcgccgtccgtctccgtctccgcccccccaaaccctactgcccctggcccctgccgccttcgcagctctccgcccgctatggccaccaacggcagctccccgagggttcgggacacggagagcagcctggagaaggtgaagcgccagctgtcgtcggggtccgggaggtacctgctgcaggggcccctgctcaagcgatctgagacgctgcggaaatggaatgaacggtgggtcatattggaccccacatctggaaagatggaatacaaactccggaggaatgaaactgccataaaggggaccattctatttgacgcctcaagcaccattactttgtctcctgtgaactttcaagggatgccgaagtatgatggttgctgcttctacatcggaactcctcaaaagaaggattactttctttgcgctgaaactcctggtgctgcgaaagcttgggtatctacattacaagcaactcagttagtactcggagctcattaagaggcaataaattcct

SEQ ID NO: 48776 - protein, 139 aa, Panicum virgatum
  misc_feature: Ceres CLONE 2045575
  misc_feature (31)..(134): Pfam Name: PH Pfam Description: PH domain
  misc_feature: SWISSPROT Homolog: EC 3.6.5.5 Dynamin GTPase
MATNGSSPRVRDTESSLEKVKRQLSSGSGRYLLQGPLLKRSETLRKWNERWVILDPTSGKMEYKLRRNETAIKGTILFDASSTITLSPVNFQGMPKYDGCCFYIGTPQKKDYFLCAETPGAAKAWVSTLQATQLVLGAH

SEQ ID NO: 48777 - DNA, 590 bp, Panicum virgatum
  misc_feature: Ceres CLONE 2045580
  misc_feature: Encodes the peptide sequence at SEQ ID NO. 48778
gcgaggcagcaagggggatgggtgcagcggctgccatggctgcatcctcttctgctgccctgtcgtcacctcctcctgcctcgggcggcggccgtcgtcgccgctcgccgctgcttcgctgggttgccgtgctcatgctcatcgtcgcaacgagcagcggtctcttctggtgtgcggcggcgggccggaatgtgatcacgcacatcaaggggttcgaaggcccgctgcccttccacctcgagacagggtacgttgaggtggatgaggagcacggcgcgcggctcttctactacttcatcgcgtcggagcggaacccggcggaggacccgctcatcctctggatcaccggcggcccaggatgctcggcgctctccggcctcctcttcgagatcggccctctcaagttcgatgtggcggggtacacggaagggtttccgcgcctggtctacttcgaagactcatggaccaaggtgagcaacgtcatcttcctggacgcgccggtgggcacgggcttctcctactcccgagaggaggccggcctcaacgtcagcctcacggggtccggccgccagcaccacaccttcctccgc

SEQ ID NO: 48778 - protein, 184 aa, Panicum virgatum
  misc_feature: Ceres CLONE 2045580
  misc_feature (59)..(183): Pfam Name: Peptidase_S10 Pfam Description: Serine carboxypeptidase
  misc_feature: SWISSPROT Homolog: EC 2.3.1.92 Sinapoylglucose--malate O-sinapoyltransferase
  misc_feature: Functional homolog of the protein sequence given in SEQ ID NO 50513
  misc_feature: Useful for biocontainment applications
  misc_feature: Useful for making plants with modulated biomass
  misc_feature: Useful for making plants with modulated flowering time
MAASSSAALSSPPPASGGGRRRRSPLLRWVAVLMLIVATSSGLFWCAAAGRNVITHIKGFEGPLPFHLETGYVEVDEEHGARLFYYFIASERNPAEDPLILWITGGPGCSALSGLLFEIGPLKFDVAGYTEGFPRLVYFEDSWTKVSNVIFLDAPVGTGFSYSREEAGLNVSLTGSGRQHHTFL

SEQ ID NO: 48779 - DNA, 674 bp, Panicum virgatum
  misc_feature: Ceres CLONE 2045590
  misc_feature: Encodes the peptide sequence at SEQ ID NO. 48780
gcttcgacgatgcatatcactcacaagctgcaatttccacactgcagtagctaagttgtctagttttgagtagctagcgttcgttgttatacttgcttagtataccgcctagagcacgcaccttcaccatgcccttcgtggaccctcttctcctttcttcagcttcgccggcggcaacaagaaacgaccgccccagtggccgttccatcatcccttgggcggcggcggcgtccaacacgctgctgcccagagattttgatcgcctccagctccagctgcgcgagggcctgacgagcatacgaaagattctgcagcaacgtcgggagagcgaccaggagatgatgaccaccatcgacaacctcaagcgcctctgcatcgaccactacttcgaggagatcgagagcgccatggacgcgtgcatgcatctcatccacagcgatgatctcttcgatgcaacccttgcattcaggctcatgagagaggctggccatgatgtttcagcagatgatgttctacggaggttcactgatgacaccggcgagttcaagcttgctctcaccaaggatatcagagggctcctgagccttcacgacatgtcacacctggacatgggagaagagccatcactgcacaaggcaaaggagttctcaagcaagcacctcgcatctgccatc

SEQ ID NO: 48780 - protein, 181 aa, Panicum virgatum
  misc_feature: Ceres CLONE 2045590
  misc_feature (30)..(181): Pfam Name: Terpene_synth Pfam Description: Terpene synthase, N-terminal domain
  misc_feature: SWISSPROT Homolog: EC 4.2.3.13 (+)-delta-cadinene synthase
MPFVDPLLLSSASPAATRNDRPSGRSIIPWAAAASNTLLPRDFDRLQLQLREGLTSIRKILQQRRESDQEMMTTIDNLKRLCIDHYFEEIESAMDACMHLIHSDDLFDATLAFRLMREAGHDVSADDVLRRFTDDTGEFKLALTKDIRGLLSLHDMSHLDMGEEPSLHKAKEFSSKHLASA

SEQ ID NO: 48781 - DNA, 652 bp, Panicum virgatum
  misc_feature: Ceres CLONE 2045620
  misc_feature: Encodes the peptide sequence at SEQ ID NO. 48782
cgattttgccgcgctcccgccccacacacacacacaccccgaccttccacgcttctccagcctcactcttcctggtcaggtaagctctcgcagccagagctcaccgggttcttcttcttcttctgctcgcccgtgaatcctgaactcctcctgaccatggcgccccgatcgagctgacgcctccacatgaattgggcgtgataggtgggagcgcaggagacagggctgggaggatggcgtcggtttccagggctgtctgcggcctgcagatgccgtgcttgaacggcagggaggcgcccgccggccgccaatcggtcgcggcgccgagggcccggaacgccaaacggggcgtcatccgctccgtgtccgcctccgcctccggctccggctccggctccgtctccggccgcggccagcattgcgcgcctgccaacgccgtcgccgacgccgcgccgattacggcgacgaagagggtgttccccttcggcaagggcaagagcgagggcaacaggggcatgaaggacctgctgggcggcaagggcgcgaacctggcggagatgtcgagcatcgggctgtcggtgccgccggggttcacggtgtcgacggaggcgtgccagcagtaccaggaggcggggcggtcgctgcccgcggg

SEQ ID NO: 48782 - protein, 139 aa, Panicum virgatum
  misc_feature: Ceres CLONE 2045620
  misc_feature: SWISSPROT Homolog: EC 2.7.9.1 Pyruvate, phosphate dikinase
MASVSRAVCGLQMPCLNGREAPAGRQSVAAPRARNAKRGVIRSVSASASGSGSGSVSGRGQHCAPANAVADAAPITATKRVFPFGKGKSEGNRGMKDLLGGKGANLAEMSSIGLSVPPGFTVSTEACQQYQEAGRSLPA

SEQ ID NO: 48783 - DNA, 493 bp, Panicum virgatum
  misc_feature: Ceres CLONE 2045659
  misc_feature: Encodes the peptide sequence at SEQ ID NO. 48784
atgaagatctccgcaggcaggctgcttcattgacaatacaagcctgctatcgtatgcactttgcaaggaagaactacagaaatatctgttccgcatcaactactatccaatctggtctacgtggtatggctgctcgcaacgaactccatttccgtctgcaaacaaaagctgtggtcattattcagagtttctggcgtagttatgtagcacgctctcggtacacgagcttgaagaaggcagctgttactacacaatgtgcttggagaggaagagttgccagaaaagaactccggaaacttaaaatggctgctaaagaaactggtgctctccaagctgccaagaataaattagagaagcaagtggaggagctcacctggcgtctgcaactagagaaacgcatcaggactgacatggaagaagctaagacacaaaaaaataggaagttgcaacaacaattgccggaaactacaattacaatcccaggagacaaaag

SEQ ID NO: 48784 - protein, 163 aa, Panicum virgatum
  misc_feature: Ceres CLONE 2045659
  misc_feature (54)..(74): Pfam Name: IQ Pfam Description: IQ calmodulin-binding motif
  misc_feature (77)..(97): Pfam Name: IQ Pfam Description: IQ calmodulin-binding motif
  misc_feature (6)..(26): Pfam Name: IQ Pfam Description: IQ calmodulin-binding motif
EDLRRQAASLTIQACYRMHFARKNYRNICSASTTIQSGLRGMAARNELHFRLQTKAVVIIQSFWRSYVARSRYTSLKKAAVTTQCAWRGRVARKELRKLKMAAKETGALQAAKNKLEKQVEELTWRLQLEKRIRTDMEEAKTQKNRKLQQQLPETTITIPGDK

SEQ ID NO: 48785 - DNA, 614 bp, Panicum virgatum
  misc_feature: Ceres CLONE 2045665
  misc_feature: Encodes the peptide sequence at SEQ ID NO. 48786
attttcgcgttccactatttaaaatcctggaagccaacagctacgaccgagttcttgctcatcaccccctcccccaagccaacagcggcgaaggccccagtcagagagagagagagagagagagagagagagagagagagagagagagagagagagagagagagagagagagagagagagagagaggagccttcttcctcctccccggctgccggtggcgagagatcgacgagcgagcgagcgagcgagatggtgctgtcccacggcgtcggcggcggctccgatgagtcggtgcactcgacgttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggagcccgagtgcgacaagctcatccaggcctccgtcaacaagaactacgtcgacatggacgagtaccccgtcaccaccgagctccagaaccggtgcgtgaacatgatcgctcatctgttcaacgcccctctcggggactccgaaactgccgtcggagt

SEQ ID NO: 48786 - protein, 121 aa, Panicum virgatum
  misc_feature: Ceres CLONE 2045665
  misc_feature: SWISSPROT Homolog: EC 4.1.1.15 Glutamate decarboxylase
  misc_feature: Functional homolog of the protein sequence given in SEQ ID NO 50492
  misc_feature: Useful for making plants with modulated nitrogen use efficiency
MVLSHGVGGGSDESVHSTFASRYVRASLPRFRMPEQSIPKEAAYQIINDELMLDGNPRLNLASFVTTWMEPECDKLIQASVNKNYVDMDEYPVTTELQNRCVNMIAHLFNAPLGDSETAVG

SEQ ID NO: 48787 - DNA, 700 bp, Panicum virgatum
  misc_feature: Ceres CLONE 2045669
  misc_feature: Encodes the peptide sequence at SEQ ID NO. 48788
agtccacactgcgaattcaaatttctccgcaacggaaacaacgcggccttccccacgtctcctttccccaacccccacctgaccacacaatccctcccaaatcgccaaccaaaatccgccccaaaacctcgcgattccctcaaggtattcctcggatcggagcgtcgcgggtgtcgccggcggcatggcgcagacgccgaaccccagcaggaggtcgttggccggcccggcgccgatgcccttcctcacgccgcggccggagcggcggcacctcgagatgaggtgggcggacggggggttccaaagcgccgtgcgccgcagcggcgtgggcgccgttgccggcaacggtggtggtttgggtggaggcgacggggatcgcgaggtgaacgtacaggtcgtgctccggtgcaggccacttagcgaggatgagcagagagcgaatgtgcagagcgccatctcttgtaatgacccaaagagggaggtcacagttctgcatagcctcttcaagcaagcagacaaaacgtttacttttgacaaggtgtttggaccgaaatctcagcagaggtcggtatatgaccatgccgttgcacctattgtgaacgatgccctcgaaggctataactgcactgtcttcgcctttggacagactggaacaggaaaaacatataccatggagggagagatgagacagaaggtcagt

SEQ ID NO: 48788 - protein, 171 aa, Panicum virgatum
  misc_feature: Ceres CLONE 2045669
  misc_feature (74)..(171): Pfam Name: Kinesin Pfam Description: Kinesin motor domain
MAQTPNPSRRSLAGPAPMPFLTPRPERRHLEMRWADGGFQSAVRRSGVGAVAGNGGGLGGGDGDREVNVQVVLRCRPLSEDEQRANVQSAISCNDPKREVTVLHSLFKQADKTFTFDKVFGPKSQQRSVYDHAVAPIVNDALEGYNCTVFAFGQTGTGKTYTMEGEMRQKV

SEQ ID NO: 48789 - DNA, 611 bp, Panicum virgatum
  misc_feature: Ceres CLONE 2045677
  misc_feature: Encodes the peptide sequence at SEQ ID NO. 48790
tgaccgctttggttttgtgccagatctcactcactatctctacacgaacaacatgcttcggtatattgaaggctatgtacagaaagtgaatcctgggaatgctcccttggtagtgggccaactactcgatgatgagtgccctgaagattttattaagggcttgattctctctgttcgttccctccttcctgttgagccactggttgatgaatgcgagaagaggaaccgcctacgtttgctcactcaattcttggagcacttagtgagcgaaggtagccaagatgtgcatgtccacaatgctcttgggaaaataatcattgacagcaacaataatcctgagcatttccttactaccaacccattttatgactcgcgcgttgtgggtaagtactgtgaaaagcgggatcctacacttgctgttgttgcttacaggcgcgggcagtgtgacgatgaacttattaacgtcactaacaaaaactcattgttcaagctgcaagccagatatgtggttgagagaatggatggtgatctgtgggataaagttcttcagcctgagaatgaatacagaaggcagctcattgaccaggtggtctcgactgcatttacaaaga

SEQ ID NO: 48790 - protein, 203 aa, Panicum virgatum
  misc_feature: Ceres CLONE 2045677
  misc_feature (55)..(194): Pfam Name: Clathrin Pfam Description: Region in Clathrin and VPS
DRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTAFTK

SEQ ID NO: 48791 - DNA, 668 bp, Panicum virgatum
  misc_feature: Ceres CLONE 2045703
  misc_feature: Encodes the peptide sequence at SEQ ID NO. 48792
ctctctctctctctctctctctctctctctctcttcctcctccctccggcctccctctcctccgcgtcctctctctcctcccaaacggcagtgagaaccgaagcgcgcgccgagagggaggggagcctcgccgcctctcgcggcagatctcgcgccagccccggattctgacgcgagatccgcgctcgccgcccgccggccggtgccgccgccgccgccgctcgctcgcccgccgccgtgcgtcgccccgatctcgaagaatccaccttgaagatgatgatgggtttgctagcgtttgagtcaccaggggctctggaatagcggatactattcccagttctttggaattggcggagttatgatcactgttgccattcttatgctatccacaggctactttggtggaatcggtgctccatttgctccgtatttctggccatatctaggacaagttccgaagaagagggaacgcaaaaggcctgtgagagtgtacatggatggatgctttgacctcatgcactatggtcacgcaaatgcattgcgacaggccaaattgttgggagatcagctggtagttggggttgtcagtgatgaggagatcgttgcaaataagggcccacctgtcctttctatggaagagaggttgactcttgttagtggcctgaagt

SEQ ID NO: 48792 - protein, 103 aa, Panicum virgatum
  misc_feature: Ceres CLONE 2045703
  misc_feature: SWISSPROT Homolog: EC 2.7.7.14 Ethanolamine-phosphate cytidylyltransferase
MITVAILMLSTGYFGGIGAPFAPYFWPYLGQVPKKRERKRPVRVYMDGCFDLMHYGHANALRQAKLLGDQLVVGVVSDEEIVANKGPPVLSMEERLTLVSGLK

SEQ ID NO: 48793 - DNA, 638 bp, Panicum virgatum
  misc_feature: Ceres CLONE 2045708
  misc_feature: Encodes the peptide sequence at SEQ ID NO. 48794
aagaaactatgagcagcttccttcaaacaaagaagaagaagaaactatgagctgttacttcccactgggaaccatgctttcattgctttggggggtcctatgcgtgttgcagttcatgttccacatggcaggtggctgcgcgatcgaggagaggattgctcttatgcgcatcagatctttgttggtggaagcaaactctgaagttcctgcttcttggggacggagtgacgactgctgctcctgggaaagggttcgatgcaacaacagcacacgagtgtcggctctcaacctccactccgtgtaccagaggaaggatcatacctttataccaattggagatccatgcggctggaatctcaatttgaccgtattttcctcgtttcatgagcttcagcagctggatttattttggaattccgcttgtcttcaaaatttcgatggccttcaaggattgactaagcttcggtatctcaacctcagctacaacatattggtcgagaatgatatcttggaatctcttggtaaattggcttctcttgaagtcataaattttgagcaaactggtttgagcggtgctcttcagaatattgctttcagaaatctcaagaacttgcgagatttgcgtctaggattcaatc

SEQ ID NO: 48794 - protein, 197 aa, Panicum virgatum
  misc_feature: Ceres CLONE 2045708
  misc_feature (32)..(72): Pfam Name: LRRNT_2 Pfam Description: Leucine rich repeat N-terminal domain
  misc_feature: SWISSPROT Homolog: EC 2.7.11.1 Non-specific serine/threonine protein kinase
MSCYFPLGTMLSLLWGVLCVLQFMFHMAGGCAIEERIALMRIRSLLVEANSEVPASWGRSDDCCSWERVRCNNSTRVSALNLHSVYQRKDHTFIPIGDPCGWNLNLTVFSSFHELQQLDLFWNSACLQNFDGLQGLTKLRYLNLSYNILVENDILESLGKLASLEVINFEQTGLSGALQNIAFRNLKNLRDLRLGFN

SEQ ID NO: 48795 - DNA, 625 bp, Panicum virgatum
  misc_feature: Ceres CLONE 2045725
  misc_feature: Encodes the peptide sequence at SEQ ID NO. 48796
aaaaatccgcagatcacgaagcggcagcgagacaagccatggcgctgtccctctccctcgcgcgcgccgcgcccctcgccgtctccgcgggcgccggggccaggaggctccccgccgccagcctcgccttcccgcccaagtccttcttcggcgcgccgctggccgccgccgccgcctccgtcgcgtcgccgctcccgcgcaagccggccacctcctccacctcgctcgcggtcgtcgcggcggggaagaaagggtacaagatgaagacccacaaggcgtcggcgaagcggttccgggtgacggggaggggcaagatcgtgcggcggtgcgccgggaagcagcacctgctcggcaagaagaacaccaagcgcaagaagaggctttccaagatggtgcaagtaaacaagagtgactatgacaatgtgacaggcgcactgccctacctcaaagtgaataggaaagcagactgagttcttcttggtcttcaaaagccattctgtttcattcaccaacctgtaattttcattcaccaacctgtaattttgtgtatcttcagctgtatttcctttcgaatatggaggccgtaattcatttcaacaaagcataaacaactcttcttactgcc

SEQ ID NO: 48796 - protein, 143 aa, Panicum virgatum; identical to SEQ ID NO: 12354
  misc_feature: Ceres CLONE 2045725
  misc_feature (75)..(133): Pfam Name: Ribosomal_L35p Pfam Description: Ribosomal protein L35

SEQ ID NO: 48797 - DNA, 695 bp, Panicum virgatum
  misc_feature: Ceres CLONE 2045741
  misc_feature: Encodes the peptide sequence at SEQ ID NO. 48798
aagctcacagttttcagacaccagaacccagcaaaagcacgcagtgagacgcagggaaggctgctgccaatgttacgcgctctcctgccgaccagaggtaacgagggccttatggctgctgctaatcaaccggcaaaactcgccatgcttgcgctactgccgtggctgctcttgtcttatggagtcagcagcgcccgttgctcgacgatccctgataacaccacggacatgctctcgttgcttgaattcaagcgtgccatcggcaacccaggagtgttgaactcttggaactccagcatgcctcattgccagtgggatggtgtgaattgcagccgaaagcacccagggcgagtcacggtgttgaccctccccgggttaggcttggcaggcccaatctccccctacatcggaaacctaacgttcctcgagactttggacctgtccataaatagattttccggcgagttgcctcctctccaccgtttccacaaactgcaaaaactcgtgctggcaaataactcatttcatgggatcattcctgataccattacaaattgtttcaacctaagctggttagacctatctggaaattccctaataggtgaaattcccctcgatataggtctcctccctaacttgttattcctacagctgtcggtgaataatctttctggaattgtcccaccaaccctaaa

SEQ ID NO: 48798 - protein, 194 aa, Panicum virgatum
  misc_feature: Ceres CLONE 2045741
  misc_feature (36)..(74): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAANQPAKLAMLALLPWLLLSYGVSSARCSTIPDNTTDMLSLLEFKRAIGNPGVLNSWNSSMPHCQWDGVNCSRKHPGRVTVLTLPGLGLAGPISPYIGNLTFLETLDLSINRFSGELPPLHRFHKLQKLVLANNSFHGIIPDTITNCFNLSWLDLSGNSLIGEIPLDIGLLPNLLFLQLSVNNLSGIVPPTL

SEQ ID NO: 48799 - DNA, 650 bp, Panicum virgatum
  misc_feature: Ceres CLONE 2045767
  misc_feature: Encodes the peptide sequence at SEQ ID NO. 48800
attcccttctcttccctgcaattcatccctaatcacatcttcccgttcgtgaagtcttcgtcttctccaatattttaccacggcccgaactccccgctcccagatccaccatggatccggtatccccgggtcgatgtgggcagccattgcaagagcccgtgttccgtttcttctgcggtgatccagcttggtcccttacctctggaacagagcgtaatcctggccgcaaattcttcatctgccagaaggcatcagttgggaggggctgcaagctttggatttgggaggatggtcttttgagatatgttgcggaaatggccgagtacagcgccgcatcgacgcatgattgtctccatgagcagctttcgattgcccgggaagctttggtcaactgtatggagaagcttgctagtgtctccgaagaagctgatgatttggtgctgaaagtccaagatttggaagtcaagttgctagagtctcaggacaccgtgcatcgtttgcatcaggatcagttgtcaggaagtgaagatggtatttgtcagtagctatcctgtttcggtaccgaaggagaattggtactcttgttcctatctcaacttacgttcccaatcatactgaattcaatggcgacggcgaaatccttggacctg

SEQ ID NO: 48800 - protein, 144 aa, Panicum virgatum
  misc_feature: Ceres CLONE 2045767
  misc_feature (22)..(62): Pfam Name: zf-GRF Pfam Description: GRF zinc finger
MDPVSPGRCGQPLQEPVFRFFCGDPAWSLTSGTERNPGRKFFICQKASVGRGCKLWIWEDGLLRYVAEMAEYSAASTHDCLHEQLSIAREALVNCMEKLASVSEEADDLVLKVQDLEVKLLESQDTVHRLHQDQLSGSEDGICQ

SEQ ID NO: 48801 - DNA, 715 bp, Panicum virgatum
  misc_feature: Ceres CLONE 2045780
  misc_feature: Encodes the peptide sequence at SEQ ID NO. 48802
acacaaattaggcataaccatcttcttttttttttcgttttcgttttttctctcttcaaccctgctcaatcgcggcggcggaggcgtcgtccatctccatgaacacggtggcttctctgtctttgatgccgcacttgctcattaagccttccttcacgtgcttctccagaaagggcgttggtcgctatggcggaatcaaggtgtatgcggtgctcagggaagatggagctgaattcgcaaggaacaacaacctggaggccctgttccatgtcgatgaccccgggccgagggtcccaatcaagaagggcaagttcttggatgtgaatgaggctctggaggtggtcagattcgacatccagtactgcgattggagggcgcggcaggatctcctcaccatcatggttctccacaacaaggtggtagaggttctcaatcctttagcaagagaattcaagtctattgaaaccttgaggaaagagcttgacgagttacaggaggaactagcaaaagctcacaatcaggttcatttatcagaagcgagagtatcatctgcgctcgacaagttagcacatatggagaccctggtaaatgacaggctattgccggatggagcctctagtacatccacagccgagtccacttcactagttccaagtacatcatccaccacccatgttcgaactaagaaacagccgcgtaggactctgaacgtgtc

SEQ ID NO: 48802 - protein, 205 aa, Panicum virgatum
  misc_feature: Ceres CLONE 2045780
  misc_feature: SWISSPROT Homolog: EC 1.13.12.14 Chlorophyllide-a oxygenase
MNTVASLSLMPHLLIKPSFTCFSRKGVGRYGGIKVYAVLREDGAEFARNNNLEALFHVDDPGPRVPIKKGKFLDVNEALEVVRFDIQYCDWRARQDLLTIMVLHNKVVEVLNPLAREFKSIETLRKELDELQEELAKAHNQVHLSEARVSSALDKLAHMETLVNDRLLPDGASSTSTAESTSLVPSTSSTTHVRTKKQPRRTLNV

SEQ ID NO: 48803 - DNA, 603 bp, Panicum virgatum
  misc_feature: Ceres CLONE 2045793
  misc_feature: Encodes the peptide sequence at SEQ ID NO. 48804
acacagccgcgagcccgcatccactctgctagtctgctagcctcaaactctcgtcagatctcacggattctgctcaggccctttcgttatcgggcattgcagattccttgatgcccagcgcatcttaaatccctgaactaaagcgattcagagatagactacggaacagcagcttgagcggttatgtctgcagtgcattagccatagttccctgtgattcaatttcctgatgatggggccaccatctccctcccgctgctagcttcacggcccaggctctgccatgatacggcggcgatgtctcttcttcctcctgctgcttgctcttcagagttgctgccgcccggcgcttgcagcctcgccgtatctggtcggcatgggcagctacgacataacggggcccgcagcagacgtcaacatgatggggtacgcgagctccgagcagatcgtggcagggattcacttcaggctcaaggcacgcgcgttcatcgtcgccgagccggatggcaagcgtgccgtctttgtcaaccttgatgcctgcatggcgtcgcagctagtcaccataaaggtgcttgagaggctaaaagcaaagtacggtgatct

SEQ ID NO: 48804 - protein, 106 aa, Panicum virgatum
  misc_feature: Ceres CLONE 2045793
  misc_feature: SWISSPROT Homolog: EC 3.5.1.23 Ceramidase
MIRRRCLFFLLLLALQSCCRPALAASPYLVGMGSYDITGPAADVNMMGYASSEQIVAGIHFRLKARAFIVAEPDGKRAVFVNLDACMASQLVTIKVLERLKAKYGD

SEQ ID NO: 48805 - DNA, 711 bp, Panicum virgatum
  misc_feature: Ceres CLONE 2045796
  misc_feature: Encodes the peptide sequence at SEQ ID NO. 48806
gccacttgctccacacttgttcctcagctcctctcagtgctgaggagcagctcttctcccctctcccaagctcagctagcgtccatcccgggagacagctgaaagagagaaagttctcagaagcttggagcaccactcgcttgacacttctccggttcttcgcctgcttcctggtatcgttccatcttgcttcctgttgaggacagtatcagaattcttctctgagcatttctgtcctcccatctcatacgcttctttaggtgatgcaacagtcaagcaccgatcttgcatcaagagggcatcaattttgagtcaaacaacagcagtgtcccggttcctgaaaacataacaagctgacaatattttcagaaagcatgaagttgctagcttttgtgctagttttattggtatgtctacaatcttctgctgctgctgagttccaagttgaagcactctatgaaatgaggcaacacctcatcgataacagtggtgtccttaatgactggaaggataatcaaatgagcgcctgctattgggaccatatcacttgtcaagacaacaaatttgttacaaaaataagtttgtcctcatctggattgacaggggtcttgtcacccagcatagcaaagctaacaaatttacaacagctgttattgaatggcaacagcttaactggagggattccacaggagttttgggaacctatcaagt

SEQ ID NO: 48806 - protein, 112 aa, Panicum virgatum
  misc_feature: Ceres CLONE 2045796
  misc_feature (20)..(60): Pfam Name: LRRNT_2 Pfam Description: Leucine rich repeat N-terminal domain
MKLLAFVLVLLVCLQSSAAAEFQVEALYEMRQHLIDNSGVLNDWKDNQMSACYWDHITCQDNKFVTKISLSSSGLTGVLSPSIAKLTNLQQLLLNGNSLTGGIPQEFWEPIK

SEQ ID NO: 48807 - DNA, 680 bp, Panicum virgatum
  misc_feature: Ceres CLONE 2045805
  misc_feature: Encodes the peptide sequence at SEQ ID NO. 48808
ggatatctcggcaccagcattcttcttccactgtgttcttggagcccgtccagatcattcagggtcggattcaggttgctttgctcaaggaccggagcttcattcgagcgggcatgtcgggccaggccgggagcggcggcggcggcggcgccgggccaccgccggcggcgtcggcgtacaagagcccgtccacggacggcaagcgccggagcacgcggttcaaggacgaggacgagtacgtcgaggtcacgctcgacgtccggggcgacggcgacggcgccttcgccgtccgcagcgtcaagggcgtcgccgccccggacgcgcaggaggcggcgctcctgggcggcccggctccggcggcggcgcccggccccggcgggctgtcgtccaagctccgggctctccggcgcatcgcgtcggggagcacgcgcgccgccggggtgccgctctcggcgctgctccgcggggaccggcccgccgccaggctcgaccggagcgtcaccggcgccgccagcgcgctccgggggctccagttcctcaaccaggccgccgtcaccgaggggtggcccgaggtcgagaagcgcttccaccgcctcgccgtcgacggcttcctcctccgctcccgcttcggccagtgcatcgggatggttggatccgaggagttcgccgtgcagatcttc

SEQ ID NO: 48808 - protein, 188 aa, Panicum virgatum
  misc_feature: Ceres CLONE 2045805
  misc_feature (124)..(188): Pfam Name: NADPH_Ox Pfam Description: Respiratory burst NADPH oxidase
MSGQAGSGGGGGAGPPPAASAYKSPSTDGKRRSTRFKDEDEYVEVTLDVRGDGDGAFAVRSVKGVAAPDAQEAALLGGPAPAAAPGPGGLSSKLRALRRIASGSTRAAGVPLSALLRGDRPAARLDRSVTGAASALRGLQFLNQAAVTEGWPEVEKRFHRLAVDGFLLRSRFGQCIGMVGSEEFAVQI

SEQ ID NO: 48809 - DNA, 714 bp, Panicum virgatum
  misc_feature: Ceres CLONE 2045829
  misc_feature: Encodes the peptide sequence at SEQ ID NO. 48810
taaccgcccgattcctctccggactccgatctccagctcgatcgcaaccggagcgcaggcatccatggccgcccccgccgccgcgccgctcgacgaggccaaggcgaagagcgtccttcgccaggtggagttctacttcagcgacagcaacctcccccgcgacaagttcctgcgggagactgtcgagcagagcgacgatggccgtaacgatctatcacgccgttccatctactcgtcgatgagtactgtattttatttgtttttgtcagcaatctgctgatttttattttttgggaactgtgcagtggtgagcttggccttgatatgttccttctcgcggatgaagtcccacctggggctcgacgccgctgtcaagcctgagactgtgccggaggagactgtgctcgcggtggctgaggtgcttcggcgttcttcggtgctccgtgtatcagaggatggtaattcaatctcttcccttttttcttagacgttcagcttctcaattcaatggtggtgctttctcttcatactcctgataaacagtggtaaggaagggatgggctctgcacttgattgtgatcatcactcctttgtttgctgtttaatttgtagcttcaattcaaattaggtaatgcaaaatttatagctgtatttgtagtctgcacatgttgttgcacctataaatatcagctattcagtgcggacaatcatgcc

SEQ ID NO: 48810 - protein, 71 aa, Panicum virgatum
  misc_feature: Ceres CLONE 2045829
  misc_feature (17)..(62): Pfam Name: La Pfam Description: La domain
MAAPAAAPLDEAKAKSVLRQVEFYFSDSNLPRDKFLRETVEQSDDGRNDLSRRSIYSSMSTVFYLFLSAIC

SEQ ID NO: 48811 - DNA, 698 bp, Panicum virgatum
  misc_feature: Ceres CLONE 2045846
  misc_feature: Encodes the peptide sequence at SEQ ID NO. 48812
cagacgctccccgatcccagttcgaactctctagacgcatcggtccctctcccttctcttcgtcgccgcctcgtcctctcctcccgtagcgcgtcttccaccttttgcacgccgaaatggcgttgccgaaccagcaggtcgtggattaccccagcttcaagctcgtcatcgtcggcgacggtggaactggtaaaaccacttttgtgaaaaggcatcttactggcgaatttgagaagaaatatgaacccaccatcggtgttgaagtgcacccgctggatttcagtactaactgcggtaaaatccgtttctattgctgggacactgctggtcaagagaagtttggtggcctcagggatggttactatattcatggtcagtgtgcaatcattatgtttgatgtaacatcaaggctgacatacaagaacgttccaacatggcacagggacttgtgcagggtgtgcgagaacattcctatcgtcctgtgtggcaacaaggttgatgtgaagaacaggcaagttaaggccaagcaagttacattccacaggaagaagaacttgcagtactatgaaatttctgccaagagcaactacaactttgagaagcccttcctgtaccttgcaaggaaactggcaggggaccagaaccttcactttgttgaggctggtgctctcaagccaaccggaggtgcagatcgatat

SEQ ID NO: 48812 - protein, 193 aa, Panicum virgatum
  misc_feature: Ceres CLONE 2045846
  misc_feature (15)..(173): Pfam Name: Ras Pfam Description: Ras family
  misc_feature (15)..(128): Pfam Name: Miro Pfam Description: Miro-like protein
  misc_feature: SWISSPROT Homolog: EC 2.7.11.1 Non-specific serine/threonine protein kinase
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAGALKPTGGADR

SEQ ID NO: 48813 - DNA, 715 bp, Panicum virgatum
  misc_feature: Ceres CLONE 2045857
  misc_feature: Encodes the peptide sequence at SEQ ID NO. 48814
acgcgccgcgcgggggggagcttcgtttccttctcgtcctcgctctcttttcagagaaggcttttcagtcaaagcaggggggcgcatagttcatggaatgtctcaagttggattcctcagatttcttcgtggagggcgatgcaatcgatagcccattggatatccatctcgagtccgatagcttggcagccaccaaagctgtgccggatcatcgccggtatgctcagcttcattgcagtaatgccccggatccgcctccgctgcccggaacttcgtatggcgcgcggaggagttctaggaaggcgaagacttgcagccgtgtccctgaagaggtcctggattcctgggacaagctatttttagagggataccaggctgatctccgtgtttccacagatgatggcactgaaattctgtcgcactcttgtgttcttggtgtcaaatctcctgttctgagagctatgttggaagacgctaaactgaaacatggttttcggtgcatccgaatttctggtgcgccttcagatgcagtccatgttttcatcagatttctttactcttcacgttttgagcaggaacagatgaagaagcatgttctgcacttgcttgtactctcccatgttttctcggtttcatctatgaagacggtttgcatcgaccagcttgagaggaatttccttgcacctgacaacgttgtagacatcctgcaactttg

SEQ ID NO: 48814 - protein, 207 aa, Panicum virgatum
  misc_feature: Ceres CLONE 2045857
  misc_feature (85)..(195): Pfam Name: BTB Pfam Description: BTB/POZ domain
MECLKLDSSDFFVEGDAIDSPLDIHLESDSLAATKAVPDHRRYAQLHCSNAPDPPPLPGTSYGARRSSRKAKTCSRVPEEVLDSWDKLFLEGYQADLRVSTDDGTEILSHSCVLGVKSPVLRAMLEDAKLKHGFRCIRISGAPSDAVHVFIRFLYSSRFEQEQMKKHVLHLLVLSHVFSVSSMKTVCIDQLERNFLAPDNVVDILQL

SEQ ID NO: 48815 - DNA, 663 bp, Panicum virgatum
  misc_feature: Ceres CLONE 2045874
  misc_feature: Encodes the peptide sequence at SEQ ID NO. 48816
gaattttttgcccaaagcttcgctttctcgcaactcgcaagtcgctcctgctcccgctcaatcgccgccagcgccgccgcccagatggctgctgcaccggaagagcgcctcgatgtcctcgacgccgccggggtgaagaccggcgtctccaagccaagggacggcgactaccaccgggcggtgcacgtgtggatctacagcgagagcaccggggagcttctgctgcagcgccgcgccgactgcaaggactcgtggcctgggaagtgggacatctctagcgccggccacatctccgccggcgactcctcgctcttctctgcacagagggagctcgaggaagaactaggcatcaagcttccagtcgatgccttcgagctgtcatttgtatttcttgaggaatgtgttataaacaacgggacattcataaacaatgagtactgtgatgtttaccttgtgactaatttagctccaattccacttgaggccttcactctccaagaaagtgaagtatctgcagttaggtatatgtgttgtgatgagtacaggagctgccttgcaaaagaaagtggagaatatgttccttatgatgtgaacgggcaatatggccacctttttaatatcattgaagaaaggtacaaagacaatacagtgtcccgcagttta

SEQ ID NO: 48816 - protein, 192 aa, Panicum virgatum
  misc_feature: Ceres CLONE 2045874
  misc_feature (29)..(171): Pfam Name: NUDIX Pfam Description: NUDIX domain
  misc_feature: SWISSPROT Homolog: EC 5.3.3.2 Isopentenyl-diphosphate Delta-isomerase
MAAAPEERLDVLDAAGVKTGVSKPRDGDYHRAVHVWIYSESTGELLLQRRADCKDSWPGKWDISSAGHISAGDSSLFSAQRELEEELGIKLPVDAFELSFVFLEECVINNGTFINNEYCDVYLVTNLAPIPLEAFTLQESEVSAVRYMCCDEYRSCLAKESGEYVPYDVNGQYGHLFNIIEERYKDNTVSRS

SEQ ID NO: 48817 - DNA, 644 bp, Panicum virgatum
  misc_feature: Ceres CLONE 2045902
  misc_feature: Encodes the peptide sequence at SEQ ID NO. 48818
ggcccaaaattccactccatcatcactcactagctctcgtcgccgccttcacacagagagagagcatcatcgatcagcttgggcaagctccttcgtccgccatggatccgagggccttggtcctggtggtcgtggcggcggcggcggcggccggggtcggcggggacttcgcggcggaccgggcggagtgctcggacaagctggtggggctggcgacgtgcctgacgtatgtgcaggacgaggcggcggcgccgacgccggactgctgcgaggggctcaagacggtgctgcagaccagccgcaagtgcctgtgcgtgctcgtcaaggacaaggacgaccccaacctggggctcaagctcaacgtcaccaaggcgctggggctccccgccctctgcaaggcctccgccaacatctccgactgccccagtacgtggcctctgatcattcctcatcatcatccacaggccagttggtggagtggtagttcttgtcatcgtaatcatctaccactcactttattaaaaataattgttacttgtttatgaaaaggaagaacatgctaggatcaaagtttagactcgacttgggaaaaactcgatccatggcagccctacttaatttgggtcagggacgaagccagatca

SEQ ID NO: 48818 - protein, 147 aa, Panicum virgatum
  misc_feature: Ceres CLONE 2045902
  misc_feature (30)..(107): Pfam Name: Tryp_alpha_amyl Pfam Description: Protease inhibitor/seed storage/LTP family
  misc_feature: Functional homolog of the protein sequence given in SEQ ID NO 50433
  misc_feature: Useful for making plants with altered carbohydrate content
MDPRALVLVVVAAAAAAGVGGDFAADRAECSDKLVGLATCLTYVQDEAAAPTPDCCEGLKTVLQTSRKCLCVLVKDKDDPNLGLKLNVTKALGLPALCKASANISDCPSTWPLIIPHHHPQASWWSGSSCHRNHLPLTLLKIIVTCL

SEQ ID NO: 48819 - DNA, 683 bp, Panicum virgatum
  misc_feature: Ceres CLONE 2045903
  misc_feature: Encodes the peptide sequence at SEQ ID NO. 48820
gcatatcactcccaagctgcaattccacactgatgccttgctcgcctaagttattgtctccctaattaagctagagctagctaacaatggccgccgcacctgcacgcaccttctccacgtcctccgtggaccctcttcccgtttcagcttcgctgccggcaaccagaaacaacgaccagcgaggccgcccccgtggccgttccatcatcgcttcggcggcggcgtcgaaaacgctgctgcccagtgatgattttgacctccagctccagactctgcaggaacgtaggaacagcgcccgggagatgatggccaccatcgacaacctcaagcgcctctgcatcgaccactacttccaggaagagatccagagcgccatgggcgcgtgcttggatctcatccacagcgatgatctcttcgatgcgacacttgcattcaagctcgtgagagaggccggccatgatgtttcagcagatgatgttctacggaggttcactgacgacaccggcgagttcaagcttgctcttagcaaagacatcagagggctactgagcctccacgacatgtcacacctggacatgggagaggagccatcactgcacaaggcaaaggagttctcaagcaagcaccttgcatctgccatcaggtacctggagccaggcctcgcaaggtacgtgaggcagtcc

SEQ ID NO: 48820 - protein, 198 aa, Panicum virgatum
  misc_feature: Ceres CLONE 2045903
  misc_feature (36)..(195): Pfam Name: Terpene_synth Pfam Description: Terpene synthase, N-terminal domain
  misc_feature: SWISSPROT Homolog: EC 4.2.3.13 (+)-delta-cadinene synthase
MAAAPARTFSTSSVDPLPVSASLPATRNNDQRGRPRGRSIIASAAASKTLLPSDDFDLQLQTLQERRNSAREMMATIDNLKRLCIDHYFQEEIQSAMGACLDLIHSDDLFDATLAFKLVREAGHDVSADDVLRRFTDDTGEFKLALSKDIRGLLSLHDMSHLDMGEEPSLHKAKEFSSKHLASAIRYLEPGLARYVRQ

SEQ ID NO: 48821 - DNA, 554 bp, Panicum virgatum
  misc_feature: Ceres CLONE 2045926
  misc_feature: Encodes the peptide sequence at SEQ ID NO. 48822
accaaaaatggccttcttcttcttcatccgcatggtgctcctcttcttcctgagcacaacatgcgccaccgcactcaccccaacaccaaatgccacagaccttgctgcgctgctcgccttcaaggcacagctcaaggacccctttggcatcctcgcgagcaactggactcggactgcctccttctgctcgtgggccggcgtctcatgtgaccgcagccagcgcgtcaccggcctggagttccgcgacgtgccgctccagggcagcgtcgcgccggagcttggcaatctctctttcctctcgactctggtcctcagcaacaccagcgtcatgggtaccgtgccaagcgagcttggtagtctgccatggcttcaaactcttgatctttcttacaacagcttgtcaggtaccatccctcgcatccttggcaaccttactaggcttgagatgcttgatcttgcttggaataacttctttggggggatcccgcatgagttgcaaatttgcacaggcttcttatgctaaggttgcaaggcaatgacctgagcggaccatt

SEQ ID NO: 48822 - protein, 171 aa, Panicum virgatum
  misc_feature: Ceres CLONE 2045926
  misc_feature (28)..(68): Pfam Name: LRRNT_2 Pfam Description: Leucine rich repeat N-terminal domain
  misc_feature: SWISSPROT Homolog: EC 2.7.11.1 Non-specific serine/threonine protein kinase
MAFFFFIRMVLLFFLSTTCATALTPTPNATDLAALLAFKAQLKDPFGILASNWTRTASFCSWAGVSCDRSQRVTGLEFRDVPLQGSVAPELGNLSFLSTLVLSNTSVMGTVPSELGSLPWLQTLDLSYNSLSGTIPRILGNLTRLEMLDLAWNNFFGGIPHELQICTGFLC

SEQ ID NO: 48823 - DNA, 661 bp, Panicum virgatum
  misc_feature: Ceres CLONE 2045931
  misc_feature: Encodes the peptide sequence at SEQ ID NO. 48824
atccttgtcctcctcttccgcttccctcccaatccagcctgagttcaatccagatattacccagcagaagccaagccgagcaaaatcgagcgctggaagcttcagccagcgaagccgaaccgaaccgaagccgcgcggcacgccgcgatggggatccccttccggtggcttctcgtcgccctggttgttctcagttcggtcgccttgcacgtcgcggcggccaaatctatagatccctacaaggttcttggagtagacaagaatgccagccaacgcgacattcagaaagcctttcacaagctttctcttaaatatcaccccgacaagaataaaggcaagggtgctcaggaaaaattcgaagaaataaacaatgcatatgagattctatctgatgaagagaagaggaaaaactatgacctatatggggatgagaagggtaaccctgcattcagtggtggaaattttggaaatcgtgagggttacacatacttcactggcggtggccccaagaccagctatttcacatctggtgatggatggaagacaatgggtggtcagggaaatacaaaaacattttccttttcgtttggtggtaatcctggggccagtggtggaacccatttggtggggggtttgatctgggtgatgtttctctaactta

SEQ ID NO: 48824 - protein, 169 aa, Panicum virgatum
  misc_feature: Ceres CLONE 2045931
  misc_feature (29)..(90): Pfam Name: DnaJ Pfam Description: DnaJ domain
MGIPFRWLLVALVVLSSVALHVAAAKSIDPYKVLGVDKNASQRDIQKAFHKLSLKYHPDKNKGKGAQEKFEEINNAYEILSDEEKRKNYDLYGDEKGNPAFSGGNFGNREGYTYFTGGGPKTSYFTSGDGWKTMGGQGNTKTFSFSFGGNPGASGGTHLVGGLIWVMFL

SEQ ID NO: 48825 - DNA, 711 bp, Panicum virgatum
  misc_feature: Ceres CLONE 2045940
  misc_feature: Encodes the peptide sequence at SEQ ID NO. 48826
aagcgaaagctcaagcaatcgaacaacagtcgcctaatccacactcaaatcaagcaccaaacaacctccagatcccccgatagagctcaccccccgcagcctctgcagcgagatggctcccgagattgccggcaagatgaccgccaaggccgccgccgccgccgccgccgccgcggtgaagcccgcgaccagggcgtacgtgacgttcctggcgggcgacggcgactactggaagggcgtggtgggtctggccaagggcctgcgcaaggtcggctcggcgtacccgctggtggtcgccgtgctgcccgacgtgccggaggcccaccgccggatcctcgtctcgcagggctgcatcgtccgcgagatcgagcccgtgtacccgccggagaaccagacgcagttcgccatggcctactacgtcatcaactactccaagctccgcatctgggaggtaatcaactgatccacgaaccgccgcctgacctttctcttgcttaattcttcgataatgctgtgctcatcactgacatgccgccggccggggaaaaaatggggtgcgcccctcgcgcacggacgctcccgtgcgcacccagccccgatgccgttcctttaggatctgacggatggcgcagtgaacggctcggcttcctcgcagggatcgacttccgcgtgacctcggctcgttgaatcgaatagcccgccggctccgct

SEQ ID NO: 48826 - protein, 116 aa, Panicum virgatum
  misc_feature: Ceres CLONE 2045940
  misc_feature: Functional homolog of the protein sequence given in SEQ ID NO 51421
  misc_feature: Useful for making plants with altered carbohydrate content
  misc_feature: Functional homolog of the protein sequence given in SEQ ID NO 50309
  misc_feature: Useful for making plants with altered cell wall content and/or composition
  misc_feature: Functional homolog of the protein sequence given in SEQ ID NO 50310
  misc_feature: Useful for making plants with modulated water use efficiency
MAPEIAGKMTAKAAAAAAAAAVKPATRAYVTFLAGDGDYWKGVVGLAKGLRKVGSAYPLVVAVLPDVPEAHRRILVSQGCIVREIEPVYPPENQTQFAMAYYVINYSKLRIWEVIN

SEQ ID NO: 48827 - DNA, 612 bp, Panicum virgatum
  misc_feature: Ceres CLONE 2045944
  misc_feature: Encodes the peptide sequence at SEQ ID NO. 48828
aaaacccacacgcccccctcccctcactgcgtcctcgactcccatcctcggctcagctagctagccttctccttctccacctcgccgcgctagaccggccggggcaccatgagtgccgccaccgccgccgagcagcaaccggagccgccggccgccgccgggaccactccgccggcggtgatccgcaacgctcgccaccgccccagcacgctcaagctgtgctaccacctcgccgtctccaactccccctacctcctcctccccctcgccgccgccctggccatccgcccgatcccccgccaccccgacccgctcccctccctcgccgccgctgcccgctccgccctcacctccaacacgcccctcaccctcgccctcctcgccctcgccgccgccctcgccaccatctacctcatgcgccgcccgcgcgccgtctacctcctcgacttcgcgtgctacaagcccgggccggagcacgtgatcacccgcgagaccttcatgcggcagtcggtgggggcggggacgttcacaccggagaacctcgcgttccagcggaagatcctcgagcggtcggggctgggccaggggaccttcttcccgcgcgcggtgctg

SEQ ID NO: 48828 - protein, 167 aa, Panicum virgatum
  misc_feature: Ceres CLONE 2045944
  misc_feature: SWISSPROT Homolog: EC 2.3.1.119 Icosanoyl-CoA synthase
MSAATAAEQQPEPPAAAGTTPPAVIRNARHRPSTLKLCYHLAVSNSPYLLLPLAAALAIRPIPRHPDPLPSLAAAARSALTSNTPLTLALLALAAALATIYLMRRPRAVYLLDFACYKPGPEHVITRETFMRQSVGAGTFTPENLAFQRKILERSGLGQGTFFPRAV

SEQ ID NO: 48829 - DNA, 745 bp, Panicum virgatum
  misc_feature: Ceres CLONE 2045948
  misc_feature: Encodes the peptide sequence at SEQ ID NO. 48830
aagggcatctactctgcacttcttcgcctgatccagtccaaccggagagagtgacagggaaaccattggactctgcatagaagcttcctgatatttctaaggggcgataaggcagggaatgagtacaaccaaggtgaagagacgtgtggggaagtatgagctcggtcggaccataggtgaaggcacattcgcaaagattaagcgggaaatttcaacaatgaagttgatcaagcatcctaatgttgttcgcatatatgaggtgatgggaagtaaaacaaagatatacattgtgttagaatttgctacaggtggtgagctctttgacataattgctaaccatggtcgaatgagggaagatgaggcaaggaggtatttccaacaattaatcaatgcagttgattattgtcatagcaggggtgtgtaccaccgggatctaaaacctgaaaatttactgctcgattcgtatggaaacctgaaggtctccgactttgggctgagcgctctatctcagcagatcaagcatgtttcttctctcttctatcttgtttaggatgatggattgctgcatacaacttgtggaactccgaactacgttgcaccagaggtccttgaagatcaaggttataacggcgcaatggctgatttgtggtcatgtggagttatcctgtttgttctgctagcagggtatttgccttttgaggactctaatcttatgatgttgtataaagaaatatcaaatgcagaa

SEQ ID NO: 48830 - protein, 143 aa, Panicum virgatum
  misc_feature: Ceres CLONE 2045948
  misc_feature (13)..(140): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
  misc_feature: Functional homolog of the protein sequence given in SEQ ID NO 50317
  misc_feature: Useful for making plants with modulated biomass
MSTTKVKRRVGKYELGRTIGEGTFAKIKREISTMKLIKHPNVVRIYEVMGSKTKIYIVLEFATGGELFDIIANHGRMREDEARRYFQQLINAVDYCHSRGVYHRDLKPENLLLDSYGNLKVSDFGLSALSQQIKHVSSLFYLV

SEQ ID NO: 48831 - DNA, 658 bp, Panicum virgatum
  misc_feature: Ceres CLONE 2045955
  misc_feature: Encodes the peptide sequence at SEQ ID NO. 48832
aaccaccacccagcgtccatctcatccccgtttgccgttgagaattcctttcacctcactcttgagcacgcggcggcggctcctcgctctcgcaagcgagcacgggcgaaatggcgcgccacgcagggaagcccctcctcgcgctcctcgtgctgtccagcctcctcttcctcccgctcgtcgcctccgtccccttgccaagaagcctgcgcctggggaacccgcagcagcacccgccggctgtgaagcttgctgcttcttctcaggaggcggcgatggcggcgtggaacctcggcagcaggccggcggcgaggctggccgtggaggtgaacgactaccaaccgtccggccccaacaaccgccatgaccctcccaagggtcccggcagagcgtgaacagtggacccaataatcctccatcttcttcgccagtagtacaaaagtgcttgcttgcttgctagttcgatcctgtattctaaaatggtagcagaaacaaaatcacctactagtagttacagaaggggtctgggggtcgatctgtatctgtctatatgccgcaccgatcggctggctgttcttgagtttgttcatcagaactgccacatcggtttctcgtgctgtgcaggcgttgaatacattgccccggattattcagctcc

SEQ ID NO: 48832 - protein, 94 aa, Panicum virgatum
  misc_feature: Ceres CLONE 2045955
  misc_feature: Functional homolog of the protein sequence given in SEQ ID NO 50820
  misc_feature: Useful for making plants with modulated flowering time
MARHAGKPLLALLVLSSLLFLPLVASVPLPRSLRLGNPQQHPPAVKLAASSQEAAMAAWNLGSRPAARLAVEVNDYQPSGPNNRHDPPKGPGRA

SEQ ID NO: 48833 - DNA, 711 bp, Panicum virgatum
  misc_feature: Ceres CLONE 2045991
  misc_feature: Encodes the peptide sequence at SEQ ID NO. 48834
gaccagtacacgcaggcgctgcacaaggcgctcatgttcttcaacgcccagcgatctggtccgctgcccaagcacaacggcgtcagctggaggggcaattcctgcatgaaggatggtctctcggacagcaccgtccggcggagcttggtcgggggcttctacgatgcaggggacgccatcaagttcaactaccccatggcctggtccatgaccatgctcagctggagtgtgatcgagtacaaggccaagtatgaggccatcggcgagctcgaccatatcaaggagctgatcaagtggggtacagattacatcctcaaggccttcaattcgtcggccgacacaatcgacaggattgttgcccaggtgggtgtaggtgacacctccaaaggcagctcccagcctaatgaccactactgctggatgagaccagaggatatcgattacaaaaggcctgtcactgagtgtcactcttgctcagatctagcatctgaaatggctgctgccctggctgcagcttccatagtgttcaaggacagcaagacctactctgacaagcttgtcaaaggtgcaaaagccctgtacaaattcggcaggctgacgcgcgggcgatacagtccgaatggatccgaccaggcaattttctacaattccaccagctactgggatgagtttgtgtggggtggtgcttggatgtattttgccacagggaaa

SEQ ID NO: 48834 - protein, 236 aa, Panicum virgatum
  misc_feature: Ceres CLONE 2045991
  misc_feature (2)..(236): Pfam Name: Glyco_hydro_9 Pfam Description: Glycosyl hydrolase family 9
  misc_feature: SWISSPROT Homolog: EC 3.2.1.4 Cellulase
  misc_feature: Functional homolog of the protein sequence given in SEQ ID NO 50500
  misc_feature: Useful for making plants with altered cell wall content and/or composition
  misc_feature: Functional homolog of the protein sequence given in SEQ ID NO 50501
  misc_feature: Useful for making plants with altered carbohydrate content
DQYTQALHKALMFFNAQRSGPLPKHNGVSWRGNSCMKDGLSDSTVRRSLVGGFYDAGDAIKFNYPMAWSMTMLSWSVIEYKAKYEAIGELDHIKELIKWGTDYILKAFNSSADTIDRIVAQVGVGDTSKGSSQPNDHYCWMRPEDIDYKRPVTECHSCSDLASEMAAALAAASIVFKDSKTYSDKLVKGAKALYKFGRLTRGRYSPNGSDQAIFYNSTSYWDEFVWGGAWMYFATG

SEQ ID NO: 48835 - DNA, 654 bp, Panicum virgatum
  misc_feature: Ceres CLONE 2045995
  misc_feature: Encodes the peptide sequence at SEQ ID NO. 48836
atgatgttgctaacttggtatctggtgtatcaaaattaagctacataaatcagctactgcgcaggcatcagcaaaaaaacactggtgggagcactcttacttcagaagaagcaaataatctgcgtgttatgttactggggatggttgatgatcctcgtgtggtgctcatcaagctggcagaccgcttgcacaatatgcgaactatttatgctcttcctgtaccgaaagctgaagctgttgctcaagagacattggctgtctggtgttcacttgcttctcgtttgggagtctgggctttgaaagctgagctggaagatttatgctttgctgttcttcaggttttaattccattcgacatattgactgactgtgaaatgtttactttgtaccatagaacttcaaggggtctaacagacatctagatgctttggaaatttcaaagaaacaattttcttgttgaaagtgtgtattcattcaaatgggtaaattcatgcaaggcacacaaacaaacctatgatgatcttctatccttcgcgcctctttggctgggccccacttttcctcaaatcttcaagaaaatacgatctgaacttactttaatgtggagtagtatgggcaaatccaaaagtatgagaagatcatcaattagaagcg

SEQ ID NO: 48836 - protein, 139 aa, Panicum virgatum
  misc_feature: Ceres CLONE 2045995
  misc_feature: SWISSPROT Homolog: EC 2.7.6.5 GTP diphosphokinase
DVANLVSGVSKLSYINQLLRRHQQKNTGGSTLTSEEANNLRVMLLGMVDDPRVVLIKLADRLHNMRTIYALPVPKAEAVAQETLAVWCSLASRLGVWALKAELEDLCFAVLQVLIPFDILTDCEMFTLYHRTSRGLTDI

SEQ ID NO: 48837 - DNA, 715 bp, Panicum virgatum
  misc_feature: Ceres CLONE 2046001
  misc_feature: Encodes the peptide sequence at SEQ ID NO. 48838
tccgtgctaagcttgggaagtttgggttacctggacacaaccatctcactccaattgttaaattgtctggtggtcagaagtcccgcgttgtgttcacttctatatcaatgtctcaacctcacattctcctgcttgatgaaccaacaaatcacttggacatgcaaagtattgatgctttagcagatgcgctggatgagttcactggaggtgttgtcttggttagtcatgactcacgattaatatctcgtgtttgtgaggatgagcaaaggagtgagatatgggttgtggaggatggcacagtgaagaaatatgatggtacatttgaggattacaaggatgaactcatggaagaaataaagaaggaagttgaagaataatgctgctccaaatggcagatgattaggcacgcgatgcacgtcctaccattttaacaatcaaatccaacaacgcgccctaccattttaacaatcaaatccaacaatagaatcaaataaacattagagagaaggatctctgtcaagatccttgtggtgactgatgatctgcgtcgggaggatctgaatcttgctcgcgacatgaaggatttggatttatcagcggcgaaaaagggtacatctggatctagctatggagatttttcggtgcttgctaagataataacctttacaaggcattggtaacctttacgaggcattgttaaacttcagagcattag

SEQ ID NO: 48838 - protein, 124 aa, Panicum virgatum
  misc_feature: Ceres CLONE 2046001
  misc_feature (1)..(98): Pfam Name: ABC_tran Pfam Description: ABC transporter
  misc_feature: SWISSPROT Homolog: EC 3.6.3.44 Xenobiotic-transporting ATPase
RAKLGKFGLPGHNHLTPIVKLSGGQKSRVVFTSISMSQPHILLLDEPTNHLDMQSIDALADALDEFTGGVVLVSHDSRLISRVCEDEQRSEIWVVEDGTVKKYDGTFEDYKDELMEEIKKEVEE

SEQ ID NO: 48839 - DNA, 692 bp, Panicum virgatum
  misc_feature: Ceres CLONE 2046021
  misc_feature: Encodes the peptide sequence at SEQ ID NO. 48840
acccgcgccccccatctgatgctcctgctccgccgccgcgtccgcttcctcctcccgtcgtcgctctcgtcccctcgcgcgccgctcgcaaaacctctcccgctccccctccgccacccgcccagaatactagcctcggcggcgcgcccgctcgcgtccatggccgcgccggcggcgatgagccgggacgcgttccgcgcggcggtgaccaacacgctggagcggcgcctcttcttcgtgtcctccttcaagatctacagcggcgtcgcggggctctacgactacggcccccccgggtgcgccgtcaaggccaacgtcctcgccttctggcgccagcattttgtgttagaggaagggatgcttgaggttgactgtccatgtgtgacaccagaagttgtcttgaaagcctctggtcatgtggataaatttacagacttaatggttaaagatgaaaagacaggcaactgctaccgtgcagatcatttgctcaaggatttttgtaaggataagcttgagaaggaccagacgttgtcacctgagcaggcagaagaatacaataaaattcttgctatcttggatgatctctctgcagagcaattgggtgctaagattaaggagtatgggattgttgctcctgacaccaagaacccattgtcagatccctaccccttcaatctcatgtttcagacttc

SEQ ID NO: 48840 - protein, 230 aa, Panicum virgatum
  misc_feature: Ceres CLONE 2046021
  misc_feature (102)..(225): Pfam Name: tRNA-synt_2b Pfam Description: tRNA synthetase class II core domain (G, H, P, S and T)
  misc_feature: SWISSPROT Homolog: EC 6.1.1.14 Glycine--tRNA ligase
TRAPHLMLLLRRRVRFLLPSSLSSPRAPLAKPLPLPLRHPPRILASAARPLASMAAPAAMSRDAFRAAVTNTLERRLFFVSSFKIYSGVAGLYDYGPPGCAVKANVLAFWRQHFVLEEGMLEVDCPCVTPEVVLKASGHVDKFTDLMVKDEKTGNCYRADHLLKDFCKDKLEKDQTLSPEQAEEYNKILAILDDLSAEQLGAKIKEYGIVAPDTKNPLSDPYPFNLMFQT

SEQ ID NO: 48841 - DNA, 700 bp, Panicum virgatum
  misc_feature: Ceres CLONE 2046040
  misc_feature: Encodes the peptide sequence at SEQ ID NO. 48842
actacgatgtggaggtgttcttgaagctatcaggatcagctgtgctggataccccacaagaaaaacattttacgaatttgtcaatcgttttggtgtccttgctcctgaagttttagaagggagcaatgatgataagatcgcgtgccagaagattttggaaaaaatgggtctggagaactaccagattggaaaaacaaaggtgtttctgagagctggacagatggctgatttggatgcacggagagctgaagtattaggaagagcagcaagaatcatacagagacaaatatgtacatatattgcaaagaaacagtttgtcgagcttaaaaaatcagcaacacagctgcaatcttttgtcagaggaaccttggctcgtaagctgtatgggtgcatgaggtgggaagcagcagcagtgaaaatacaaaagaatatgcgtcgccataaagcacgagagtcttatttacaattgcaagcagctgcagtcacactgcagacaggtttaagggcaatgtctgctcgcaatgaattcaggttcagaaaggaaacaaaagcagctgtccacatccaagctcgatggcgctgccacagagactactcacattacaagaatctgcaaggtgctgctcttacttaccagtgtgcgtgacaaaggcttgcgagaagagagctcagaaagctcaagatggccgcgagagaaaca

SEQ ID NO: 48842 - protein, 214 aa, Panicum virgatum
  misc_feature: Ceres CLONE 2046040
  misc_feature (109)..(129): Pfam Name: IQ Pfam Description: IQ calmodulin-binding motif
  misc_feature (134)..(154): Pfam Name: IQ Pfam Description: IQ calmodulin-binding motif
  misc_feature: SWISSPROT Homolog: EC 2.7.11.1 Non-specific serine/threonine protein kinase
LRCGGVLEAIRISCAGYPTRKTFYEFVNRFGVLAPEVLEGSNDDKIACQKILEKMGLENYQIGKTKVFLRAGQMADLDARRAEVLGRAARIIQRQICTYIAKKQFVELKKSATQLQSFVRGTLARKLYGCMRWEAAAVKIQKNMRRHKARESYLQLQAAAVTLQTGLRAMSARNEFRFRKETKAAVHIQARWRCHRDYSHYKNLQGAALTYQCA

SEQ ID NO: 48843 - DNA, 624 bp, Panicum virgatum
  misc_feature: Ceres CLONE 2046055
  misc_feature: Encodes the peptide sequence at SEQ ID NO. 48844
ggcacttcagcaaacatgtaagcacttagcagccaccacatcatagccaactccgccggcacggcccttggctagtgtatatatattatacatacatgttatagtccggcagatgttgaactgaaggcgcacatctgtaagagtttatttccagcaagcatgacgagctggcttgctccattatgtgttcaacatctagccctgcttatgctgcttctttcgctccacgagtctccgttgcacgcgactgatacgctcaccgtgacccagccgctgtccggtgaccgaaagctgatctctcaaaacggcagcttcgcactggggttcttccagcctacaggtgcagatggagttgctaatggcaagtggtacatagggatttggtacaataaaatacctgtgcaaactgtagtgtgggtggctaacagagagaaaccactcctagatccagcctcgtcaaagctaacaatctccgatagtggaaatattgttctcctgacgaaccgctctgagtctcatgtgtggtctaccaatatcaataacaaaacttccgccagatcgacagttgcagtgctcctcgactctgggaatctcatcgtcagaaatgcgtccaacacctctcag

SEQ ID NO: 48844 - protein, 154 aa, Panicum virgatum
  misc_feature: Ceres CLONE 2046055
  misc_feature (81)..(154): Pfam Name: B_lectin Pfam Description: D-mannose binding lectin
MTSWLAPLCVQHLALLMLLLSLHESPLHATDTLTVTQPLSGDRKLISQNGSFALGFFQPTGADGVANGKWYIGIWYNKIPVQTVVWVANREKPLLDPASSKLTISDSGNIVLLTNRSESHVWSTNINNKTSARSTVAVLLDSGNLIVRNASNTS

SEQ ID NO: 48845 - DNA, 628 bp, Panicum virgatum
  misc_feature: Ceres CLONE 2046099
  misc_feature: Encodes the peptide sequence at SEQ ID NO. 48846
agctcgatctatttgtctcctgacccgccccaacgcagcaagacctgggatctttgggtgtgcctttgtattgctgctcccttgccagaggaccaagggatacatgtttaactcttgctcaagcgggttgtgccactagcagagcacaaagatggaattagaggaagtaccatttaaaatattacaagagattacaaatgatttctctgaggagcggaaacttggtgaaggatcatttggagatgtttacagggcagtgactaaaaatggcgaggatattgctgtgaagaagcttaaagaaatgttgttccgaaatgatccggaccagctccgaaatgatcaggagcagttccgaaatgagttttatagcctcaggatgcttaagcataaaaacattgtacaggttcttggctattgctatgaaacaaagcaaatacctatggagctcaatggtataaaagtgcttgctgaagagacacatagagcgctctgcttagaatatttgcacagtggaagccttaagaaacatctttctgatgagtcttgtggacttgaatggcatgcacggtacagaattattaagggtatttgtgagggtctaaaatatattcatgaggatctggaaaaa

SEQ ID NO: 48846 - protein, 158 aa, Panicum virgatum
  misc_feature: Ceres CLONE 2046099
  misc_feature (18)..(157): Pfam Name: Pkinase_Tyr Pfam Description: Protein tyrosine kinase
  misc_feature: SWISSPROT Homolog: EC 2.7.11.1 Non-specific serine/threonine protein kinase
MELEEVPFKILQEITNDFSEERKLGEGSFGDVYRAVTKNGEDIAVKKLKEMLFRNDPDQLRNDQEQFRNEFYSLRMLKHKNIVQVLGYCYETKQIPMELNGIKVLAEETHRALCLEYLHSGSLKKHLSDESCGLEWHARYRIIKGICEGLKYIHEDLE

SEQ ID NO: 48847 - DNA, 613 bp, Panicum virgatum
  misc_feature: Ceres CLONE 2046104
  misc_feature: Encodes the peptide sequence at SEQ ID NO. 48848
ggactgccggttgcggcgatggagtgcgcggcgaaggggctggccgcggagccgtgcgccggcggcgtcgccgaccggcggtgcggcagctgcggggccgtcgcctgctgctcccgcgcccaccagattatacattggagagttcacaaagaagaatgtgaaagatttgcagagcaaatgaggcgtgtcaatctgctgagccagtttccgttcacattcttagaacctcctaccctgaaccatgaattaccaagtacaaggtgcttctttttgcaaacgatcaaacttcacgagaaagggctctggaaatcagaatgtatatgtggctcagatgttgcttctgcgaaagacttaagcatagcagctgaatggaacttgcaaagctccctctgcccatgtacagagcctgaaaatcctgtgcctgcggtcctggcaagctgggaagactattatcagtggagatcccttcccttgcattcacctgttgctgttttacttcattggccacttactctatatcattgccttcaactctattgtctcccaacctcaaaatatgatggccaggacaccctgtgcattcactatttagggcctgagaaggaactactac

SEQ ID NO: 48848 - protein, 198 aa, Panicum virgatum
  misc_feature: Ceres CLONE 2046104
  misc_feature (13)..(47): Pfam Name: zf-MYND Pfam Description: MYND finger
MECAAKGLAAEPCAGGVADRRCGSCGAVACCSRAHQIIHWRVHKEECERFAEQMRRVNLLSQFPFTFLEPPTLNHELPSTRCFFLQTIKLHEKGLWKSECICGSDVASAKDLSIAAEWNLQSSLCPCTEPENPVPAVLASWEDYYQWRSLPLHSPVAVLLHWPLTLYHCLQLYCLPTSKYDGQDTLCIHYLGPEKELL

SEQ ID NO: 48849 - DNA, 622 bp, Panicum virgatum
  misc_feature: Ceres CLONE 2046125
  misc_feature: Encodes the peptide sequence at SEQ ID NO. 48850
aggtacactcctcttgtccatccttccacctcgccgccggcgagacgactcgaccggccaccagcccaccaatcccgcacgcgctcttcgcttcgcctcacctccttccccgcggccccggcttcttgccgcagcgcggtccttgcctcttcccccagctcacgcggcctccgtccccgcgctaccgtccccgcttggcgccgccacctcctgacgcgctccttccctcagcgggaaacccgaaacgtggccgggattctcaaccgctacgcaccacggtgcttgaccactcgtcggcgccgtccccgcggtgccttatctgctactttcccacgtgaagcgtagcttgtctggttgtgtgcattgggggaaggattgatggccaacagcgagtatgagtacgtgaagagggaattcgagttcgatcgccgtctcccgccctctaactggatcgttgtccgcatcgacggctgccacttccaccggttctcgaagattcacgcttttgagaaaccgaacgatgagaatgctctaagattgatgaacgcttgtgccacagctatgcttgagaaattccctgacatagtctttggttatggtgttagtgatgagtacagctttg

SEQ ID NO: 48850 - protein, 81 aa, Panicum virgatum
  misc_feature: Ceres CLONE 2046125
  misc_feature (1)..(81): Pfam Name: Thg1 Pfam Description: tRNAHis guanylyltransferase
MANSEYEYVKREFEFDRRLPPSNWIVVRIDGCHFHRFSKIHAFEKPNDENALRLMNACATAMLEKFPDIVFGYGVSDEYSF

SEQ ID NO: 48851 - DNA, 627 bp, Panicum virgatum
  misc_feature: Ceres CLONE 2046127
  misc_feature: Encodes the peptide sequence at SEQ ID NO. 48852
atctcatcgaccaagaccggaagcaccactgcatcaagctcatcggcgccagcaagctcctcctccgccactcctgtcaaacatggccaccggccggagcggcggcggcggcgccgcggggaagtgctgcggaggcttcttcgggttactcttcaccgtcggcttcatcgtgctcatctactgggccatcttccagccccaccacatccgcgccgccgtcgactccgccaccctctcaaacctcaccgtctccagcaacgccgcctccgccgctggtgtctcctaccacctcgtcgtaaagctcagcctctacaaccccagcgtccgcgtcaacatctactatgacgccctcgacgccgagctccgcttccgcgacgccgccgtcatcggcccggccgccaacgacacctccccgtccgaattctaccagcgcagcaagacgaacgaggtggtgacggtggagttcgactacggaaggccgggcgccatcgccgtcgccggcgacgccgccggggatctggagaaggagatgaggagcggcgggccggtgagcttggagctgcacgtgggcgtgcaggtgaggtacgtgttcaggatgttcaagctgcggcagaagccgaggatatc

SEQ ID NO: 48852 - protein, 181 aa, Panicum virgatum
  misc_feature: Ceres CLONE 2046127
  misc_feature (34)..(181): Pfam Name: Hin1 Pfam Description: Harpin-induced protein 1 (Hin1)
MATGRSGGGGAAGKCCGGFFGLLFTVGFIVLIYWAIFQPHHIRAAVDSATLSNLTVSSNAASAAGVSYHLVVKLSLYNPSVRVNIYYDALDAELRFRDAAVIGPAANDTSPSEFYQRSKTNEVVTVEFDYGRPGAIAVAGDAAGDLEKEMRSGGPVSLELHVGVQVRYVFRMFKLRQKPRI

SEQ ID NO: 48853 - DNA, 708 bp, Panicum virgatum
  misc_feature: Ceres CLONE 2046128
  misc_feature: Encodes the peptide sequence at SEQ ID NO. 48854
gcgcatggtttcgatcgccccatcgaatctgctgtaaactactactagtcctgttgttaaggccaaagagcccagaaggatcccatctcccctgtctccgtctcctcgccgatctatattgtttctgcgatctttctacctgagagaggttcgaacagggctgccgctacggttcctgtctcccctctgcatcccggatcgccgggatcagtatcggccttcagtaggagacaaaaaaatatcaaggaatgctggaagatgtgcttgcatgttagagagttaccttgtgtgggatttggcgaggaagcccaacatatttgcactttgcttgaccttgatgacattgaagtacaagcaattgcacagcaattgctccatgtggatgggcacagtggggctggatgtggtagctcaaccatcatgttagatcaccatcttggcggagacggttgaagctattgtgcatctaaaaagctctctactgttacatcattgagtgctcatcaccacctcaagtttcaaaatcactgattttcttatagttcgctcggagaagatggtcgacaaagggaacgttctgttggagaaatatgagatgggaaagttacttggtcaagggagttatgctaaagtttaccatgctcgtgatgttaatacttcacagagtgttgccatcaaggtgattgacaaagagaagatctttgagtg

SEQ ID NO: 48854 - protein, 50 aa, Panicum virgatum
  misc_feature: Ceres CLONE 2046128
  misc_feature: SWISSPROT Homolog: EC 2.7.11.1 Non-specific serine/threonine protein kinase
  misc_feature: Functional homolog of the protein sequence given in SEQ ID NO 50317
  misc_feature: Useful for making plants with modulated biomass
MVDKGNVLLEKYEMGKLLGQGSYAKVYHARDVNTSQSVAIKVIDKEKIFE

SEQ ID NO: 48855 - DNA, 2154 bp, Panicum virgatum
  misc_feature: Ceres CLONE 2046131
  misc_feature: Encodes the peptide sequence at SEQ ID NO. 48856
aggaaaaacatcgtttgatagcccttccaccatactgtagtttccacctcagttgaacatcaacaaagctctcttccatagtcgccagctcatttataatactgaactatgtcacgaggcagggatcctttggcattgagccaggtaattggtgatgtgttggatccttttgttaagtcagcaacaatgaggattaattatggtgacaaggagatcacaaatggaactggactacgagcatcagcagtgctcaatgcaccacatgttgagattgaaggccacgaccaagcaaagctttacacccttgttatggtggatcctgatgcaccaagtccaagcaaaccagagtacagggaatatctacaatggttggtgacagatataccagaggcaagagacatacattttggttaagcagttggacggttgttatctgcccaacagcgcctcaagttgagtatctgagatcatgttatttactgtgggtcccactatatcacttaagtcagtgtggcaagacttctacaggaaatcaagtagatggatgttgatatcgttacctgcttcactgcttgacaatatacaatgctcgacaattggcatcttctgtgtgggcccaaagaaatatgggacacagctgtatattaaatctgcgggacatcctaagaactttaaacattagaagttagaacttccatttccagacaaaaataaaatatggaaagaaattagtgttcagattaaatacgagatcataaggttgccaaattgctttctggttcagggtccccttcaagaagctgccagctaatcccacaaattatagttattagttctcgcaaaacactagtgctgcgacttttttgagaattgcatcaaggacttcttctaagtcatgcaatatcactggattcataaacgtatctttagtaacacatgcaaatctagcagcacagtcttttgataggctcaccaagttctgttcttcttaggccaccagatacagacttctttgttaatcattcaagactgcaagaaagttttaagtaaactttgaacaaatcacaaaattaccatcataatcataatagaccgaatgcattttgcgaatttatgattcatagttgatcatactttatccctttatctcccttttcatgtatggttaataatgggaacattccacctctcgataatatatgtgcagctctggatgatacaagggtttatgctataggtagcaataactccatcgccacaggctatttgtgcgtgtgtgggtgggggagggcgtgggaacagttagaaaagtcagtactgtagaatggttataggtagccttcaccttaaaaattgaaattacagtaagctttctaataaggaatacaaactttttcaggcaatgaaatagttccctacgaaagcccaaggccgcctgctggaattcatcgaattgtttttgtgctattcaaacagcaagcacgacagacagtttatgcaccaggatggcggcaaaatttcaacatcagagacttctcagcaatctacaatctcggagcaccagttgctgcattatacttcaactgccaaaaggagagcggtgttggtggcagaaggtttctgggatcaagctgaagtacagatacagaaaaacatctacaacaaggaagaagcattcacaattcagaaactgatatccatataaaacagttgaaaacatatgagatgttagttgacagttaagcactagagtaatcaacttatatcatatgaaacaaactagcatttggaggttatcttcttatgtcactaggcctcaataaaatattatgatgttgatattagcaattatgaggaagggtgttcagttgggaaaaaaaatggtgttccaaagttcaagtatcaaaaaaatattcaaactataaatctgcttggtggttttccgaagcataatgaaggaggccatggacgtgaccatcctgcctattagtgttctaaaattcaagtataaacctgcatggtgggttctcctcctgggttttttccctgagccttgcagacacaaaatctgcagttctgaaggccttataaacttaaattgctgtggaagattttcttttttttgtcaagagaacaaggattgcatatccagat

SEQ ID NO: 48856 - protein, 101 aa, Panicum virgatum
  misc_feature: Ceres CLONE 2046131
  misc_feature (19)..(101): Pfam Name: PBP Pfam Description: Phosphatidylethanolamine-binding protein
  misc_feature: Functional homolog of the protein sequence given in SEQ ID NO 51756
  misc_feature: Useful for making plants with modulated flowering time
  misc_feature: The sequence is a functional homolog of SEQ ID NO 2 in US patent 7196246
MSRGRDPLALSQVIGDVLDPFVKSATMRINYGDKEITNGTGLRASAVLNAPHVEIEGHDQAKLYTLVMVDPDAPSPSKPEYREYLQWLVTDIPEARDIHFG

SEQ ID NO: 48857 - DNA, 509 bp, Panicum virgatum
  misc_feature: Ceres CLONE 2046132
  misc_feature: Encodes the peptide sequence at SEQ ID NO. 48858
ataccgccgcgagcccgcatccactctgctagtctgctagcctcaaactctcctcagatctcacgaattctgctcaggccctttcgttatcaaggcattggaaattccttgatgcccagcgcatcttacaatccatgaactaaagcgattcagagatagactacggaacaacagcttgagcggatgtgtctgcagtgcatcagccatagttgcctgtgaatctatttcctgatgatggggccaccatctccctcccgctgctagcttcacggcccatgctcggcgatgataccgcggcgatgtctcttctaccgccagctgcctgctcttcagagttgctgccgaccggcgctggcagcctcgccttatctggtcggcatgggcagctacgacataacggggcccgcagcagacttcaacatgatggggtacgcgagctccgaggaaatcgcggcatggattccctgcaggttcaaggcactcgcgtacatcgtcgccgagccggatgg

SEQ ID NO: 48858 - protein, 74 aa, Panicum virgatum
  misc_feature: Ceres CLONE 2046132
  misc_feature: SWISSPROT Homolog: EC 3.5.1.23 Ceramidase
MIPRRCLFYRQLPALQSCCRPALAASPYLVGMGSYDITGPAADFNMMGYASSEEIAAWIPCRFKALAYIVAEPD

SEQ ID NO: 48859 - DNA, 692 bp, Panicum virgatum
  misc_feature: Ceres CLONE 2046196
  misc_feature: Encodes the peptide sequence at SEQ ID NO. 48860
ctcaaggaagaagaccaaatcaagacagcattcatcactccgttcagcgcatacgcatacaagaccatgtccttcggattaaagaacgttggagcaacatatcagcatgccatacagctatgcttcaccaatcagcttcaccgcaatttggaagcttacgtcgatgatgtggtcgtaaaaacaaaggaatacaattcctttattcctgacctagaagaaaccttcaatagtttacgaagcttcaggtggaaattaaacccgaccaagtgtgtttttggcgtgccacacggaaaactactcggcttcatagttagccacagaggaatcgaagcgaatcccgagaagattaacaccattatgaacatggaagctccggcttctatcaaagatgttcagaagctcactgggtgcatggccactctaaatagattcctctcgagactcagcgaaagaggactccctttcttcaagctactcaagaagcaagataagttcaaatggtttcaagaagcactagatgcgctcgaagacctaaagcagcacctccaatcacctccaatgctcacagccccaatgccaggagaggagttgctcctctatattgcggctaccacacacgtcgttagcatggcaattgtagtagaacgcaacgaagaagggcacgcctacggcgtccaacgactagcttactt

SEQ ID NO: 48860 - protein, 230 aa, Panicum virgatum
  misc_feature: Ceres CLONE 2046196
  misc_feature: SWISSPROT Homolog: EC 2.7.7.49 RNA-directed DNA polymerase
LKEEDQIKTAFITPFSAYAYKTMSFGLKNVGATYQHAIQLCFTNQLHRNLEAYVDDVVVKTKEYNSFIPDLEETFNSLRSFRWKLNPTKCVFGVPHGKLLGFIVSHRGIEANPEKINTIMNMEAPASIKDVQKLTGCMATLNRFLSRLSERGLPFFKLLKKQDKFKWFQEALDALEDLKQHLQSPPMLTAPMPGEELLLYIAATTHVVSMAIVVERNEEGHAYGVQRLAY

SEQ ID NO: 48861 - DNA, 714 bp, Panicum virgatum
  misc_feature: Ceres CLONE 2046204
  misc_feature: Encodes the peptide sequence at SEQ ID NO. 48862
gcatcgcggctcgcaaactcccatcaccgcaaggcaagcgaacccggcggaaccgtcgccgagaagagaagagagacaaggtggagtaggccatgtccaacgtgcccgcctccctccgcgactcctccctcaccgtcttccgcctcgccatgtccagctccgacccctggcccttctcttcctgcctctagccaccagccccctccgcctcgatcggcttcctctccctcctcctcttctagagcagcaggccgccgctcctcctcgcttcggttctcggggcggggctcagccgatcgatctggcctgcctggcggcaatcatcatgcacggcaagcaccaccaccaccagcagcagcagatggcgccggccgcggtggcgcccaaggggtgcgtgacggtgcgggtgggcgcggacggggaggagcagcgccggttttttgttccgctgggccacctcaagcacccgctcttcggcgcgctgctcgaggaggccgagcgcgagtacggcttccgccaccagggcgccatcgccatcccctgccgcgtcgaccgcttcgtccaggtcgagcacctcatcggccaggacctccacggcgccggcagcagcacctgcgcgcagcacctcgtcgacctcgacagcgccgccgccgccccgcaccaccaccacctgcacctgccgcgcttcgtcggctgcttccgcgcctgatgatg

SEQ ID NO: 48862 - protein, 127 aa, Panicum virgatum
  misc_feature: Ceres CLONE 2046204
  misc_feature (1)..(86): Pfam Name: Auxin_inducible Pfam Description: Auxin responsive protein
MHGKHHHHQQQQMAPAAVAPKGCVTVRVGADGEEQRRFFVPLGHLKHPLFGALLEEAEREYGFRHQGAIAIPCRVDRFVQVEHLIGQDLHGAGSSTCAQHLVDLDSAAAAPHHHHLHLPRFVGCFRA

SEQ ID NO: 48863 - DNA, 685 bp, Panicum virgatum
  misc_feature: Ceres CLONE 2046206
  misc_feature: Encodes the peptide sequence at SEQ ID NO. 48864
gacgctttcccaggctcgccacgccctgcgctcccccgtcgcgtcgccttctatctttggggggagagcctttgccgctcctcactctctgtgtcacgtatctcctcggttgctgattccctgctcgtttgtcgccatttccgcacctcgtgccctgtgaaggcatggcgagctcggggccaacgtctgggaagaaatctctaaatacggtgactttgctgttcaaattaccatattacacacaatgggggcagagccttctgattgctggctcggaaccggcactgggttcgtggaatgtcaagcaaggactgtctctgagtccagttcatcaggataatgagctaatctggtgtggaagagtgtctgttgctgctggcttcacctgtgaatacaaatactatgtagtggatgacaacaagaacgttttgagatgggaggctggggagaacaggaaactagtcctgccagatggcgttcaagaaggagacataattgaaatccgtgactggtggcaggatgcttctgaagcccttttccttagaagcgcattcaagaatgttgttttcaatgctacagaaggtgttaaaaaggaaccccagtcggcatcccctcacaaaagtttggatcctgaagatatcgttgtccagttcgtaattagctgtcctcgactcgaatctggttc

SEQ ID NO: 48864 - protein, 173 aa, Panicum virgatum
  misc_feature: Ceres CLONE 2046206
  misc_feature (15)..(111): Pfam Name: CBM_20 Pfam Description: Starch binding domain
  misc_feature: SWISSPROT Homolog: EC 3.2.1.3 Glucan 1,4-alpha-glucosidase
MASSGPTSGKKSLNTVTLLFKLPYYTQWGQSLLIAGSEPALGSWNVKQGLSLSPVHQDNELIWCGRVSVAAGFTCEYKYYVVDDNKNVLRWEAGENRKLVLPDGVQEGDIIEIRDWWQDASEALFLRSAFKNVVFNATEGVKKEPQSASPHKSLDPEDIVVQFVISCPRLESG

SEQ ID NO: 48865 - DNA, 671 bp, Panicum virgatum
  misc_feature: Ceres CLONE 2046231
  misc_feature: Encodes the peptide sequence at SEQ ID NO. 48866
acaaatcagtcgagaggggggagaagacggtcgataaagtcaatctgcttggttggcttcgtgcttgggcctgcgaagaggagtgagcctgagccagccgcctcctcctcctccttcgacgaggggagggaattaggctagcaagggggaaggggaagcgaggatgagcggaggaggcatggacggggctccggccgccgaattccggccgacggtgacgcacggcggccggttcctccagtacaacatcttcggcaacctgttcgagatcaccagcaagtaccagccgcccatcatgcccatcggccgcggcgcctacgggatcgtctggtacgttctgtgccacctcgcccggctcatcgatttcttgcgagttgcagatgattggcgagcaattgggttaattcatactaggtcataggaggatggccatggattgatagggccaatcagttcatttttctttttctgtttttgtaaaaaaattactagagtactgcaattgagcaacaagtttggttaaatttagtactgcagtggttggtgagctttttcgaatcaaatgaaacgctcccagcttttaagagtggttgaatgattttgttctgaaaattctgtacgggcccgcgcagctcggtgatgaacttcgagacgagggagatggtggccat

SEQ ID NO: 48866 - protein, 85 aa, Panicum virgatum
  misc_feature: Ceres CLONE 2046231
  misc_feature: SWISSPROT Homolog: EC 2.7.11.24 Mitogen-activated protein kinase
MSGGGMDGAPAAEFRPTVTHGGRFLQYNIFGNLFEITSKYQPPIMPIGRGAYGIVWYVLCHLARLIDFLRVADDWRAIGLIHTRS

SEQ ID NO: 48867 - DNA, 733 bp, Panicum virgatum
  misc_feature: Ceres CLONE 2046236
  misc_feature: Encodes the peptide sequence at SEQ ID NO. 48868
cacaacccccacgccagtagcctccccattccgcccgccgtcacctgcccctctgcctcctccggtcgccgcctcagcggtttaaggttcacctgcagccatgggtaaagagaagtcccacatcaacatcgtggtcattggccacgtcgactctggcaagtcgaccaccaccggccacctgatctacaagcttggtggtatcgacaagcgtgtgatcgagaggttcgagaaggaagctgctgagatgaacaagcggtccttcaagtacgcatgggtgcttgacaagctgaaggctgagcgtgagaggggtatcacaatcgatattgccctgtggaagttcgagaccaccaagtactactgcactgtcattgacgcccctggtcaccgtgacttcatcaagaacatgatcacgggtacctcccaggctgactgtgctgtccttatcattgactctaccactggtggttttgaggctggtatctccaaggatggccagacccgtgagcatgctctccttgctttcactcttggagtgaagcagatgatctgctgctgcaacaagatggatgctaccactcccaagtactccaaggcccgttatgatgagatcgtgaaggaagtctcctcctacctgaagaaggtgggatacaaccctgataagattgccttcgtccccatctctggttttgagggtgacaacatgaatgagaggtccacgaaccttgactggtac

SEQ ID NO: 48868 - protein, 210 aa, Panicum virgatum
  misc_feature: Ceres CLONE 2046236
  misc_feature (5)..(207): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIAFVPISGFEGDNMNERSTNLDW

SEQ ID NO: 48869 - DNA, 592 bp, Panicum virgatum
  misc_feature: Ceres CLONE 2046238
  misc_feature: Encodes the peptide sequence at SEQ ID NO. 48870
gattagtaaaacaattgccatgtcagacggagttgtcgtcctcaggacgaagaagttcttattgaaccgccttctttccagaaaacaaatggtcttggaagtcctccatccaggccaggccaacttttccaaggataagctcaccgagctcattgccaagaagttcaagactgatgccaagaacgtcgttgtcttcggcttccacaccgttttcggtggtggtaaaagtaccggtttctgcttgatctacgataatcgtgactatctcttgaagtacgagcccaagtatagactcgtcagactcaaagttttggaacaaaagatccacaacagaaaggccagaaaggaattaaagaccaagaggaaaaaggtcagaggaaaagaaaaatcaaagatccaagccggcaagaagaagtaaactggtgctgcttgacgatttgtatggattatcctatccctttattattgtgcccataattatgactccctcctcattttgcatatgctgacataaaaaagaaatccgataacttgaaattaagcctgggtgaagatgaaaatacctatcatgatctcgtttactgggctatcc

SEQ ID NO: 48870 - protein, 132 aa, Panicum virgatum
  misc_feature: Ceres CLONE 2046238
  misc_feature (24)..(106): Pfam Name: Ribosomal_S24e Pfam Description: Ribosomal protein S24e
MSDGVVVLRTKKFLLNRLLSRKQMVLEVLHPGQANFSKDKLTELIAKKFKTDAKNVVVFGFHTVFGGGKSTGFCLIYDNRDYLLKYEPKYRLVRLKVLEQKIHNRKARKELKTKRKKVRGKEKSKIQAGKKK

SEQ ID NO: 48871 - DNA, 725 bp, Panicum virgatum
  misc_feature: Ceres CLONE 2046256
  misc_feature: Encodes the peptide sequence at SEQ ID NO. 48872
actcaacccggccgcagccggtcagagaagggttcggtgccgaaaaccccaatcgccgccgcccccctcccctcctccggccgccgccgcctcccgcattccgccgcgccgatcgtgttggtgagaggggccgcgtgggatggcgtcgtcggcgtctgcgccggcgtccaagggtccgcgctatgcgcccccggatccgacgctgcccaagccgtggagggcgctcatcgacggcaacaccgggtacctctacttctggaacccggagaccaaggtcacccagtacgagcgccccgtcgcggctgcacccccctccccgtcgcaaccgcctggctactccaggcccgaggagagggcgaggagcagcggaccttccgagttgcactcggaagctgcggtgagccgctcgcagtatgcgcctttgtctgataacagaacaaggaatgatcactcagagccacgctttgcagctgaagcgaatgtttcacagagtgctcctttcaccaatcaattttctcaagctggcaatggaagccaaatgtcgacagaagcatatcgtgctaagcatgagattactatcgttggtaacgaggcgccagcaccattcatgacatttcagtcaacaggctttccgtcagagattctaagggaggttctgcaggcaggattctctgcaccaactcctatccaagctcagtcatggccaattgctctaaaaggtcgtg

SEQ ID NO: 48872 - protein, 195 aa, Panicum virgatum
  misc_feature: Ceres CLONE 2046256
  misc_feature (22)..(52): Pfam Name: WW Pfam Description: WW domain
MASSASAPASKGPRYAPPDPTLPKPWRALIDGNTGYLYFWNPETKVTQYERPVAAAPPSPSQPPGYSRPEERARSSGPSELHSEAAVSRSQYAPLSDNRTRNDHSEPRFAAEANVSQSAPFTNQFSQAGNGSQMSTEAYRAKHEITIVGNEAPAPFMTFQSTGFPSEILREVLQAGFSAPTPIQAQSWPIALKGR

SEQ ID NO: 48873 - DNA, 693 bp, Panicum virgatum
  misc_feature: Ceres CLONE 2046267
  misc_feature: Encodes the peptide sequence at SEQ ID NO. 48874
ttatcctatcttcgcccagccctttgctggcgatgagcgcatcctccaggttgctctcaagttgacttcaattctatcagctggaggaaacttcaaattccagttggttgcaatatgagtggtgtcgtgataaaggtttttgtttcacgatcgcagaatggaggagtccgatggggaggatattggtgttccagaagttggtatggtgttcaataatcacacagaagtcaaccgattttaccgcaagtatgctcgtcgtgttggctttggtgtctcagtaaggaggtcctcattttcacaagaaggaacctgcttatatctcgagcttatgtgctgcaaaggagggcggccgcgttatgagccaaagttccggaaacgggcctcatcgaccactaactgcccagccaagattcgagtgaagttgtggggagacaaattgttgcatgtagagttggtgatccttgatcacaatcatccagtgagcccagcaatggcaagattcttgaactcttataagcagctctctggccctgcaaagaggcggttacgtatgggtggccctggggctatgcctgttgaagagccaagtaagatgcccatgaataagttgggggaacttgaggagcttttgtttggtgagagcaagcaccacagttttgtggagaggggtcgtttgaagctcccaccctgaag

SEQ ID NO: 48874 - protein, 177 aa, Panicum virgatum
  misc_feature: Ceres CLONE 2046267
  misc_feature (26)..(110): Pfam Name: FAR1 Pfam Description: FAR1 family
MEESDGEDIGVPEVGMVFNNHTEVNRFYRKYARRVGFGVSVRRSSFSQEGTCLYLELMCCKGGRPRYEPKFRKRASSTTNCPAKIRVKLWGDKLLHVELVILDHNHPVSPAMARFLNSYKQLSGPAKRRLRMGGPGAMPVEEPSKMPMNKLGELEELLFGESKHHSFVERGRLKLPP

SEQ ID NO: 48875 - DNA, 692 bp, Panicum virgatum
  misc_feature: Ceres CLONE 2046277
  misc_feature: Encodes the peptide sequence at SEQ ID NO. 48876
aaggggaaaaaaaggcgaggggcgggtctcatggcgctagcctagccgcctcccaacctcctcaccgaggagagagagagaggacagaggagagagagagagaggaggttccatttccgcgtcgtctccgcccgcagccccaccctccacatggccgcgctgccgggtggggcccacgccgccggcgccgcggacccgatgcaggtggaccagccgcgccccgccgccgccgccgcagcagcgaccgcccccgcggatgccaagcatgccagttctatgattgaagggggtgatccagtcactggtcacataatctcaacaacgattggaggcaagaatggagagcctaaaaggactatcagctacatggccgagagagttgtgggaactggatcattcggaatcgtcttccaggctaaatgtctggagactggtgagactgttgccattaagaaggttttacaggacaagcggtacaagaatagggagctgcaaatcatgcgatccatggatcactgcaatgtcgtctccttgaagcattgcttcttctctaccacaagcagggatgaacttttccttaacttggtgatggagtttgttcctgagtcactgtatcgtgtattgaagcattacagcaatatgaaccagaggatgccgcttatatatgtcaagttatacacctaccagatatt

SEQ ID NO: 48876 - protein, 180 aa, Panicum virgatum
  misc_feature: Ceres CLONE 2046277
  misc_feature: SWISSPROT Homolog: EC 2.7.11.1 Non-specific serine/threonine protein kinase
  misc_feature: Functional homolog of the protein sequence given in SEQ ID NO 50365
  misc_feature: Useful for making plants with modulated biomass
  misc_feature: Functional homolog of the protein sequence given in SEQ ID NO 50366
  misc_feature: Useful for making plants with modulated water use efficiency
MAALPGGAHAAGAADPMQVDQPRPAAAAAAATAPADAKHASSMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQI

SEQ ID NO: 48877 - DNA, 553 bp, Panicum virgatum
  misc_feature: Ceres CLONE 2046286
  misc_feature: Encodes the peptide sequence at SEQ ID NO. 48878
agagctgagtcacaggccacagccagacacccccccaaggaggagaggaagctgcttttcagataagatgatggagatggcgtcgttgcttcgacttgttgccctctcgctgctccttgcagtggccactccagtaagggacatcaccgatgcgtgctcgtctcaagtcaaggctgcagacttccctcacctgaacggctccggcctccacctcacgctgcaccacccgcggagcccctgctcgccggcgccgctgcccgccgacctccccttctccgcggtgctcacccacgacgacgcgcgcatcgcctcgctcgccgcgcgcctcgccaagacgccgtcctcgcggcccaccgcgcttgacgagtcgtcgtccccggcgctcgacgagtccctcgcgtccgtgccgctgggcccgggcacgtcggtgggcgtgggcaattacgtcacccgcatgggcctcggcacgcctgccaagtcgtacgtcatggtcgtggacacgggctcctcgctcacgtggctgcagtgctccccctgcgtggtgtcgtgccac

SEQ ID NO: 48878 - protein, 158 aa, Panicum virgatum
  misc_feature: Ceres CLONE 2046286
  misc_feature: SWISSPROT Homolog: EC 3.4.23.12 Nepenthesin
MASLLRLVALSLLLAVATPVRDITDACSSQVKAADFPHLNGSGLHLTLHHPRSPCSPAPLPADLPFSAVLTHDDARIASLAARLAKTPSSRPTALDESSSPALDESLASVPLGPGTSVGVGNYVTRMGLGTPAKSYVMVVDTGSSLTWLQCSPCVVSC

SEQ ID NO: 48879 - DNA, 581 bp, Panicum virgatum
  misc_feature: Ceres CLONE 2046292
  misc_feature: Encodes the peptide sequence at SEQ ID NO. 48880
tcgacagattgtggtctcctcgagttttttttttttttttttttgtagcagcgagctgttgcaaatggcgtcgacggtggcgagcctgtccaccccggcgaccttcgcggccgcagacgtggtcccgaggaggaaggtcgtcgccgccggccgcgtctggttccccgtggcgcgccgcggcggcggcttcgcggtgaggtcgagcgggccggcgacgccgccggggatctccgacaaggtgtcggagagcatcaagaaggcggaggagacgtgcgcggaggagacggcctccggggagtgcgcggcggcttgggacgaggtggaggagctcagcgccgcggcaagccacgcccgggacaagctcaaggagaacagcgacccgctcgagaactactgaaaggagaaccccgaggccgacgagtgccgcacctacgacaactagaccatgcctgtttgctaaatttgccgcacacgaccggaggatttgcacgaagctttatgcttctctgcctgtaatatatatatatccactatactcgtgtgtgtgatatagattgaatataagaacgagttatctttcg

SEQ ID NO: 48880 - protein, 110 aa, Panicum virgatum
  misc_feature: Ceres CLONE 2046292
  misc_feature (55)..(110): Pfam Name: CP12 Pfam Description: CP12 domain
MASTVASLSTPATFAAADVVPRRKVVAAGRVWFPVARRGGGFAVRSSGPATPPGISDKVSESIKKAEETCAEETASGECAAAWDEVEELSAAASHARDKLKENSDPLENY

SEQ ID NO: 48881 - DNA, 607 bp, Panicum virgatum
  misc_feature: Ceres CLONE 2046304
  misc_feature: Encodes the peptide sequence at SEQ ID NO. 48882
tatccaccgacgcagcgaccccggtcagccaccagcccaatgcggcgaacgcagtgaggaagacacagcgccgccgcagtgggcacacctgcccgcccgcgcgcgcactgctgtgctgccgctgccgctgcttgacctcgcctgtcagccgctgctgggtgctggagaggagaggaggggatcaggggggagccgggagggcggcggcgccatggcggggggaggaggaggagggcccgggccggggaaggtgaaggcggggagccggccgccgtgggtggggctggcggcggcggtgtgggtgcaggtggcggcggggagcgcctacgtgttcccgctctactcgcacgccgttaaggaggcgcttgggtacgaccagaaggcgctcaccatgctcggcgtcggcaacgacgtcggcgagaacgtggggctcgtcccgggggtgctggccaaccgcctcccgccctggctcatactcgtcatcggctccgcctgcgccttcttcggcttcggcacgctctggctcgccgtcaccaagaccgtcgccatgccgtactgggtgttgtggatagctttatgtatcgcgacaaacagcagtgcatggttg

SEQ ID NO: 48882 - protein, 131 aa, Panicum virgatum
  misc_feature: Ceres CLONE 2046304
  misc_feature (21)..(131): Pfam Name: Nodulin-like Pfam Description: Nodulin-like
MAGGGGGGPGPGKVKAGSRPPWVGLAAAVWVQVAAGSAYVFPLYSHAVKEALGYDQKALTMLGVGNDVGENVGLVPGVLANRLPPWLILVIGSACAFFGFGTLWLAVTKTVAMPYWVLWIALCIATNSSAW

SEQ ID NO: 48883 - DNA, 704 bp, Panicum virgatum
  misc_feature: Ceres CLONE 2046307
  misc_feature: Encodes the peptide sequence at SEQ ID NO. 48884
aagttcccatccgctccccccacccccgccgccagacgccgaccctccagctgcaccgagcagcggccatggtgaagaagcccaacggcgttgccaaggccacgccggccgcgcccgttgccaaggccacgccggcctctgccggcgcggcggccgggccatccaaggcgaatccgtccacccctgggtcgattaagacctcgaagtttaagaagcggaaggccaaggccaaccgggccactgccgccgctgcaactgttgaccaagtcgcgtcggtgggcgcagccacttctggtggcgatgcatctgcttcggcggtcttaccgcagccatcccatgttgctgaagcatcacctcaggcacaaatgccagagtcagacactattgctgaggcatcacctgtgacgcctaagccagccactgctgaagcatcagctttggttgcaaagccaaagccaaaacccactgatgctgatgctgatgctgatgctgatgctgatgctgatgctgatgctgatgctgatgctgcggctgcggctgcggctgatgctgatgctgcggctgcggctgcacctgcggcaagcaagggcaagggcgcgggtgctgataatagaagtggtgatggaaggatgaagagcagaagagtgaggtctaggagtggcaaggggaaggaggttgtggaggatggaggaagtaaagggaaa

SEQ ID NO: 48884 - protein, 211 aa, Panicum virgatum
  misc_feature: Ceres CLONE 2046307
  misc_feature: SWISSPROT Homolog: EC 3.1.1.61 Protein-glutamate methylesterase
MVKKPNGVAKATPAAPVAKATPASAGAAAGPSKANPSTPGSIKTSKFKKRKAKANRATAAAATVDQVASVGAATSGGDASASAVLPQPSHVAEASPQAQMPESDTIAEASPVTPKPATAEASALVAKPKPKPTDADADADADADADADADADAAAAAAADADAAAAAAPAASKGKGAGADNRSGDGRMKSRRVRSRSGKGKEVVEDGGSKG

SEQ ID NO: 48885 - DNA, 694 bp, Panicum virgatum
  misc_feature: Ceres CLONE 2046324
  misc_feature: Encodes the peptide sequence at SEQ ID NO. 48886
cacgcacgccaccaaaccaaccggcgagatggaggccccgccgccgcgccggtggccgccgggattccgcttcagccccaccgacgaggaactcgtcctctacttcctcaagcgccggatcgtctctggccgcccctccccctatgtcgccgacatcgacgtctacaagtcccacccctcccacctccctgagaggtcggcgctgcagacgggggacaggcagtggttcttcttcagccggatggaccgcaagtaccccaacggctcgcgcgccagccgcaccactggcgacggctactggaaggccacggggaaggaccgcttcatctgcggcggcggccgagcggtggggaacaagaagacgctcgtgtaccaccatggccgggcccctcgcggggagcgcacggactgggtcatgcacgagtacaccctgctcgccgacgcgctcccgcctgccgcgcaggggagggagtcctacgcgctctacaagctgttccagaagagcggggccgggcccaagaacggcgagcagtacggcgcaccctttcgggaggaggattggttggatgacgatgtggagggagtgactgcgggtcctcctcctaatcccgttcctaacaacaataattgtcctgctaccgtggaggagcacgcaattgctgaccgtgaacttccgattgaggatcttgacgag

SEQ ID NO: 48886 - protein, 221 aa, Panicum virgatum
  misc_feature: Ceres CLONE 2046324
  misc_feature (9)..(136): Pfam Name: NAM Pfam Description: No apical meristem (NAM) protein
  misc_feature: The sequence is a functional homolog of SEQ ID NO 2168 in the 10/374,780 US patent application
  misc_feature: The sequence is a functional homolog of SEQ ID NO 370 in the 10/666,642 US patent application
  misc_feature: The sequence is a functional homolog of SEQ ID NO 240 in the 10/225,068 US patent application
  misc_feature: The sequence is a functional homolog of SEQ ID NO 368 in the 10/374,780 US patent application
  misc_feature: The sequence is a functional homolog of SEQ ID NO 162 in the 10/225,068 US patent application
  misc_feature: The sequence is a functional homolog of SEQ ID NO 2414 in the 10/374,780 US patent application
  misc_feature: The sequence is a functional homolog of SEQ ID NO 428 in the 11/435,388 US patent application
  misc_feature: The sequence is a functional homolog of SEQ ID NO 508 in the 10/412,699 US patent application
  misc_feature: The sequence is a functional homolog of SEQ ID NO 728 in the 10/225,066 US patent application
  misc_feature: The sequence is a functional homolog of SEQ ID NO 1816 in the 11/479,226 US patent application
  misc_feature: The sequence is a functional homolog of SEQ ID NO 2112 in the 10/374,780 US patent application
  misc_feature: Functional homolog of the protein sequence given in SEQ ID NO 51020
  misc_feature: Useful for making plants with altered alkaloid content
  misc_feature: The sequence is a functional homolog of SEQ ID NO 582 in the 10/666,642 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
MEAPPPRRWPPGFRFSPTDEELVLYFLKRRIVSGRPSPYVADIDVYKSHPSHLPERSALQTGDRQWFFFSRMDRKYPNGSRASRTTGDGYWKATGKDRFICGGGRAVGNKKTLVYHHGRAPRGERTDWVMHEYTLLADALPPAAQGRESYALYKLFQKSGAGPKNGEQYGAPFREEDWLDDDVEGVTAGPPPNPVPNNNNCPATVEEHAIADRELPIEDLD

SEQ ID NO: 48887 - DNA, 664 bp, Panicum virgatum
  misc_feature: Ceres CLONE 2046331
  misc_feature: Encodes the peptide sequence at SEQ ID NO. 48888
ggtcaacctccccaccccatggccggcacccgccaccacgccgacgaaagtcatagcatactcctctcccgcagcagcctccaccctccgcctcgccgttaaataatctctctcgctccgctcccgcactgaccccgcatcgccctttgcctctgtttatttaaatactcctagcgttggccgccgcggcagtggcagtgggagggaggaccacgtcgggcgccggaggagcagcgaggagtcgagtgcgcggcgaggtcgctgtggtggtggtggtcgtgcgtcggcggtaggcggtggttctcggctgcggagatggagagcacgctcaaggggatacggggctgcgacgcgcccggcgtgctggacatggacgacgcggccaccgtgggcggcggcgtcggggacacctacggcgaggactgcgccaccgaggaccagctcgtcacgccctggaccgtctccgtcgccagtggttacaatttgatgagggacccccgctacaacaagggcctcgccttcacagagagggagcgcgagacacactacctccgtggccttctgccaccagctatagtatcccaagagcttcaggagagaaagatcatgaataatatcagacaataccaggtgcctttgcagcgttacatggctatgatggacc

SEQ ID NO: 48888 - protein, 116 aa, Panicum virgatum
  misc_feature: Ceres CLONE 2046331
  misc_feature: SWISSPROT Homolog: EC 1.1.1.40 Malate dehydrogenase (oxaloacetate-decarboxylating) (NADP(+))
MESTLKGIRGCDAPGVLDMDDAATVGGGVGDTYGEDCATEDQLVTPWTVSVASGYNLMRDPRYNKGLAFTERERETHYLRGLLPPAIVSQELQERKIMNNIRQYQVPLQRYMAMMD

SEQ ID NO: 48889 - DNA, 685 bp, Panicum virgatum
  misc_feature: Ceres CLONE 2046337
  misc_feature: Encodes the peptide sequence at SEQ ID NO. 48890
cccggttccaccacccgggggactcgccacttccattcccccctccctctcgccgcgcgagttcccccacccacccccacccccaccaacccgatggagcgtgcacgccgcctcgcaagccgcgcgctgctgcgccgcctgctggcggcggccggctccaccacgtccccggtcccgtcccgcggcatctccaccctggcgcccgcgccggaggggaagcagcgcccgcgcgcgcggggcgcgcaccagcacgcgcaggaccgccaggtgtcggcgtcggcgctgaagccgagcgacaccttcccgcggaggcacaactccgccacgcccaccgagcaggccgccatggcgtccgcctgcgggttcaccaccgttgacgcgcttatcgacgccaccgtcccggccgccatccgcgcgccgccgatgcacttcgccggcaagttcgaccaggggttcaccgagtccgagatgatcggccacatgcagcgcctcgcgtccatgaacaaggcctacaagtccttcatcgggatgggctactacaacacccatgtcccgggggtgatactgcgcaacctcatggagaaccccgcctggtacacccagtgcacgccgtaccaggccgagatcgcgcagggccgcctcgagtccctgctcaacttccagaccatggtcgcggacctcaccg

SEQ ID NO: 48890 - protein, 197 aa, Panicum virgatum
  misc_feature: Ceres CLONE 2046337
  misc_feature (72)..(197): Pfam Name: GDC-P Pfam Description: Glycine cleavage system P-protein
  misc_feature: SWISSPROT Homolog: EC 1.4.4.2 Glycine dehydrogenase (decarboxylating)
MERARRLASRALLRRLLAAAGSTTSPVPSRGISTLAPAPEGKQRPRARGAHQHAQDRQVSASALKPSDTFPRRHNSATPTEQAAMASACGFTTVDALIDATVPAAIRAPPMHFAGKFDQGFTESEMIGHMQRLASMNKAYKSFIGMGYYNTHVPGVILRNLMENPAWYTQCTPYQAEIAQGRLESLLNFQTMVADLT

SEQ ID NO: 48891 - DNA, 711 bp, Panicum virgatum
  misc_feature: Ceres CLONE 2046355
  misc_feature: Encodes the peptide sequence at SEQ ID NO. 48892
ctcactcgtgttcttcttcctccgagcttcttcatccaccagcaatggagagtcaacgcagcagcagcggtagagaagaaaccctcaacggtagtcctcacctcaaagccccactcaacacgctccatgtcgaccgctgcacccccgcgcaccgcgtgcacgcgctcctctacgccggcgccatcctcggcctggtgtgccaccggctgacctccattctagcctcctcctcgctcgccgagggatggatgctgctggcggagctcgtcctggccttcatgtagggctgctcgcgggcgttcaagtggcagccggtgcgtcgccgggagttcccagacagattgccggagggtggcgcctggccgaagctcgacgtgttcgtgtgcacggctgatccgaggaaggagcccccggtcggggttgtgagcacagccctctcggccatggccttcgagtaccccgcgggcaagctgtcggtgtatgtttccgacgacggcggcgcggatgtgacgctgttcgcgttcatggagggcgccaggttcgcgcggcactggctgccattttgcagggagaatggcgtgcaggtgcggtcgccggaggtgttctttgcttcttcttcttcttcttcttcttcttcttcttcttcttctggatgttctgccggtggcggcgatgcggataagctgaaggtgatgttccaaaacatggtac

SEQ ID NO: 48892 - protein, 89 aa, Panicum virgatum
  misc_feature: Ceres CLONE 2046355
  misc_feature: SWISSPROT Homolog: EC 2.4.1.12 Cellulose synthase (UDP-forming)
  misc_feature: Functional homolog of the protein sequence given in SEQ ID NO 51757
  misc_feature: Useful for making plants with altered cell wall content and/or composition
MAFEYPAGKLSVYVSDDGGADVTLFAFMEGARFARHWLPFCRENGVQVRSPEVFFASSSSSSSSSSSSSGCSAGGGDADKLKVMFQNMV

SEQ ID NO: 48893 - DNA, 682 bp, Panicum virgatum
  misc_feature: Ceres CLONE 2046367
  misc_feature: Encodes the peptide sequence at SEQ ID NO. 48894
atactcaccaaacacgagctctctccccagcggctctgctgaatgaagatggtttcgttatgccatcctgttcgaatcagaacatgcgggaaatttgcgacgaggaatgcagcagccaaggtcttgtgctccatggagacgccaccgtcccagagcacaatcaaggtactgtactctgctgttgcctgtgttcttgggaaacccaacttctctgtcaccgttagcttccttctgagggcaaagcctgccgcctgccggtgctattatgtccaggttgttatcatcggggccacaaaggaaattgggaggacggcgattgttgcagtcagtaaagccaggggcatggagcttgcaggggcaatcgattcccagggcattggagaggacgcgggacagattagtggcatggaggagccgttggaaattccggtgctcaatgatctcacaatggttctgggctccatagcacaatcgagagcaactggcgtggttgttgatttcagtgaaccttcaactgtttatgacaatgtcaagcaggtatgtcgatgtccacctacaacaaggaaaatgatatgtaagctgcatcaaattgctaggtacttaatcccaaagctaaataaatactgctatgcaaatcgaatggtttcatatgcatccaaaagtcccagggtggatttaagca

SEQ ID NO: 48894 - protein, 213 aa, Panicum virgatum
  misc_feature: Ceres CLONE 2046367
  misc_feature (76)..(186): Pfam Name: DapB_N Pfam Description: Dihydrodipicolinate reductase, N-terminus
  misc_feature: SWISSPROT Homolog: EC 1.3.1.26 Dihydrodipicolinate reductase
MKMVSLCHPVRIRTCGKFATRNAAAKVLCSMETPPSQSTIKVLYSAVACVLGKPNFSVTVSFLLRAKPAACRCYYVQVVIIGATKEIGRTAIVAVSKARGMELAGAIDSQGIGEDAGQISGMEEPLEIPVLNDLTMVLGSIAQSRATGVVVDFSEPSTVYDNVKQVCRCPPTTRKMICKLHQIARYLIPKLNKYCYANRMVSYASKSPRVDLS

SEQ ID NO: 48895 - DNA, 585 bp, Panicum virgatum
  misc_feature: Ceres CLONE 2046369
  misc_feature: Encodes the peptide sequence at SEQ ID NO. 48896
acccaaccccggcgcgtgccccccgcctcgccgcgcgccgattcgaccgccgctctcgctccctcccccactctctctttcttctcgccgcgtacacgcgcgccccaccccgctcgcgccacctaccctccacggcctcccccccgatcccgagccgccaccaggtaggcgccctcccccgcggggcggccgggctcgcgccgatggcggcgtccctcgccgccgccgcctcctcctccgcgcgcttcgtcgccggcggcgaggtctcgccggcgcgtccccgggcgcgcgtcccctgcgtcgccgggcggcgccggcgccccgccgcgggcgtgcgctgcggaggggccagggcgcccggcggcggggttttgccggaggcggaggaagggggccggttcgtgaggtggttccgggaggcgtggccgtacatccgtggccaccgagggagcaccttcgtcgtcgtcgtctcgtgggaggtcgtcgccggaccccacctcgacggcattctgcaggatatatcccttcttcatggtcttgggatcaaatttgttcttgatcctggaacacatggccagattgata

SEQ ID NO: 48896 - protein, 127 aa, Panicum virgatum
  misc_feature: Ceres CLONE 2046369
  misc_feature: SWISSPROT Homolog: EC 2.3.1.1 Amino-acid N-acetyltransferase
MAASLAAAASSSARFVAGGEVSPARPRARVPCVAGRRRRPAAGVRCGGARAPGGGVLPEAEEGGRFVRWFREAWPYIRGHRGSTFVVVVSWEVVAGPHLDGILQDISLLHGLGIKFVLDPGTHGQID

SEQ ID NO: 48897 - DNA, 710 bp, Panicum virgatum
  misc_feature: Ceres CLONE 2046370
  misc_feature: Encodes the peptide sequence at SEQ ID NO. 48898
gatcaatccatacacaacactcatctcttcaggtgcatccacagctgcttgacagagctagagagataactaagcttgagagatagagagagatcaagagagagaaagagagagttcctgcagccaagaaattaaaccaatcaagcatagcaaatggctgaccgtgtgatgaagctggcgtcggagcgcgcggtggtggtgttcacgctgagttcctgctgcatgtgccacacggtgacgaagctgatgcaggacctgagcgtaaacgcgctggtgcacgagctggacagcgaccccaggggcaaggagatggagtgcgcgctgctcaagatgctcggcggtaggggccctgccgtccccgccgtctttatcggcggcaagctcgtcggcggcaccaacagggtcatgtcccttcacctcggcggcgagctggtgcccatgctcatgagcgccggcgcgctctggctgtagagacatgcatagtcacgtacgtgcgagcatggccatggatacgctagcaggaaaaataaagaggtcgtggtccaagagtaccaagggtcgttactagtgtgtgtgtcgagggcaggtttttcccgtcctgttcttccgagttctgacaggaataactagggcaaactagctgcttagcttcgtgccttgtagctaggagcttgtgagcgagagagagatgggccttcttgatgttttgt

SEQ ID NO: 48898 - protein, 105 aa, Panicum virgatum
  misc_feature: Ceres CLONE 2046370
  misc_feature (14)..(78): Pfam Name: Glutaredoxin Pfam Description: Glutaredoxin
  misc_feature: Functional homolog of the protein sequence given in SEQ ID NO 51226
  misc_feature: Useful for making plants with altered protein content
MADRVMKLASERAVVVFTLSSCCMCHTVTKLMQDLSVNALVHELDSDPRGKEMECALLKMLGGRGPAVPAVFIGGKLVGGTNRVMSLHLGGELVPMLMSAGALWL

SEQ ID NO: 48899 - DNA, 703 bp, Panicum virgatum
  misc_feature: Ceres CLONE 2046377
  misc_feature: Encodes the peptide sequence at SEQ ID NO. 48900
atcaggagcgtactttgcacaacatggggaaaagtggaagcatgctagcagctcagtgaataaccggcgaggcaaaaagaaccttgtcttatcctcatggggtgatgagtcaactctttctgaaggctatgttaaccctcattatgtttctgattactataagtcatacagtgagagaaccaaccaaaatctaaaacggttgaacgaagatgtgattgattttgatctgttggaagacttgatatgctttattgatgagaactgccctcctggtgctcttctagtttttcttcctggagttgcagagattgacatgttgattgatagattatctgcttcagttagatttggaggggcatcatctgattggatccttcccttacattcactacttggaccctctgatcaaagaaaagtgttccagtctccaccagataaattccgcaaggttattgttgccacagacatagcagagaccagcattacaattgatgatgtaatatatgtagttgacactggaaagcacaagcagaaccgttttaacccacggaagaaaatgtcaagcatagtagaagattggatttctcgtgcaaatgcaaagcagagacgcggaagggctggtcgtgtgaagcctggtttatgtttctgtttgtataccaggcatcgatttgaaaacattatgcgtccatttcaggtgcctgag

SEQ ID NO: 48900 - protein, 233 aa, Panicum virgatum
  misc_feature: Ceres CLONE 2046377
  misc_feature (119)..(210): Pfam Name: Helicase_C Pfam Description: Helicase conserved C-terminal domain
  misc_feature: SWISSPROT Homolog: EC 3.6.1.15 Nucleoside-triphosphatase
SGAYFAQHGEKWKHASSSVNNRRGKKNLVLSSWGDESTLSEGYVNPHYVSDYYKSYSERTNQNLKRLNEDVIDFDLLEDLICFIDENCPPGALLVFLPGVAEIDMLIDRLSASVRFGGASSDWILPLHSLLGPSDQRKVFQSPPDKFRKVIVATDIAETSITIDDVIYVVDTGKHKQNRFNPRKKMSSIVEDWISRANAKQRRGRAGRVKPGLCFCLYTRHRFENIMRPFQVP

SEQ ID NO: 48901 - DNA, 696 bp, Panicum virgatum
  misc_feature: Ceres CLONE 2046399
  misc_feature: Encodes the peptide sequence at SEQ ID NO. 48902
agcagctagctgcccccattccagctccagcagccagatgcgctcccccgtgagagccctaccgccgccacccgcagcgctcctcccccggcccgtgcccgccgccgggtagcccgatccgacggcccccgccgcccccatgggccgcggccccgccgccgcgctgccgccgtggcacgctctcccggacgaggtctgggagcatgccttctccttcctccccgcggactcggaccggggcgccgccgcggccgcctgccgctcctggcttcgcgccgagcgccgctcgcgccgccgcctcgccgtcgccaactgctacgctgcatccccgcaagacgccgtcgaccggttccggtccgtacgcgccgtcgaggtcaagggcaagcctcacttcgcggacttcgggctggtgccgcctggctggggcgctgccgccgcgccatgggtcgccgccgcagccgacgggtggccgcttctcgaggagttcagcttcaagcgcatggtcgtcaccgacgactgcctcgagatgatcgcggcctccttcaggaacttccaggtgctgcgcctcgtatcctgcgagggcttcagcaccgccggtctcgctgccattgccgccggctgcaggaatctaaaagaacttgacctgcaggagaatgagattgaggattgctctattaattggctcagtctctttcc

SEQ ID NO: 48902 - protein, 185 aa, Panicum virgatum
  misc_feature: Ceres CLONE 2046399
  misc_feature: Functional homolog of the protein sequence given in SEQ ID NO 50502
  misc_feature: Useful for making plants with altered carbohydrate content
MGRGPAAALPPWHALPDEVWEHAFSFLPADSDRGAAAAACRSWLRAERRSRRRLAVANCYAASPQDAVDRFRSVRAVEVKGKPHFADFGLVPPGWGAAAAPWVAAAADGWPLLEEFSFKRMVVTDDCLEMIAASFRNFQVLRLVSCEGFSTAGLAAIAAGCRNLKELDLQENEIEDCSINWLSLF

SEQ ID NO: 48903 - DNA, 674 bp, Panicum virgatum
  misc_feature: Ceres CLONE 2046416
  misc_feature: Encodes the peptide sequence at SEQ ID NO. 48904
ccagcataacatccttctctttctcctcccccataacatccttctcccaactctcaacctagtactcgccctcgcttcgcgcttcttcttgagctcttgcgagccgctgatcatcctgcgctcggcactggaactggaagctgtttgaataacagctccaaggttcaaaggaaccttcgtttgttgtaagatgtatagggcaaagagagctgcactgtcaccaaaggtaaagcgccgtgttgggaagtatgagctcggacgcaccattggggtgggaaccttcgcaaaggtccggtttgcaaagaacactgaaaatggggagcctgttgctatcaaaattcttgacaaggagaaggttcagaggcacagattggttgaacaggaacaacgtggataatgaattttcttccttggacgttgccgtgtcagcatgggatcataggaagatgaaactccaattaagaaacgatttcatatctacatatttgcatgccatcaagatatatccacatggtgatcttccagttgaagtcatactaccaactcaattaagcgtgaaatttgcactatgaagttagtcaagcatcctaatgttgttcgactgtttgaggtgatgggaagtaaagcaagaattttcattgttatggaatatgttactggcggagagctttttg

SEQ ID NO: 48904 - protein, 68 aa, Panicum virgatum
  misc_feature: Ceres CLONE 2046416
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
MYRAKRAALSPKVKRRVGKYELGRTIGVGTFAKVRFAKNTENGEPVAIKILDKEKVQRHRLVEQEQRG

SEQ ID NO: 48905 - DNA, 695 bp, Panicum virgatum
  misc_feature: Ceres CLONE 2046426
  misc_feature: Encodes the peptide sequence at SEQ ID NO. 48906
gaaagctcggagcatcacgatggcaagacacattcagcttgtcttcttctctgcagcatggtggctgcttctgtgggcacaatgtgtgagcaccctgcggttcacaaggggtgatttcccggatggctttgcgtttggagctgcaacttcagcctatcagtatgagggtgcagcagctgagggcgggaggagtccaagcgtctgggacacctacacccattcaggtctttctcggatatttcttataggaattactctcatcaactatagctaaagtccgataacccctaaactatcgtttggttcattttactcccaaactataccctttggttcaaattaccccctaattcaatttattttttatttctccatgcataggtggagttttaagttaaaattttacaaaatgataatacacatcataacacattttagaaaaaaaatatatcattattttgatagcttaggattagctcaaaattttttttgaaaaatattgatgaaaaaattataacaatttattttaatatgcattgtgatgtcgaatactagcttgcagaatttaaaattaaaattcaacttatgtatggagaaataaaggataaattgtattatggggtaaaattaactaaatagcatagtttaggggataaactaaagactgaagttatagttagggattattgagactt

SEQ ID NO: 48906 - protein, 84 aa, Panicum virgatum
  misc_feature: Ceres CLONE 2046426
  misc_feature: SWISSPROT Homolog: EC 3.2.1.21 Beta-glucosidase
  misc_feature: Functional homolog of the protein sequence given in SEQ ID NO 51758
  misc_feature: Useful for making plants with altered cell wall content and/or composition
MARHIQLVFFSAAWWLLLWAQCVSTLRFTRGDFPDGFAFGAATSAYQYEGAAAEGGRSPSVWDTYTHSGLSRIFLIGITLINYS

SEQ ID NO: 48907 - DNA, 654 bp, Panicum virgatum
  misc_feature: Ceres CLONE 2046431
  misc_feature: Encodes the peptide sequence at SEQ ID NO. 48908
agtcatctcccagccaagccagccaccctctcaaggcacaccaatccagtgcacgtcgatcgatctatggcgacctgcggcagccctgtgctcgccctggcctcgcaacaagagggccttcttcagcgcaagccccggccttacaccccaagcatctggggcgacttcttcctcaaacaccagccatgcaccccatcgcagcttctgtccatgaaggagagtgcacggatcaagcaggaggatgtgaggcacatcatactggagaccactgcctcttgcgagctggttctcaagctggagcttgtcgacacgctgcaaaggatcggagtggactaccactacaggaaggagatcgatgagttgctgcgtgatattcacggctccaagcatgaagaagaaggctgcgatgatgagctatatcttgtatcattgcggttctatttgctcagaaagcatgggtacaatgtctcttctgatgtgtttgtgaagtttagagataaccaaggaaactttacaagtaatgatgtcaaatgtctgttggcgctgtatgacgctgcacatctcagaacttgcggtgaagagattcttgacaatgccatggctttcaccaagagccaccttcagtctatgattaaaactttagatcccagagct

SEQ ID NO: 48908 - protein, 195 aa, Panicum virgatum
  misc_feature: Ceres CLONE 2046431
  misc_feature (31)..(194): Pfam Name: Terpene_synth Pfam Description: Terpene synthase, N-terminal domain
  misc_feature: SWISSPROT Homolog: EC 4.2.3.13 (+)-delta-cadinene synthase
MATCGSPVLALASQQEGLLQRKPRPYTPSIWGDFFLKHQPCTPSQLLSMKESARIKQEDVRHIILETTASCELVLKLELVDTLQRIGVDYHYRKEIDELLRDIHGSKHEEEGCDDELYLVSLRFYLLRKHGYNVSSDVFVKFRDNQGNFTSNDVKCLLALYDAAHLRTCGEEILDNAMAFTKSHLQSMIKTLDPR

SEQ ID NO: 48909 - DNA, 690 bp, Panicum virgatum
  misc_feature: Ceres CLONE 2046443
  misc_feature: Encodes the peptide sequence at SEQ ID NO. 48910
gttcgtctctcattttccgcgctcgcgcgctcccgccacacgcaccccccaaccttcctcgcttctccagactccagcctcgccaaggcttcctgatcaggttgggagcgcaggagaggagcttggaaggatggcgtcggtttccagggctgtctgcggcgtgcagatgccgtgcttgaacggcagggaggcgcccgccggccgccgatcggtcgcggcgccgaaggcccggaacgccaagcggggcgtcatccgctccgtgtcggtctccggctccggctccggctccggctccggccgcggccagcattgcgcgcctgccaacgccgtcgccgacgccgcgccaattacagcgacaaagagggtgttccccttcggcaagggcaagagcgagggcaacaggggcatgaaggatctgctgggcgggaagggcgcgaacctggcggagatgtcgagcatcgggctgtcggtgccgccggggttcacggtgtcgacggaggcgtgccagcagtaccaggaggccgggcgcgcgctgccggcggggctctgggcggagatcctcgacggcctggcgtgggtggaggagtacatgggcgcgcgcctcggcgacccgcagcgcccgctcctgctctccgtccgctccggcgccgcggtgtcgatgcccggcatgatggacacggtgctcaacct

SEQ ID NO: 48910 - protein, 186 aa, Panicum virgatum
  misc_feature: Ceres CLONE 2046443
  misc_feature: SWISSPROT Homolog: EC 2.7.9.1 Pyruvate, phosphate dikinase
MASVSRAVCGVQMPCLNGREAPAGRRSVAAPKARNAKRGVIRSVSVSGSGSGSGSGRGQHCAPANAVADAAPITATKRVFPFGKGKSEGNRGMKDLLGGKGANLAEMSSIGLSVPPGFTVSTEACQQYQEAGRALPAGLWAEILDGLAWVEEYMGARLGDPQRPLLLSVRSGAAVSMPGMMDTVLN

SEQ ID NO: 48911 - DNA, 697 bp, Panicum virgatum
  misc_feature: Ceres CLONE 2046444
  misc_feature: Encodes the peptide sequence at SEQ ID NO. 48912
tattgagcatcgaggaacaaaagaatttagtctaaaataccaaaaagaagtagatcggttttttttcattcttcaagaactgcatctcttgccgagatcctcatccctaaaggtacttgataatagtattattggagtcgatacacaactcacaaaaaatacaagaagtagactaggtggattggtccgagtgaagagaaaaaaaagccatacagaactcaaaatcttttccggagatattcattttcctgaagaggcggataagatattaggtggcagtttgataccaccagaaagagaaaaaaaagattataaggaatcaaaaaaaaggaaaaattgggtttatgttcaacgaaaaaaaattctcaaaagcaaggaaaagtattttgttttggttcgacctgcagtcgcatatcaaatggacgaagggagaaatttagcaacacttttcccgcaggatctcctgcaagaagaggataatctccaacttcgacttgtcaattttatttctcatgaaaatagcaagttaactcaaagaatttatcacacgaatagtcaattcgttcgaacttgcttagtagtgaattgggaacaagaagaaaaagagggggctcgtgcttctcttgttgaggtaagaacaaatgatctgattcgcgatttcctaagaattgagttagttaagtctactacttcgtat

SEQ ID NO: 48912 - protein, 231 aa, Panicum virgatum
  misc_feature: Ceres CLONE 2046444
  misc_feature: SWISSPROT Homolog: EC 2.7.7.6 DNA-directed RNA polymerase
IEHRGTKEFSLKYQKEVDRFFFILQELHLLPRSSSLKVLDNSIIGVDTQLTKNTRSRLGGLVRVKRKKSHTELKIFSGDIHFPEEADKILGGSLIPPEREKKDYKESKKRKNWVYVQRKKILKSKEKYFVLVRPAVAYQMDEGRNLATLFPQDLLQEEDNLQLRLVNFISHENSKLTQRIYHTNSQFVRTCLVVNWEQEEKEGARASLVEVRTNDLIRDFLRIELVKSTTS

SEQ ID NO: 48913 - DNA, 615 bp, Panicum virgatum
  misc_feature: Ceres CLONE 2046458
  misc_feature: Encodes the peptide sequence at SEQ ID NO. 48914
atcaccactctcagcaaaagcactcatacgtccactgcaggtagcataaaaatgttgtgccggagaacatatatgctccctgtaggaactctcatcagctcctcatcactctcattgatcattgtcctcgcgtttcttttgacactcgctgcaccttcattatgtgcaacacctcttcgtcgtgaacctaacgatgacttggaagcactccattgccttaaacaccatctctcaagtaaccctgccggactcctaccttcatggaagaatggttccacccaattctgcaattggtccggtgttacatgtagcaagacacactcgtctcgtgttgtagcactggaccttgagtcactcgggctccatggccaaatacctccttgcattgccaatctctcttttctcacaaggatccacttgccaaataatcaactgcacggtcaaatcccagctgaacttcgccaactacataggttaaggtaccttaacctcagctacaacaattttagcagtatgatcccagagactctatcatcttgttttggccttcgtaccattgatcttgcaggtaattccatcagcggaagtatcccagaagggttggggaccctccgc

SEQ ID NO: 48914 - protein, 180 aa, Panicum virgatum
  misc_feature: Ceres CLONE 2046458
  misc_feature (39)..(80): Pfam Name: LRRNT_2 Pfam Description: Leucine rich repeat N-terminal domain
  misc_feature: SWISSPROT Homolog: EC 2.7.11.1 Non-specific serine/threonine protein kinase
MLPVGTLISSSSLSLIIVLAFLLTLAAPSLCATPLRREPNDDLEALHCLKHHLSSNPAGLLPSWKNGSTQFCNWSGVTCSKTHSSRVVALDLESLGLHGQIPPCIANLSFLTRIHLPNNQLHGQIPAELRQLHRLRYLNLSYNNFSSMIPETLSSCFGLRTIDLAGNSISGSIPEGLGTL

SEQ ID NO: 48915 - DNA, 722 bp, Panicum virgatum
  misc_feature: Ceres CLONE 2046470
  misc_feature: Encodes the peptide sequence at SEQ ID NO. 48916
agatgaagatgcaggtgaagggaacaactatggagtggcacaggagtgccttgaccgccttgccattgccattggtggaaacgcaattgtgccaattgcatctgagctgcttccacagtacctgtctgctcctgagtggcaaaagcatcatgctgcgctcataacacttgcacagattgcagaaggatgtgcaaaggttatgcttaaaaatttggaacaagttgtttcgatgatattgaatggattccaacatcctcacccgcgtgtgagatgggctgcaatcaatgcgattggccagctctctacggatttggggccagacttgcaagttcattaccaccagaaggtgctgcctgcattggcgaatgctatggatgatttccagaacccacgagttcaggcacatgccgcatcggccatcctgaacttcagcgagaactgtacgccagaaattttgacaccttacctggatggaattgttaacaaattacttgttcttcttcagaatggcaagcaaatggtgcaagagggagcattgacagctctagcttcagtagcggattcatcacaggagcactttaagaaatactatgatgctgtaatgccatacctaaaagctattttgatgaatgcaactgacaagtctaataggatgctccggggcaagtccatggagtgtattagtttggtaggaatggctgtggggtaagacaagttcagag

SEQ ID NO: 48916 - protein, 235 aa, Panicum virgatum
  misc_feature: Ceres CLONE 2046470
  misc_feature (68)..(104): Pfam Name: HEAT Pfam Description: HEAT repeat
DEDAGEGNNYGVAQECLDRLAIAIGGNAIVPIASELLPQYLSAPEWQKHHAALITLAQIAEGCAKVMLKNLEQVVSMILNGFQHPHPRVRWAAINAIGQLSTDLGPDLQVHYHQKVLPALANAMDDFQNPRVQAHAASAILNFSENCTPEILTPYLDGIVNKLLVLLQNGKQMVQEGALTALASVADSSQEHFKKYYDAVMPYLKAILMNATDKSNRMLRGKSMECISLVGMAVG

SEQ ID NO: 48917 - DNA, 706 bp, Panicum virgatum
  misc_feature: Ceres CLONE 2046471
  misc_feature: Encodes the peptide sequence at SEQ ID NO. 48918
  misc_feature (607)..(607): n is a, c, t, g, unknown, or other
gccttccccactaccgcggcaggcagctaccgcatccgtccggtcttctcctccgcctcagagggctcgcccgactcgccggcgcagggtcgaggcgctcccgccggcgcccgctccacggcccctccctgggagacggacctcggcgcgggcttgtagataggggactgggatcttcttttgatagttcagtatggaggggtctctagttcagtctgcgattgtcccgactgtttacagaagcaactctggtcggttccgtgtgcgtgcaagggccagaacaaatgccacaatggtgcggaatatgccgacaaggacccttactcttggcagcttccaagggctgcgtcaaacaaactttttggacacgaggtccgtggtaaagcgtgactttggcgctatcgtggcaagccagattgccaggcccagaggatcggcgacaagaggggtggtttgtgccatgttcgagcgcttcactgaaaaagcaatcaaggtgattatgcttgcgcaggaggaggcaaggcgtctgggccacaactttgttgggacggagcagattttgctggggcttattggtgagggcaccggaattgctgctaaggttctncagtctacgggaatcaatcttaaggatgcccgagtggaagttgagaagatcattgggcgaggaagtgggtttgtggctgttgaaatcccattcacgcct

SEQ ID NO: 48918 - protein, 170 aa, Panicum virgatum
  misc_feature: Ceres CLONE 2046471
  misc_feature (105)..(157): Pfam Name: Clp_N Pfam Description: Clp amino terminal domain
MEGSLVQSAIVPTVYRSNSGRFRVRARARTNATMVRNMPTRTLTLGSFQGLRQTNFLDTRSVVKRDFGAIVASQIARPRGSATRGVVCAMFERFTEKAIKVIMLAQEEARRLGHNFVGTEQILLGLIGEGTGIAAKVLQSTGINLKDARVEVEKIIGRGSGFVAVEIPFT

SEQ ID NO: 48919 - DNA, 712 bp, Panicum virgatum
  misc_feature: Ceres CLONE 2046474
  misc_feature: Encodes the peptide sequence at SEQ ID NO. 48920
accgtcccaaaactccccaccctgccagcatcccacctcgaaccccgctcggtaaccaccgcgcaggcaggcaggcagacagacaggcaggcagccaccaccatgggagaggggaagaaggccgccgccaaggacggcgccgccggcggtgacaagaagaaggagaaggacgcaggggccgcgccggcggggccggggcccatcgtgctcaaggtcgacttgcattgcgccgggtgcgcgggcaaggtccgcaaggccatcaagcgcgccccaggggtggagaccgtgacggcggacatggcggcgggcaaggtggtcgtcaccggccccgcggacgccgcggagctcaaggaccgcatcgaggccagggccaagaagcccgtgcagatcgtctccgccggcgccggcgcgcccaagaaggacaaggacaaggagaagaaggcggacggcggcggcgagaagaagccggacaaggagaagggcggcggtggcggcggagacaagaaggccgacaaggagaagggcggcggcggcgtcgacaagaaggccgagaaagacaagggcggcgacaagccgaaggaggagaagaaggccaaggaacccaaggaggagacggtgacgctcaagatccggctccactgcgacggctgcatcgaccgcatcaagcgccgcatctacaagatcaaaggtgtgaaggatgtggcgatcgacg

SEQ ID NO: 48920 - protein, 203 aa, Panicum virgatum
  misc_feature: Ceres CLONE 2046474
  misc_feature (34)..(96): Pfam Name: HMA Pfam Description: Heavy-metal-associated domain
MGEGKKAAAKDGAAGGDKKKEKDAGAAPAGPGPIVLKVDLHCAGCAGKVRKAIKRAPGVETVTADMAAGKVVVTGPADAAELKDRIEARAKKPVQIVSAGAGAPKKDKDKEKKADGGGEKKPDKEKGGGGGGDKKADKEKGGGGVDKKAEKDKGGDKPKEEKKAKEPKEETVTLKIRLHCDGCIDRIKRRIYKIKGVKDVAID

SEQ ID NO: 48921 - DNA, 525 bp, Panicum virgatum
  misc_feature: Ceres CLONE 2046495
  misc_feature: Encodes the peptide sequence at SEQ ID NO. 48922
ttccgtcgcgtcatccgcttcccccgtctgcccgctccacgatcagagagcaagatcgccatggctctccgcgcgtggtgcgtgtcgcccgccctcccccagtgacatctccctgctcttcctcgacatctggtccccgatctacctgtccagatggtgaatatctgctgcatcggtgctggctatgtcggtggcccaaccgtggccgtcattgccctcaattgcccagacattgaggtcgtcgtcgtccacatctccaagccccgcattgaggcctggaacagtgacaccctccccatctacgagcctggtctcgatgatgttgtgaagcagtgcaggggcaggaacctcttcttcagcactgatgttgagaaacacgtcgctgaggatgacatcatctttgtctcggtgaacacccccaccaagacccgtggtcttggagctggtaaggctgccgacctcacatactgggagagcgctgctcgcatgatcgctgatgtctccaagtctgacaagattgttgtt

SEQ ID NO: 48922 - protein, 123 aa, Panicum virgatum
  misc_feature: Ceres CLONE 2046495
  misc_feature (2)..(123): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Functional homolog of the protein sequence given in SEQ ID NO 50760
  misc_feature: Useful for making plants with altered carbohydrate content
  misc_feature: Functional homolog of the protein sequence given in SEQ ID NO 50761
  misc_feature: Useful for making plants with altered cell wall content and/or composition
MVNICCIGAGYVGGPTVAVIALNCPDIEVVVVHISKPRIEAWNSDTLPIYEPGLDDVVKQCRGRNLFFSTDVEKHVAEDDIIFVSVNTPTKTRGLGAGKAADLTYWESAARMIADVSKSDKIV

SEQ ID NO: 48923 - DNA, 710 bp, Panicum virgatum
  misc_feature: Ceres CLONE 2046511
  misc_feature: Encodes the peptide sequence at SEQ ID NO. 48924
gagttctcattctttcctcagctgccagatctcctctcgtgcaagtctcctgttcttccagctagcgtccatggaagaccagagccccaagcccatccgctgcaaaggtaccaccaccagggctagcccaaccagcatgtgtgctacgtatatagcattacagcctacatggctgctcgttgtttaatcatctgctgctctgctatctctaaccatcgacgacgtctccgggtcatgcgtggcgacaagcagctgcggtgtgcagagccgccggcgagccgctcgtcgtcgaggagatcgtcgtcgatccaccgaaagcgtacgagatccgcatcaaaatcgtctgcacctcgctctgccacagtgacatcaccttctggcgcggcaaggttgcgacaacttttccaagaatcttaggccacgaagcatacggggtggcggagagcgtgggggagcatgtggagggcttcgctgccggcgacacggtggtgccgacgttcatggggcagtgcgaccgctgcccgggctgcgcgtccgagcacaacaacctctgcaccacggtgccgttcgtgtttggccccgggatgcggcgcgacggcacaacccggttccgggacgcccagggaaaccccctccacgacctggtcgccgtgtccagcttcagcgagtacaccgtcgtggacgtgacccaggtcgtcaagatcgaaccc

SEQ ID NO: 48924 - protein, 69 aa, Panicum virgatum
  misc_feature: Ceres CLONE 2046511
  misc_feature: SWISSPROT Homolog: EC 1.1.1.1 Alcohol dehydrogenase
MGQCDRCPGCASEHNNLCTTVPFVFGPGMRRDGTTRFRDAQGNPLHDLVAVSSFSEYTVVDVTQVVKIE

SEQ ID NO: 48925 - DNA, 734 bp, Panicum virgatum
  misc_feature: Ceres CLONE 2046533
  misc_feature: Encodes the peptide sequence at SEQ ID NO. 48926
ctgctgcttccttgagcctgttgagctgagtttcgcaactcgatttcttgcagtgtttttccttgtttctgaggtctgcaggaaaaagaaggtcagtgttatgtgtgaaggctaggttctcgccgagcaatggatcttgagttcgggaggaggctgagatccccaaagagggactcttggaagaccaccttgctgctggcgtaccagagcttgggagtggtctatggagacctgagcatatctcctctgtacgtgtacaagagcaccttcgctgaggacatccagcactcggagacgaacgaggagatcttcggcgtgctctctttcgtgttctggaccctcaccttgatacctctcatcaagtacgtttcgattgtcctgcgagctgacgacaatggagagggaggaacatttgccctgtactctctgatttgcaggcacgcaaatgtgagccttctcccgaatcgccaaattgctgatgaggagctttccacttataaactggaatgccctcccgacataacccacaagtcccgtatcaaggtgtggcttgagaagcacaggaagctgcgcattgctctgttgattatggttatgattggcacttgtatggttatcggggacggtgttctcacgcctgctatatctgtgttctcagcagtttcaggtcttgagttctcgctgtccaaggatcaccgtgaatatgctgtcattccaatcacctgtgtcatatt

SEQ ID NO: 48926 - protein, 201 aa, Panicum virgatum
  misc_feature: Ceres CLONE 2046533
  misc_feature (22)..(201): Pfam Name: K_trans Pfam Description: K+ potassium transporter
  misc_feature: Functional homolog of the protein sequence given in SEQ ID NO 50430
  misc_feature: Useful for making plants with modulated biomass
MDLEFGRRLRSPKRDSWKTTLLLAYQSLGVVYGDLSISPLYVYKSTFAEDIQHSETNEEIFGVLSFVFWTLTLIPLIKYVSIVLRADDNGEGGTFALYSLICRHANVSLLPNRQIADEELSTYKLECPPDITHKSRIKVWLEKHRKLRIALLIMVMIGTCMVIGDGVLTPAISVFSAVSGLEFSLSKDHREYAVIPITCVI

SEQ ID NO: 48927 - DNA, 582 bp, Panicum virgatum
  misc_feature: Ceres CLONE 2046536
  misc_feature: Encodes the peptide sequence at SEQ ID NO. 48928
aatcctatacctaaaaagtgcaagaatatttgaagagatatgcgcggctgcactactttaatggcaaccacctccttcaaaccacaaaggaacttccatgttgctgctgctgctactgcatcaacgcaatgcccgagcatttcatggaggcaggggcagaagcggcgccacatcaggttgcaatgccaccagttgcaacatgatgatgccgacaaccgcctgacccgaaacaccggcattttccacccatctctttggggagatttcttcatcggctactccaacccagcagctccgcaacaacagcggatggaagaacgagcggaccaactcagggaagaagtggcggaaattatggcagcttcaagtttcagtagcttgcatgcgaggctacacatgatcgatacattggagagtctgtgcttggatcacctgtttgagcaagagatcaatgatgcattacagcaagttgtggctgccgatgtcagggattgtgatcttgggaccgttgctctttggttttgtctacttcggaaacatcgatacatggtttcaccagtgttcctgaggttcaaagatgag

SEQ ID NO: 48928 - protein, 180 aa, Panicum virgatum
  misc_feature: Ceres CLONE 2046536
  misc_feature (73)..(180): Pfam Name: Terpene_synth Pfam Description: Terpene synthase, N-terminal domain
  misc_feature: SWISSPROT Homolog: EC 4.2.3.9 Aristolochene synthase
MRGCTTLMATTSFKPQRNFHVAAAATASTQCPSISWRQGQKRRHIRLQCHQLQHDDADNRLTRNTGIFHPSLWGDFFIGYSNPAAPQQQRMEERADQLREEVAEIMAASSFSSLHARLHMIDTLESLCLDHLFEQEINDALQQVVAADVRDCDLGTVALWFCLLRKHRYMVSPVFLRFKD

SEQ ID NO: 48929 - DNA, 647 bp, Panicum virgatum
  misc_feature: Ceres CLONE 2046552
  misc_feature: Encodes the peptide sequence at SEQ ID NO. 48930
ttacttgcccatccaatcatccgtagccttttggggactcaagctgagtggatttttcatatgttacaagcattcaactctggtaacgtagcactgtatcaagaactctgcaaagctcacaacaccaccttgagtgcacagcctgcattggtccaaaatgagaggaaactgcttgaaaagatcaacatactttgcttgatggaaatcattttcagtcgatcatctgaaaaccggacgatcccactgaacgccatagcagaacggaccaggctctcagttgaagatgtggagtatctactgatgaagagcctctctgctcgtcttatagaagccataattgatcaagttgatggaaccgttcatgtttcatgggttcaaccgagggtgttaggcatagaccaagtaaaatccttgcgtgaccggttggatacctgggttgggaaggtgcatacgaccttgctttcggttgaagcagagacaccggacttgatatcttcgtgatgttcctctctttccgcagaaagggttgatgtggcatttcctgatgtgaagaccttatttatctgttcttagactgcagtttctgcagtaacgattgttgtaaccttgtttcttcactcagtgaagtgttgtttcacactgagcag

SEQ ID NO: 48930 - protein, 166 aa, Panicum virgatum
  misc_feature: Ceres CLONE 2046552
  misc_feature (16)..(124): Pfam Name: PCI Pfam Description: PCI domain
LLAHPIIRSLLGTQAEWIFHMLQAFNSGNVALYQELCKAHNTTLSAQPALVQNERKLLEKINILCLMEIIFSRSSENRTIPLNAIAERTRLSVEDVEYLLMKSLSARLIEAIIDQVDGTVHVSWVQPRVLGIDQVKSLRDRLDTWVGKVHTTLLSVEAETPDLISS

SEQ ID NO: 48931 - DNA, 690 bp, Panicum virgatum
  misc_feature: Ceres CLONE 2046571
  misc_feature: Encodes the peptide sequence at SEQ ID NO. 48932
gcaggccaaatacgcgcgtcgccatgccgccccggttccccaccacccgcctcctcctcaccaggcagctcccgctcccgcaccgcctcctcccacccccgcctctccccttctcggcccctcgagccctccgcctccctccggcgccgcagccccttccacgaggcgcgcgccgctgccgctgccgccgccccccgctgctccggggcatggcctccgccgccgcctcccccgggtcacaagccgctgccgcggaggcgccggccgccccgcggcggttcgcgctggaggagctcccctgggaccactccttcgtccgcgagctgcccggggacccgcgatccgacaccgtcccgcgggagatcctgcactcctgctactccaaggtgtctccctcggccaaggtggacggccccaagctcgtggcgtggtccgatgccgtcgccgacctcctcgatctggaccacaaagagtttgaaagacctgactttcctcagttcttttccggagcaactccactggtgggaagtttgccctacgcacagtgctatggaggacatcagtttggcgtatgggctggtcagttgggggatggaagagcgataacacttggggaggttgtaaactctcgaggtgagagatgggagttgcagctcaagggtgctggaaagactccatacagcagatttg

SEQ ID NO: 48932 - protein, 160 aa, Panicum virgatum
  misc_feature: Ceres CLONE 2046571
  misc_feature: Functional homolog of the protein sequence given in SEQ ID NO 50587
  misc_feature: Useful for making plants with modulated flowering time
MASAAASPGSQAAAAEAPAAPRRFALEELPWDHSFVRELPGDPRSDTVPREILHSCYSKVSPSAKVDGPKLVAWSDAVADLLDLDHKEFERPDFPQFFSGATPLVGSLPYAQCYGGHQFGVWAGQLGDGRAITLGEVVNSRGERWELQLKGAGKTPYSRF

SEQ ID NO: 48933 - DNA, 720 bp, Panicum virgatum
  misc_feature: Ceres CLONE 2046597
  misc_feature: Encodes the peptide sequence at SEQ ID NO. 48934
acgcatcttcaggtatctgaaattcatccctgaatttggtctttggtactctgcggactcttctctggttctggtgggcttttctgatgccgatttcggtgggtgtcggttggatcgcaagtcgacatccggcacttgccaatttctcggtacatcgttggtgtcttggtcctctcgcaagcaggctagcgtagcgctttcttccacagaagctgagtatgttgccactgctagctgttgctcccagatactttgaatgaaacaaaccttgcaggattatggattgagttttggtagggttcccatctttgtagacaacatgtccgctattagcattgcaaagaaccctgtcctacactctagaaccaaacacatagatatccgattccatttcctgcgagataaccatgagagaggacacatagacttgattcatgtcccttcagagaggcaaaccgcagatatcctaaccaaaccgctagagcatgacacctttgctcgcttgcgatgggagcttggggtttgttaccccttttgatcgctgacttttctttggttagctttgcaggtcttgcttgctcttctttttgtcttctaggtttggtagttgcattgtgcatatgcattgtacatgtttgcattttgcattgtctcacttgcactagcattcttgtatacattgctatgatcttctagtgcctgctagtgtgagttgataaa

SEQ ID NO: 48934 - protein, 84 aa, Panicum virgatum
  misc_feature: Ceres CLONE 2046597
  misc_feature: SWISSPROT Homolog: EC 2.7.7.49 RNA-directed DNA polymerase
RIFRYLKFIPEFGLWYSADSSLVLVGFSDADFGGCRLDRKSTSGTCQFLGTSLVSWSSRKQASVALSSTEAEYVATASCCSQIL

SEQ ID NO: 48935 - DNA, 538 bp, Panicum virgatum
  misc_feature: Ceres CLONE 2046614
  misc_feature: Encodes the peptide sequence at SEQ ID NO. 48936
gtcgcggagcgccaccaccaccaccaccaccacgcctcgccgccgccggcgagcggtgaaggctagggttagctcggggtgatggcggccgcgccgcccgccgccagctcgaccgccttctaaggcggcgattatccgaggctgagctcgtgcgcgcgcgtgggggggatccccgtgcacagctcgcgaaaccctacggggccagcaggaggcgaggcggcttggtggagcgggcggcgatggacgtggacgcgcgcatggcgacggagtcggactcagactccgacgcgcggagcggcggcggcggcggcgggtcagggtccgggagcgagaccccctcggtgtccccttcggcgcccgggacgcccccggccgctgccgcggcagcttcaccggggccggtggcggggcccaagccggcgccggggtacacggtggtggacgcggcaatggacaagaaggaggacgggccggggtgccggtgcgggcacacgctcacggtggtgccggctgtcagggaggagggctcgccggggta

SEQ ID NO: 48936 - protein, 99 aa, Panicum virgatum
  misc_feature: Ceres CLONE 2046614
  misc_feature: SWISSPROT Homolog: EC 3.1.3.16 Phosphoprotein phosphatase
MDVDARMATESDSDSDARSGGGGGGSGSGSETPSVSPSAPGTPPAAAAAASPGPVAGPKPAPGYTVVDAAMDKKEDGPGCRCGHTLTVVPAVREEGSPG

SEQ ID NO: 48937 - DNA, 519 bp, Panicum virgatum
  misc_feature: Ceres CLONE 2046665
  misc_feature: Encodes the peptide sequence at SEQ ID NO. 48938
accacacgccgaggcttgctcttcttcttcttcttcttcttgttgatagaaaaatagaattcaggggcagccggggcccgagatcggcgaggccggccgtgcttgctgctcgcgccattgacacatcgtccatctgctagcgcagaggtagcgaggtaggtagcaatggagacccgggacagcgccccctccaccacgccgctcccctactcctactcgccgctgccggccgccgacgccgcctccgccgaggtctccggcgcccgcgcccgccggaggccgctctgcgccgccgcgctcgtgctgtccgccgcgctgctgctcctcgccgtcgcggcgctggccggcgtccgcatcgcgcccccgcggcccatcgcggtgggagagacggcggcggccgccaggagcaggggccccgcggccggcgtgtccgacaatacgtccggcgcatcgggggtgctgcttggcgagggcggtggcgacgccttcccctgcagcaaccagatgctccaatggcag

SEQ ID NO: 48938 - protein, 117 aa, Panicum virgatum
  misc_feature: Ceres CLONE 2046665
  misc_feature: Functional homolog of the protein sequence given in SEQ ID NO 51130
  misc_feature: Useful for making plants with altered carbohydrate content
METRDSAPSTTPLPYSYSPLPAADAASAEVSGARARRRPLCAAALVLSAALLLLAVAALAGVRIAPPRPIAVGETAAAARSRGPAAGVSDNTSGASGVLLGEGGGDAFPCSNQMLQW

SEQ ID NO: 48939 - DNA, 730 bp, Panicum virgatum
  misc_feature: Ceres CLONE 2046686
  misc_feature: Encodes the peptide sequence at SEQ ID NO. 48940
taaacatcgttatctggtcaaccttcgtggttactgcaactctccttcatccaaacttttgatatatgactatcttcaaggtggaagcttggatgaagtgttgcacgaaaagtctgaacagttggactgggatgcacgtattaacataatactaggagctgcaaaaggcttgtcatatttgcatcatgactgttcacctcgaataatacatcgtgatattaagtcgagcaacatcttacttgacggcaattttgaggcccgtgtatccgactttggacttgcaaaactattagaggatgaagaatcacatattactacaatagttgcaggaacatttggttaccttgcaccagagtatatgcaaagtggcagagccactgagaagactgatgtctacagctttggggttctggtacttgaaatactgagtggaaagcggcctactgatgcatcattcattgagaagggattgaacattgttggatggttgaattttctggctggtgagaatcgggagagggaaattgtcgatcccaactgtgaaggtgtgcagattgagaccttagatgctctgctttctctagccaagcaatgtgtaagctctttgccagaggagcggccgacaatgcacagggtggtacagatgctggagtcggatgtaattacaccatgccctagcgatttctacgattcagagtagtctcctggacaagccacactgctcccaatt

SEQ ID NO: 48940 - protein, 232 aa, Panicum virgatum
  misc_feature: Ceres CLONE 2046686
  misc_feature (1)..(216): Pfam Name: Pkinase_Tyr Pfam Description: Protein tyrosine kinase
  misc_feature: SWISSPROT Homolog: EC 2.7.11.1 Non-specific serine/threonine protein kinase
KHRYLVNLRGYCNSPSSKLLIYDYLQGGSLDEVLHEKSEQLDWDARINIILGAAKGLSYLHHDCSPRIIHRDIKSSNILLDGNFEARVSDFGLAKLLEDEESHITTIVAGTFGYLAPEYMQSGRATEKTDVYSFGVLVLEILSGKRPTDASFIEKGLNIVGWLNFLAGENREREIVDPNCEGVQIETLDALLSLAKQCVSSLPEERPTMHRVVQMLESDVITPCPSDFYDSE

SEQ ID NO: 48941 - DNA, 691 bp, Panicum virgatum
  misc_feature: Ceres CLONE 2046696
  misc_feature: Encodes the peptide sequence at SEQ ID NO. 48942
tctgctgatgcaattaactctggttgcgagggagatgaacctctaggatccatgaaagaaatggaagctcaaactattggagacctccttcctgatgacgatgatttgatatctggaatcactgatggcttcgaatgcgctggcttgtctaaccaggatgatgctgatgaagatatattctacactggaggaggtatggagctagataatgatgattccagcaatagtgacaaatttcatgaaagatccttcgatagtcagctttctcggaagcactctattagtaaacacccttccagagctctcattgtaaaaaatattaacccgagcattgaagattctgagctaagggttcaatttcagcaatatggggacatacaggctctccacacgtcctgcaagaaccatggatttgttacagtgtcttactatgacataagagctgcacagaatgcaatgagagcactccataacacacctctggggctgatgaaccttgatgttcaattttccattactaaggaaaatgttctaaacagagatgccaacaatggaatactggctgtatctatctttgactcttccatatccaaccatgatcttctccaaatatttagtgtttatggcgatgtcaaggagattcgcaaggcccctacaggaagcaataagatatttgtagaattctatgatg

SEQ ID NO: 48942 - protein, 230 aa, Panicum virgatum
  misc_feature: Ceres CLONE 2046696
  misc_feature (102)..(168): Pfam Name: RRM_1 Pfam Description: RNA recognition motif. (a.k.a. RRM, RBD, or RNP domain)
SADAINSGCEGDEPLGSMKEMEAQTIGDLLPDDDDLISGITDGFECAGLSNQDDADEDIFYTGGGMELDNDDSSNSDKFHERSFDSQLSRKHSISKHPSRALIVKNINPSIEDSELRVQFQQYGDIQALHTSCKNHGFVTVSYYDIRAAQNAMRALHNTPLGLMNLDVQFSITKENVLNRDANNGILAVSIFDSSISNHDLLQIFSVYGDVKEIRKAPTGSNKIFVEFYD

SEQ ID NO: 48943 - DNA, 586 bp, Panicum virgatum
  misc_feature: Ceres CLONE 2046700
  misc_feature: Encodes the peptide sequence at SEQ ID NO. 48944
ctctgcctgcccacagaaattggaaattccccattcagaaaggaggctgctccgcttcacacgcaggctttgctctgcccgaaatctctcgctcccatcaatggcgtcgccgacggcctgagcagctccccagctccgttggcggcggcgcgactccgcaccgggctcgcgagtcttcgccgcagggaggaggaagtggaggaggaagggaggccgcggagatggtggggggaggcggcggcggcggcggcggggcgctgcggcgggtgggcaaatacgaggtcggccggaccattggggagggcaccttcgccaaggtcaagttcgcgcagaacaccgagaccggggagagcgtcgccctgaaggtgctcgaccgctcctccatcctcaagcacaagatggccgaacagattaaaagggagatatccataatgaagcttgtcaggcatcccaatgttgttaggctacacgaggcgcgcttatctttctcttcctataaaccactgtttaacttctttctcaccactttgtcgtctttaaagtacccgtgctgtccattctgttatgtgcaggttctggcaagccg

SEQ ID NO: 48944 - protein, 121 aa, Panicum virgatum
  misc_feature: Ceres CLONE 2046700
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
MVGGGGGGGGGALRRVGKYEVGRTIGEGTFAKVKFAQNTETGESVALKVLDRSSILKHKMAEQIKREISIMKLVRHPNVVRLHEARLSFSSYKPLFNFFLTTLSSLKYPCCPFCYVQVLAS

SEQ ID NO: 48945 - DNA, 613 bp, Panicum virgatum
  misc_feature: Ceres CLONE 2046703
  misc_feature: Encodes the peptide sequence at SEQ ID NO. 48946
aagtgcttcccacgcagccgccattatcatcctcactctcatcactctctccccaacagtcacgctccctcacaatggagctcgctctccccctcctcctcgtccttgcaagcctctcgcttgccaatgccggcggcggcaacacgacaacctacatcgtgttcacggacccggagcggatgccggccgtgcacgcgtccccggcgcgctggcacgcggcgcacctcgagtcactgtccatcgacccggcgcgccacctgctctactcctactccgccgcggcccacggattcgcggcggcgctgctcccggaccaccttaccatgctccgcggcacccccgaggtgctccaggtcgtccccgacgaggtgttccagctccacaccacgcgctccccggagttcttgggcctgttaacgccggcgtaccagccggccatcggcaatctggaggcggccacgcacgacgtcgtcataggcgtcctggacaccggcgtctggccggagtcgtcgagcttcgcgggcggcagcctgccgccaccgcccgcgcggtggaagggggtgtgcgaggccggcgtcgatttcccgccgagcgcctgcgggaggaagttggt

SEQ ID NO: 48946 - protein, 179 aa, Panicum virgatum
  misc_feature: Ceres CLONE 2046703
  misc_feature (25)..(103): Pfam Name: Subtilisin_N Pfam Description: Subtilisin N-terminal Region
  misc_feature: SWISSPROT Homolog: EC 3.4.21.25 Cucumisin
MELALPLLLVLASLSLANAGGGNTTTYIVFTDPERMPAVHASPARWHAAHLESLSIDPARHLLYSYSAAAHGFAAALLPDHLTMLRGTPEVLQVVPDEVFQLHTTRSPEFLGLLTPAYQPAIGNLEAATHDVVIGVLDTGVWPESSSFAGGSLPPPPARWKGVCEAGVDFPPSACGRKL

SEQ ID NO: 48947 - DNA, 647 bp, Panicum virgatum
  misc_feature: Ceres CLONE 2046710
  misc_feature: Encodes the peptide sequence at SEQ ID NO. 48948
aacacacagcacagagaacatatatgggactctcttcttcatcacgtggccctctggcctcggcactactgctttgcttttgcatgctgcttctgggagtacatggaggatctcgcaggctttatatcgtctacctaggagatgtgaaacatggacacccgaatgatgtcatcgcttctcaccatgatctactcatcaacattcttggaagcaaggaagattctttggcctccatggttcacaactacaagcatggcttctcaggcttcgcagcaatgctcactgaagaacaagctaaacagctcgcagagtctccagaagtcatcagtttggaaccaagcagaagctacacggcgacaaccacacgaagctgggacttccttggtctgggctcccaaatacccagcgacctgctccgtgaaggcagatatggagaggacataatcatcggcgtcgtcgacagtggtatctggccggagtcgagaagcttcagcgacgaagggtacgggccagtgccgtcccggtggaaaggcgtgtgccaagtcggtcagggctgggacctcaacaactgcagccgcaagatcatcggcgcacggttctacagcgccggacagaacgaggagaacctcaagatggacttcctctcg

SEQ ID NO: 48948 - protein, 207 aa, Panicum virgatum
  misc_feature: Ceres CLONE 2046710
  misc_feature (32)..(112): Pfam Name: Subtilisin_N Pfam Description: Subtilisin N-terminal Region
  misc_feature: SWISSPROT Homolog: EC 3.4.21.25 Cucumisin
MGLSSSSRGPLASALLLCFCMLLLGVHGGSRRLYIVYLGDVKHGHPNDVIASHHDLLINILGSKEDSLASMVHNYKHGFSGFAAMLTEEQAKQLAESPEVISLEPSRSYTATTTRSWDFLGLGSQIPSDLLREGRYGEDIIIGVVDSGIWPESRSFSDEGYGPVPSRWKGVCQVGQGWDLNNCSRKIIGARFYSAGQNEENLKMDFL

SEQ ID NO: 48949 - DNA, 581 bp, Panicum virgatum
  misc_feature: Ceres CLONE 2046713
  misc_feature: Encodes the peptide sequence at SEQ ID NO. 48950
actgctcgagcgagctccagctctcaagaaaccacgccggatcatggccatggcgcctctccttcgcccgctcgtcctcgcgctcctgatcgcgtcctgcgccgcgcagcaggcgccgccggcgcagcccccgcagacgccgaacgccccgccgcaggcgcctccggctccccaagcgcctccggcgggcaacccgcctcccgcacccaccactcctcctccggctccgacgaccacgccgcccccggcaccgaccacccctcctccggccccaaccacgccgcccccggccccggtgactcccccgccagcccccaccacgccgccgccgtcgccgccggcctctcccccgcccgctcccaccaccccgccacccgctcccgccaccccgcccccgtccccgcccatggcgccgcctccagccacgcctcctccccccgccaccccgcctccggccgcgcccacgccggccccgagcaccgccccgacgctcccgcccgtggcgacacccgccgcgtccccgaagagccccaagaccccgagccccgccgccgcgacgtccccggcgcccgcgctctcgc

SEQ ID NO: 48950 - protein, 177 aa, Panicum virgatum
  misc_feature: Ceres CLONE 2046713
  misc_feature: Functional homolog of the protein sequence given in SEQ ID NO 50205
  misc_feature: Useful for making plants with altered cell wall content and/or composition
MAPLLRPLVLALLIASCAAQQAPPAQPPQTPNAPPQAPPAPQAPPAGNPPPAPTTPPPAPTTTPPPAPTTPPPAPTTPPPAPVTPPPAPTTPPPSPPASPPPAPTTPPPAPATPPPSPPMAPPPATPPPPATPPPAAPTPAPSTAPTLPPVATPAASPKSPKTPSPAAATSPAPALS

SEQ ID NO: 48951 - DNA, 740 bp, Panicum virgatum
  misc_feature: Ceres CLONE 2046753
  misc_feature: Encodes the peptide sequence at SEQ ID NO. 48952
aaaatcccataatttcccatccattgccccccaaccagaacgggaacgccgccgccgcctccccctcagcccgcgcacttcaatgctccccccgtcccgcgccacgccgcctcccccatccacatggactccatcctccccctccccctcctcctcgccctcctcctcctcgccgcgccggcggcggcggccacgcacccggccgacctcgccgtcctcaaggacctccgcaagtccctgaccaaccccgacgcgctcggatggccggacaacgacgacgcctgcgggcccccagcctggccgcacgtctcctgcgaccactcgggccgcgtcgacaacctcgacctcaagaacgccggcctcgccggcgccctccccgccaccatctcctccctcgacgccctccagggcctcagcctccaggggaaccgcctctccggcccgctcccctccttccgcggcatgtccgccctccgccgcgccttcctcaacgacaacgccttcgactccatccccgccgacttcttcgacggcctcaccgccctcctcgagatctccctcgccaacaacccgcgcctcaacgcctccgccggcggctgggcgctgccccacggcctcgccgcctccgcgcagcagctgcagttcctctccctcgacaactgcagcctctccggcgccgtcccgcccttcctcggcaccatgaacagcctccaaaaactcaccctctcctacaaccactt

SEQ ID NO: 48952 - protein, 205 aa, Panicum virgatum
  misc_feature: Ceres CLONE 2046753
  misc_feature: SWISSPROT Homolog: EC 2.7.11.1 Non-specific serine/threonine protein kinase
MDSILPLPLLLALLLLAAPAAAATHPADLAVLKDLRKSLTNPDALGWPDNDDACGPPAWPHVSCDHSGRVDNLDLKNAGLAGALPATISSLDALQGLSLQGNRLSGPLPSFRGMSALRRAFLNDNAFDSIPADFFDGLTALLEISLANNPRLNASAGGWALPHGLAASAQQLQFLSLDNCSLSGAVPPFLGTMNSLQKLTLSYNH

SEQ ID NO: 48953 - DNA, 408 bp, Panicum virgatum
  misc_feature: Ceres CLONE 2046759
  misc_feature: Encodes the peptide sequence at SEQ ID NO. 48954
aagcttctactaaaagccggcgcagcagcggcaggaggaggttagcagcttggtcatcatcggtgctcggtgtcaggggagatagatccatggagcccaaggaggcgacgaaagcggatgcggtggcgccggcggccggagccgccgcagttgatgtcggtggcgccggagcaaagaatggacctccagtgccggttgacaatgccgcagctgccccggctgacagagatgccgttcttgcaaaggtggagatggacaggaagctgtcgatgatcaaggcttgggaggagagcgagaagagcaaagctgagaacaaggctcagaagaagatgtcatccatcatgtcgtgggagaacacaaagaaggctgctgcggaagcaaagcttcgaacccgagaggagaagctgg

SEQ ID NO: 48954 - protein, 106 aa, Panicum virgatum
  misc_feature: Ceres CLONE 2046759
  misc_feature: The sequence is a functional homolog of SEQ ID NO 496 in the 11/435,388 US patent application
  misc_feature: The sequence is a functional homolog of SEQ ID NO 438 in the 10/666,642 US patent application
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
MEPKEATKADAVAPAAGAAAVDVGGAGAKNGPPVPVDNAAAAPADRDAVLAKVEMDRKLSMIKAWEESEKSKAENKAQKKMSSIMSWENTKKAAAEAKLRTREEKL

SEQ ID NO: 48955 - DNA, 556 bp, Panicum virgatum
  misc_feature: Ceres CLONE 2046772
  misc_feature: Encodes the peptide sequence at SEQ ID NO. 48956
ctagagctcccaaccttccagatctcgcgctgttccggccgctcgactgcttctcgcgaactattagaggggtaatagcttgtgcgatccagtggatcatccatggggttcagatcggatgcttagcacagctgggctgaggcttttcgtgctcgtcgcgattgggagctggaactcgggcgctatttgggggaggaagctgggttgatttcaaacgaatggggacgagtcaatcggcgcgctctttcgctgttccgcagggccgacttgcggggtatcagcttcaagtcctgctgctgcaccataaatgcgcgagagagatgcctgctgggagtactgccacgagctggatgggaacaaagtccgttgcaggttctgccacaaggttctcaatggtggcatcagccggctcaagttccatctgtctcaaattcccagcaaaggggttaacccttgcaccaaggtgaaggaagacgtcattgagaatgtgaaggctatcatatcggcaaaggaagagtacgaggagttccagcttctcaagaggcagcgggtagcg

SEQ ID NO: 48956 - protein, 82 aa, Panicum virgatum
  misc_feature: Ceres CLONE 2046772
  misc_feature (5)..(58): Pfam Name: zf-C2HC_plant Pfam Description: Protein of unknown function, DUF1544
MRERDACWEYCHELDGNKVRCRFCHKVLNGGISRLKFHLSQIPSKGVNPCTKVKEDVIENVKAIISAKEEYEEFQLLKRQRV

SEQ ID NO: 48957 - DNA, 684 bp, Panicum virgatum
  misc_feature: Ceres CLONE 2046788
  misc_feature: Encodes the peptide sequence at SEQ ID NO. 48958
atcaactcatcccgctgctccgctcgaggacgtactacgatgccctcctcagcgcctcgccgcggcgccgccggccacgcgctgctcgccgcgctcctcgcgaccgtgctcgttgccgcgcgggcgcaggacggcggcggcgacgcgcccggcggccaggaacagaaccagcaggaccaggtcagcacggcgatggtcccgctcctcgcggccgtcgtcgcggtgttcgtcttcatcgcctccgccaccatctacctccgccactgcagcggcagcgcgccgcctcccgccgacagccgcgcggctggcgacgccttcttcgccacgcggtcgtcgcggtcgtggtggcggccgcggcggcgcgccccgcgcgggctcgacgccgaggccgtcgaggcgttccccaccatgacgtacgccgaggccaaggcgctgcgcgtcgggaatggcggcgacggcggcggcgcgctcgagtgcgcggtgtgcctcagcgagttcgaggacggggagcggctccgggtgctactgcccaggtgcagccacgccttccacccggactgcatcggcgcgtggctcgccggccacgtcacctgccccgtctgccgctgcaacctcgagcctcgaaacaaggatgccaccaccagcagcgacggggaagagccgacgggtagtttgccgccgatt

SEQ ID NO: 48958 - protein, 214 aa, Panicum virgatum
  misc_feature: Ceres CLONE 2046788
  misc_feature (146)..(188): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature: The sequence is a functional homolog of SEQ ID NO 1132 in the 10/666,642 US patent application
MPSSAPRRGAAGHALLAALLATVLVAARAQDGGGDAPGGQEQNQQDQVSTAMVPLLAAVVAVFVFIASATIYLRHCSGSAPPPADSRAAGDAFFATRSSRSWWRPRRRAPRGLDAEAVEAFPTMTYAEAKALRVGNGGDGGGALECAVCLSEFEDGERLRVLLPRCSHAFHPDCIGAWLAGHVTCPVCRCNLEPRNKDATTSSDGEEPTGSLPP

SEQ ID NO: 48959 - DNA, 707 bp, Panicum virgatum
  misc_feature: Ceres CLONE 2046807
  misc_feature: Encodes the peptide sequence at SEQ ID NO. 48960
ccaaagcacccgcaaatatctgtcgccatcccgtctctctcgtcgaattcgatagccatggcgagccaaggcgcgtcttcctccgatccgaaggataagaaggactattctacggcgatcctcgagaggaagaagtcgccgaaccgactggtggtcgacgaggccaccagtgatgacaactccgtcgtcgcactgcacccggacaccatggagcgcctccagctcttccgcggcgacactgtcctgctcaagggtaagaagaggaaggacactatctgcatcgtgcttgcagatgacacttgcgaggagccaaaaatcaggatgaacaaggttgtcaggaagaacttgagggtacgacttggtgatgtggtttctgtccatcaatgcccagatgtcaagtatgggaagcgtgtacacatacttccatttgatgacacgattgaaggcattactggcaacttatttgatgccttcctgaaaccatacttccttgaagcctatcgtcctttgagaaaaggagaccttttccttgtcaggggtggtatgagaagtgtagaattcaaagttatagagactgaccctgcagagtattgtattgttgcaccagatacagagatattctgtgaaggtgagcctattaagagggatgatgaggaaagactcgatgaggttggctatgatgatgttggaggagttaggaagcaaat

SEQ ID NO: 48960 - protein, 216 aa, Panicum virgatum
  misc_feature: Ceres CLONE 2046807
  misc_feature (27)..(113): Pfam Name: CDC48_N Pfam Description: Cell division protein 48 (CDC48), N-terminal domain
MASQGASSSDPKDKKDYSTAILERKKSPNRLVVDEATSDDNSVVALHPDTMERLQLFRGDTVLLKGKKRKDTICIVLADDTCEEPKIRMNKVVRKNLRVRLGDVVSVHQCPDVKYGKRVHILPFDDTIEGITGNLFDAFLKPYFLEAYRPLRKGDLFLVRGGMRSVEFKVIETDPAEYCIVAPDTEIFCEGEPIKRDDEERLDEVGYDDVGGVRKQ

SEQ ID NO: 48961 - DNA, 705 bp, Panicum virgatum
  misc_feature: Ceres CLONE 2046812
  misc_feature: Encodes the peptide sequence at SEQ ID NO. 48962
gacccatatactatatttccccagccagaagagaactttaaggttcatacagaaatatttttcagcagtggaaatatatggagagcacataacacaaaagaaattttagaaaaacatctgaaggcaactggaggaaaagtgatgacccgtttcccaccagaacctaatggatatctacatattggtcatgccaaggccatgtttattgattttgggctggcgaaggagcgaaatggtcactgctaccttaggtttgatgacacaaatccagaagctgaaaagaaagagtatatagatcacattcaggaaattgtccattggatgggatgggagccctacaaagtaacatacacgagtgactatttccaagctttgtatgagcatgctattgagttaatacggaaagggctagcctatgtggaccaccagactgctgaagaaatcaaggagtatagggataagaagatgaatagtccatggagggataggccaattgaagagtcactgaaattgtttgaagacatgaggcgtgggttgattgctgagggcgcagcaactctccgaatgaagcaggacatgcagaatgagaacaaaaatatgtctgacttaatagcatatagaataaaattcacccctcatccacatgctggcgacaagtggtgtatctatccaagttatgactacgctcattgcatggtggattct

SEQ ID NO: 48962 - protein, 234 aa, Panicum virgatum
  misc_feature: Ceres CLONE 2046812
  misc_feature (46)..(234): Pfam Name: tRNA-synt_1c Pfam Description: tRNA synthetases class I (E and Q), catalytic domain
  misc_feature: SWISSPROT Homolog: EC 6.1.1.18 Glutamine--tRNA ligase
DPYTIFPQPEENFKVHTEIFFSSGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAIELIRKGLAYVDHQTAEEIKEYRDKKMNSPWRDRPIEESLKLFEDMRRGLIAEGAATLRMKQDMQNENKNMSDLIAYRIKFTPHPHAGDKWCIYPSYDYAHCMVD

SEQ ID NO: 48963 - DNA, 653 bp, Panicum virgatum
  misc_feature: Ceres CLONE 2046815
  misc_feature: Encodes the peptide sequence at SEQ ID NO. 48964
actcccatcacaggccccaatttcccgccgccccaccgaacctgcttctttgatagccttcctctgctttcccctccgatctttgctcggtccctggctaaacatgaccgaatcctttgtgctcaacaccggcgcgaggatcccatcggttggccttggcgtatggcaaattcagcctgacgccgtcggcaacgccatctatgctgctgtcaaggctgggtatcggcacattgattgcgctgcagcatacagcaatgagaaggaggtaaatagtaattactttcacccagtttaccatcacataaattttctgttccatgtgcacactgctatttctttatcgtaactgattaggttgtaattgttggttctctcaagaaatatatttattgacttactttattttatcacacaatcatatgattgtttcaactcacctgaatatgacacgatgcatgccataactttattctttactcctattttctacatcatgtagaacatttcttgtaaggaaattcgattcgttcatttttaaaagcagtatttagagaagaatcatatccagatatagtgataataagtcaatcagataaaagtgataagataataagaaggaatgtaaggatagcacaacaatttgtgttggaacg

SEQ ID NO: 48964 - protein, 80 aa, Panicum virgatum
  misc_feature: Ceres CLONE 2046815
  misc_feature: SWISSPROT Homolog: EC 1.1.1.21 Aldehyde reductase
MTESFVLNTGARIPSVGLGVWQIQPDAVGNAIYAAVKAGYRHIDCAAAYSNEKEVNSNYFHPVYHHINFLFHVHTAISLS

SEQ ID NO: 48965 - DNA, 676 bp, Panicum virgatum
  misc_feature: Ceres CLONE 2046826
  misc_feature: Encodes the peptide sequence at SEQ ID NO. 48966
gagaagcggggggaggagctctgctcttcttccacccacccaccacctctagggcagcacagcagggctggctctaccacgtccacgaccacgagtcagtcagtcagtcgccaccaccaccaccaccacccgcatccagtcggtcagccagccagtcccaccacaccactggcacccacccagcaccaaattagctacgtagtagggaggatagagagagaggggggatgaccaccaggcctgcagcagaggggggcgccgccgccgccgccgccgacaataagcagctcgtccccgcctccagcggcaccgtccgcaaggccccctccaaggaccgccacagcaaggtcgacggccggggccgccgcatccgcatgcccatcatctgcgccgctcgcgtcttccagctcacccgcgagctcggccacaagtctgacggccagaccatcgagtggctgctccgccaggccgagccctccatcatcgccgccaccggcaccggcaccaccccggcctccttctccacctcctcgccatcctccctcccctcctcctcccagaccacgccaaccgccgccgcgcccttcatcctcggcaagcgcgcccgcgacgacgccggcgccgacgccgagcccacggtcgccgcccccgccccgggattctgggcgctgccggg

SEQ ID NO: 48966 - protein, 149 aa, Panicum virgatum
  misc_feature: Ceres CLONE 2046826
  misc_feature (22)..(138): Pfam Name: TCP Pfam Description: TCP family transcription factor
  misc_feature: The sequence is a functional homolog of SEQ ID NO 1222 in the 11/479,226 US patent application
  misc_feature: The sequence is a functional homolog of SEQ ID NO 136 in the 10/225,068 US patent application
  misc_feature: The sequence is a functional homolog of SEQ ID NO 162 in the 10/374,780 US patent application
  misc_feature: The sequence is a functional homolog of SEQ ID NO 550 in the 10/412,699 US patent application
  misc_feature: The sequence is a functional homolog of SEQ ID NO 970 in the 10/225,066 US patent application
  misc_feature: The sequence is a functional homolog of SEQ ID NO 1229 in the 11/479,226 US patent application
  misc_feature: The sequence is a functional homolog of SEQ ID NO 226 in the 10/225,066 US patent application
  misc_feature: The sequence is a functional homolog of SEQ ID NO 2424 in the 10/374,780 US patent application
  misc_feature: The sequence is a functional homolog of SEQ ID NO 1392 in the 10/374,780 US patent application
MTTRPAAEGGAAAAAADNKQLVPASSGTVRKAPSKDRHSKVDGRGRRIRMPIICAARVFQLTRELGHKSDGQTIEWLLRQAEPSIIAATGTGTTPASFSTSSPSSLPSSSQTTPTAAAPFILGKRARDDAGADAEPTVAAPAPGFWALP

SEQ ID NO: 48967 - DNA, 632 bp, Panicum virgatum
  misc_feature: Ceres CLONE 2046837
  misc_feature: Encodes the peptide sequence at SEQ ID NO. 48968
gcgaacgcagtgaggaagtgaggaaggcacagcgccgccgcagtgggcacacctgcccgcccgcgcgcgcactgctgtgctgccgctgccgctgcttgacctcgcccgtcagccgctgctgggtggtggaaaggagaggaggggatcaggggggagccgggagggcggcggcgccatggcggggggaggaggaggagggcccgggccggggatggtgaaggcggggagccggccgccgtgggtggggctggcggcggcggtgtgggtgcaggtggcggcggggagcgcctacgtgttcccgctctactcgcacgccgtcaaggaggcgcttgggtacgaccagaaggcgctcaccatgctcggcgtcggcaacgacgtcggcgagaacgtggggctcgtcccgggggtgctggccaaccgcctcccgccctggctcatcctcgtcatcggctccgcctgcgccttcttcggcttcggcacgctctggctcgccgtcaccaagaccgtcgccatgccgtactgggtgttgtggatagctttatgtatcggcacaaacagcagtgcatggttgggcactgctgctcttgttaccaacatgaggaatttccctctcagcagaggcactgttgctg

SEQ ID NO: 48968 - protein, 152 aa, Panicum virgatum
  misc_feature: Ceres CLONE 2046837
  misc_feature (21)..(152): Pfam Name: Nodulin-like Pfam Description: Nodulin-like
MAGGGGGGPGPGMVKAGSRPPWVGLAAAVWVQVAAGSAYVFPLYSHAVKEALGYDQKALTMLGVGNDVGENVGLVPGVLANRLPPWLILVIGSACAFFGFGTLWLAVTKTVAMPYWVLWIALCIGTNSSAWLGTAALVTNMRNFPLSRGTVA

SEQ ID NO: 48969 - DNA, 697 bp, Panicum virgatum
  misc_feature: Ceres CLONE 2046864
  misc_feature: Encodes the peptide sequence at SEQ ID NO. 48970
acaatgtgtgagcaccctgcggttcacaaggggtgatttcccggatggctttgcgtttggagctgcaacttcagcctatcagtatgagggtgcagcagctgagggcgggaggagtccaagcatctgggacaccttcacccattcaggtctttctcggatatttcttataaaacatcgaagttctatgctagtttttagcccatattcgctacgattgagatgataaagggaaagttcagttacttatccaaaatgttgcccaaatttggcacaactagtttccaaatttcctcaaagaaagattcatttccaatgctggttaatcttctggttgtggaaatgtgccttttagcaaaaataagtttcggtaagctttattaccagtgtagtcttgtactctgtttgatctatctttgttaatgtgataggaagctcccttgccatttccactcaaatattacatttaaatggaataaaaatatatttttaaacctgtgatcagtagttatgcatttatctcaactaactaaatttgtgtgattgtatcgcacacgagccatagagagaaatacggatgggggaaccggtgatatcgcttctgacggctgccacaagtacaagcatttccaatgtagcaagatgtcaagctaatgagtgatataggcctggaggcttaccggtttactatttcttggtc

SEQ ID NO: 48970 - protein, 73 aa, Panicum virgatum
  misc_feature: Ceres CLONE 2046864
  misc_feature: SWISSPROT Homolog: EC 3.2.1.21 Beta-glucosidase
QCVSTLRFTRGDFPDGFAFGAATSAYQYEGAAAEGGRSPSIWDTFTHSGLSRIFLIKHRSSMLVFSPYSLRLR

SEQ ID NO: 48971 - DNA, 711 bp, Panicum virgatum
  misc_feature: Ceres CLONE 2046871
  misc_feature: Encodes the peptide sequence at SEQ ID NO. 48972
aaacgcagcagtagcagcacggccgtcgtcctccgtttcctcctcgccgcaccggggggcaatccgcaagccattctctccttctcgattcccctcgtcgcgggatctcccttgcacaccgcggccggagaagaggaggagaggggcagcctcattcatcggatcggcgtgcctgtgctgtctgtggtttcgatttccctttttcccccttatttttccaggtcgataagatttgggggcgatcgccatgggattcgggatggggaataacggggcgagctcgtcgtcgtcgcggctggaccccgccccgctcctgccgcaccatggcagcgcgggcggcgagatcggcctgtcgtcgcagcccaagacgttcgccaacgtcttcatcgcggtggtcggcgccggcgtgctggggctgccgtacaccttctcgcacaccgggtgggcggcggggtcgctgctgctcttcgtcgtcgccgcgctcaccttctactgcatgatgctgctcgtcgcgtgccgccgccgcctcgccgacgagcacccgaagatcgcctcgttcggggacctgggggacgccgtgttcggcgcgcacgggcggtccgccgtggacgtgatgctggtgctcagccaagtgagcttctgcatcgggtacctcatcttcatctccaacaccatggcgcacctctacccgatattcgcgccgtcggcctt

SEQ ID NO: 48972 - protein, 154 aa, Panicum virgatum
  misc_feature: Ceres CLONE 2046871
  misc_feature: Functional homolog of the protein sequence given in SEQ ID NO 50549
  misc_feature: Useful for making plants with modulated nitrogen use efficiency
MGFGMGNNGASSSSSRLDPAPLLPHHGSAGGEIGLSSQPKTFANVFIAVVGAGVLGLPYTFSHTGWAAGSLLLFVVAALTFYCMMLLVACRRRLADEHPKIASFGDLGDAVFGAHGRSAVDVMLVLSQVSFCIGYLIFISNTMAHLYPIFAPSA

SEQ ID NO: 48973 - DNA, 707 bp, Panicum virgatum
  misc_feature: Ceres CLONE 2046892
  misc_feature: Encodes the peptide sequence at SEQ ID NO. 48974
gggtttcaaaagaagatgatcctgaaaattggcatgttcaggttgtcatgctgccttttaagttctattttttttgtcaaaataattttgaaattttctggagtggttgatgtatttttcttaactatgcaggtattccggtcaattgactctggttcgctaaaaggatttcctagtgattccaaagaagcttcaaagctgaatctcgtgtgccgcaagaacctggtaattgataagagcattcacactgcatatgtccgggcaatcagatctgcacagcatttcatttatatcgagaatcaatactttcttggttcttcatatgcttggccatcctatgtgaattcaggtgctgacaatctgataccaatagaattagccctcaaaattgcaagtaagattagagcaggagaacgctttgcagtgtacgtagtgataccaatgtggcctgaaggagtccctactgcagcatctgtgcaagaaatccttttctttcaggcccagacaatggagatgatgtataaaataattgcagatgaacttaaggcaatggacattaaggatttgcaccctcaagattacttgaacttcttttgtcttggaaatcgggaagaaaccacatcaaatggcagcctggagtcagagaaatcttcagataaaagtgcagcggtaatctactgttgcacttcttttctcattcttcaaac

SEQ ID NO: 48974 - protein, 235 aa, Panicum virgatum
  misc_feature: Ceres CLONE 2046892
  misc_feature: SWISSPROT Homolog: EC 3.1.4.4 Phospholipase D
GFQKKMILKIGMFRLSCCLLSSIFFVKIILKFSGVVDVFFLTMQVFRSIDSGSLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDLHPQDYLNFFCLGNREETTSNGSLESEKSSDKSAAVIYCCTSFLILQ

SEQ ID NO: 48975 - DNA, 705 bp, Panicum virgatum
  misc_feature: Ceres CLONE 2046922
  misc_feature: Encodes the peptide sequence at SEQ ID NO. 48976
gcacggcccgatacccatctctcctccagtcccgcccctcccctcccctcgcattgcggccgccacccggtagagtgtgaggctagataactagctgcgcgtacgctcgccggcgccggccgttcctgccgtgcgtctgctccggtaaatgactggaggccttgccagcgtcgtcgaggtcgtggtgctggctccgctcttgttcgtggcgtgcctgtcgtcgtccccatcgccggagccgtcgtcgtcatcgtcgttgcgcgctagcaccggagggtttatcaacgaaggctaaatcttgctggcaatacgaacttcaacgtctccttacagaaagactgaagaaattcctgaacaatttgcggaaaacagattaagcaagcaagcaggctgatagtgaagtttcagaaagctcattgaacgacgtgatggatcccaccactgttgagtcgaaatgggtgtctcccaccactgaagatgggtcaatggacaggagaggaaacccagctgccaaagcagcatctggaagatggagatctgccatcctgctgctcgccaactacgggctcgtgacgtgcgccttcttcggcgtcggtgtgaacctggtggtgttcctgcggcgggtgctccaccaggacaacgccgaggcgggcaacaacatcagcaagtggaccgggcacgtctacatcttctcgctcatcggcg

SEQ ID NO: 48976 - protein, 92 aa, Panicum virgatum
  misc_feature: Ceres CLONE 2046922
  misc_feature: Functional homolog of the protein sequence given in SEQ ID NO 51119
  misc_feature: Useful for making plants with altered carbon content
  misc_feature: Useful for making plants with altered nitrogen content
MDPTTVESKWVSPTTEDGSMDRRGNPAAKAASGRWRSAILLLANYGLVTCAFFGVGVNLVVFLRRVLHQDNAEAGNNISKWTGHVYIFSLIG

SEQ ID NO: 48977 - DNA, 738 bp, Panicum virgatum
  misc_feature: Ceres CLONE 2046934
  misc_feature: Encodes the peptide sequence at SEQ ID NO. 48978
gtgcatgttaccttagtccatagaattaaccaccgcgccgctaagataggagttgcaaggcactgtgacgatgaccaccttatccctgagacctgcagggcagtgcaatgggagctgcctgctcgcacctgccacagcacggcaaccacgtatttcttggtggcgtcggcagcagaggcaaaccacgctgcatcgccagcaaatgcaacagtgttcagtggcaacattacacaatgataaggttgacgatcgcttgggcaagaatccatgcaattttcatccttctatatggggagatttcttcctacactactacgacgcagcagcttcctccaaacagcagcagacgtggatggtagaacgagcagatgaagtgaagcaagacgtggcaaaaatagtagcaagttcagttgcttgggaccttcatcataggctacaacttatcaatgcgctggagcgtctgtgcttggatcatttgttcgaagatgacattaatgctgcactgactcaaattaggacagttaatcttactgactgtgatcttcacacggtagctatgtggttttatctgcttcgtaagcacggacacagagtttcaccagatgtgtttgtgaggttcaaagatcaagaggggagctttcttgcgaacaatccagtggagctattgagtctgtataatgctgcacacctcggaacacatggagagataatactagatgaagctgtagtatttaccaa

SEQ ID NO: 48978 - protein, 178 aa, Panicum virgatum
  misc_feature: Ceres CLONE 2046934
  misc_feature (30)..(178): Pfam Name: Terpene_synth Pfam Description: Terpene synthase, N-terminal domain
  misc_feature: SWISSPROT Homolog: EC 4.2.3.13 (+)-delta-cadinene synthase
MQQCSVATLHNDKVDDRLGKNPCNFHPSIWGDFFLHYYDAAASSKQQQTWMVERADEVKQDVAKIVASSVAWDLHHRLQLINALERLCLDHLFEDDINAALTQIRTVNLTDCDLHTVAMWFYLLRKHGHRVSPDVFVRFKDQEGSFLANNPVELLSLYNAAHLGTHGEIILDEAVVFT

SEQ ID NO: 48979 - DNA, 528 bp, Panicum virgatum
  misc_feature: Ceres CLONE 2046943
  misc_feature: Encodes the peptide sequence at SEQ ID NO. 48980
atcagcaacgaagtactcgagatagattcagactttcagagagagagaattattctgtaaatctgcagtaggaccattatctgatgggtcacgggtgggtgcaggtgagggtggagacgtgcgtggagaaggccggcgccgacatggtggtgatgggcagccacggctacggcttcctgcagagggcgctgcgggggagcgtcagcaaccactgcgtgcagaactgcaagtgccccgtcgtcgtcgtcaagaggcccggcggcgagcgccgcccggcgccgccgcggatctaggctcttgatgaggccgtatataataaccgtaagtgaataggagcccgactcgcctcggctaaacgtgacggtggccgcccgtgtacatatctcgcttgttcggggcctgtatctccctgagtatataatgttttcggttcacacaaaatattgtaacgtgtcatgtacattctatatagtcgtttcgaatatgtaagatgagaagaggcatattcgttgttctgtccgacacctt

SEQ ID NO: 48980 - protein, 69 aa, Panicum virgatum
  misc_feature: Ceres CLONE 2046943
  misc_feature: Functional homolog of the protein sequence given in SEQ ID NO 50611
  misc_feature: Useful for making plants with altered lignin content
  misc_feature: Useful for making plants with modulated biomass
MGHGWVQVRVETCVEKAGADMVVMGSHGYGFLQRALRGSVSNHCVQNCKCPVVVVKRPGGERRPAPPRI

SEQ ID NO: 48981 - DNA, 709 bp, Panicum virgatum
  misc_feature: Ceres CLONE 2046947
  misc_feature: Encodes the peptide sequence at SEQ ID NO. 48982
aaaaaaaaaaaccactactagctcgcaaatttgggaaagcagatccctgctctctatagttagacagcaacccaaccacctactaggcctaggctgtgatcccagcttgcacactttggtctgcagattgcagaaatctgcagggtgcaggatggagagaacactgatcacctctaacctctccatggctgcgcatccttcaagatcgtccgggagagttggctacatctcccctgctgcctctgctgctgcacagaactccagctacaggaagaagaagagcaccccatcggccgccgcaaccgccaccgtcgtcacctcccctccggccactgacaatgctcagtccactgctccgaagcagaccgagcaacaggacaagggagagcgcgtggcggccgagactaacacttcaagaattggcactgcaagtgcaagaacaagggcgccgagccaggcccgggctcagccccaccgccgccctgccccggcggccgcgtccctgccgatggcgttctgcagcgcgctggaggaggcgatcaacacgttcgtcgacccgccggcgctgcggccgtcggtggacccgcggaacgtgctgtcggccaacttcgcgcccgtggacgagctgccgcccacgccctgccccgtcgtgcgcggcgccatcccgcgctgcctcgccggaggggcctacatccgcaacgggcccaac

SEQ ID NO: 48982 - protein, 185 aa, Panicum virgatum
  misc_feature: Ceres CLONE 2046947
  misc_feature: SWISSPROT Homolog: EC 1.13.11.51 9-cis-epoxycarotenoid dioxygenase
MERTLITSNLSMAAHPSRSSGRVGYISPAASAAAQNSSYRKKKSTPSAAATATVVTSPPATDNAQSTAPKQTEQQDKGERVAAETNTSRIGTASARTRAPSQARAQPHRRPAPAAASLPMAFCSALEEAINTFVDPPALRPSVDPRNVLSANFAPVDELPPTPCPVVRGAIPRCLAGGAYIRNGP

SEQ ID NO: 48983 - DNA, 679 bp, Panicum virgatum
  misc_feature: Ceres CLONE 2046959
  misc_feature: Encodes the peptide sequence at SEQ ID NO. 48984
ggtcaccactgaatggctgcagcaatgggttcaatatctgcctatggttcttaccaaacaaataggcccagtgcactgaagcagacacctcacatgcaattccaacaatgttgtagaggtggagttaggtttgtaagcaatcattcccaatccgtgcgaagtaagacacggctgtccaaaagaagagccacaaataatggaattcgtccaaagactaccaggtctcaggcacctattgtatgttccactggaatgaccataatttttgttgcaactgaagtacacccatggtgcaaaactggtggcctcggtgatgttgtaggaggactgcccccagctctggctgccctgggacaccgggtcatgacgatagctcctcgctatgatcaatacaaggatgcatgggatacaaatgtccttgttgaggtatggggcaagactggtgcaaaattgtatggtcctactactggaactgactatagagataaccagttgaggttctgccttttgtgccttgctgctttggaggctccaagagttctcaatctcagcaattctgaatacttttctggaccttatggtgaagatgttgtcttcgtagcgaatgattggcacactgcagttctgccctgctatctgaagagcatgtataagccaaatgggatttatgcgaatgcta

SEQ ID NO: 48984 - protein, 222 aa, Panicum virgatum
  misc_feature: Ceres CLONE 2046959
  misc_feature (82)..(222): Pfam Name: Glyco_transf_5 Pfam Description: Starch synthase catalytic domain
  misc_feature: SWISSPROT Homolog: EC 2.4.1.242 NDP-glucose--starch glucosyltransferase
MAAAMGSISAYGSYQTNRPSALKQTPHMQFQQCCRGGVRFVSNHSQSVRSKTRLSKRRATNNGIRPKTTRSQAPIVCSTGMTIIFVATEVHPWCKTGGLGDVVGGLPPALAALGHRVMTIAPRYDQYKDAWDTNVLVEVWGKTGAKLYGPTTGTDYRDNQLRFCLLCLAALEAPRVLNLSNSEYFSGPYGEDVVFVANDWHTAVLPCYLKSMYKPNGIYANA

SEQ ID NO: 48985 - DNA, 704 bp, Panicum virgatum
  misc_feature: Ceres CLONE 2046961
  misc_feature: Encodes the peptide sequence at SEQ ID NO. 48986
gtcccccgctctcgagcagctcgtccctaaacaaacccttcccctctctcgcgccgccgacttcgccctcgcctcctcgccttcgggaagctttcgccatggcctcggagaccgagacgtttgccttccaggcggagatcaaccagctgctctcgctcatcatcaacaccttctactccaacaaggagatcttcctccgcgagctcatctccaactcctccgatgccttggacaagatcaggtttgagagcttgacggacaagaccaagctagatgctcagccagagctgttcatccatatcatccctgacaaggctacaaacaccctgacgatcgttgacagtggtattggtatgaccaagtcagacctcgtgaacaaccttggtaccattgcacggtcaggaacgaaggagttcatggaggcactggctgctggtgctgatgtgtctatgatcggtcagtttggtgttgggttctactctgcctaccttgtcgctgagaaggtggttgtgaccaccaagcacaacgatgatgagcagtacgtgtgggagtctcaggctggtggatccttcaccgtcacacgtgatacatctggtgagccccttggcaggggtaccaagatgaccctctacctcaaggatgatcagttggagtaccttgaggagcgtcgcctcaaggatctgatcaagaagcactctgagttt

SEQ ID NO: 48986 - protein, 201 aa, Panicum virgatum
  misc_feature: Ceres CLONE 2046961
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKTKLDAQPELFIHIIPDKATNTLTIVDSGIGMTKSDLVNNLGTIARSGTKEFMEALAAGADVSMIGQFGVGFYSAYLVAEKVVVTTKHNDDEQYVWESQAGGSFTVTRDTSGEPLGRGTKMTLYLKDDQLEYLEERRLKDLIKKHSE

SEQ ID NO: 48987 - DNA, 613 bp, Panicum virgatum
  misc_feature: Ceres CLONE 2046962
  misc_feature: Encodes the peptide sequence at SEQ ID NO. 48988
aaaaaaaaaaaaaactcccggcggcgcctccacatctcgtctctcagatcgagaggcgaaaccaagcaggaaaatatatatttgtagtgtgatcttcaaaagaagtcaagatggtgaagttcacggcagaggagctccgtgccatcatggacaaaaagaacaacatccgtaatatgtctgttattgcccatgtggaccacggcaagtctacccttacagactcccttgtggcagctgctgggattattgcccaggaagttgctggtgatgttcgcatgactgatacccgcgcagatgaagcagagcgtggtattacaatcaaatccaccggtatctctctttattatgagatgactccagagtcactgaagaattacaagggtgagagagatggtaaccagtacttgatcaaccttattgactcacctgggcacgtcgatttttcttcggaagtgacagctgcccttcgtattaccgatggtgctctagtggtggttgactgtattgaaggtgtctgtgtgcaaactgagactgtgctccgccaggctcttggtgagaggattaggccagtccttactgtgaacaagatggacaggtgcttccttgagcttca

SEQ ID NO: 48988 - protein, 167 aa, Panicum virgatum
  misc_feature: Ceres CLONE 2046962
  misc_feature (17)..(167): Pfam Name: GTP_EFTU Pfam Description: Elongation factor Tu GTP binding domain
  misc_feature: SWISSPROT Homolog: EC 2.7.7.4 Sulfate adenylyltransferase
MVKFTAEELRAIMDKKNNIRNMSVIAHVDHGKSTLTDSLVAAAGIIAQEVAGDVRMTDTRADEAERGITIKSTGISLYYEMTPESLKNYKGERDGNQYLINLIDSPGHVDFSSEVTAALRITDGALVVVDCIEGVCVQTETVLRQALGERIRPVLTVNKMDRCFLEL

SEQ ID NO: 48989 - DNA, 655 bp, Panicum virgatum
  misc_feature: Ceres CLONE 2047003
  misc_feature: Encodes the peptide sequence at SEQ ID NO. 48990
atctgccccccgtgcggcggcggcgacgcctccacctgacctggcctgcggcgacgactcctcatctgtccctctctgatcgtcgggtatcggccagatccgcgggggtgctgtgctccgcggaggccctagatcgcaccgcgtgcgatgccgcgcgacttgtcgaggtcgcgttcgccgccgcgccggcggcagcggtcgccgtcccccgcgcggtaccgtggccggatggggcgccgcgatcgaagcccaagccccgtccgtagcagatccccctatcgccccgcgtataggtgaccccagctaccctctcgcaccaccacagaaatccggcgactcttttttttatttaatttattttaggttgtactgtgaaaaaatatgaggcgatgctaatccgcttatggaatttttatactgtatagtttatttggtggaaatgggatgtgcgcttctgcttgtagttatcggatctatcaattgttgtatgagctagctagtgtcgtagtatgctgtggtataccatatttcaatcaattgttatttctatgaacatgtgcaatgttgatgatgcatgaggacgatacagatttctaaggaaaaaaaattacttgctgcgcagagtgaaaatcagcatgtaatgagcagataatgc

SEQ ID NO: 48990 - protein, 49 aa, Panicum virgatum
  misc_feature: Ceres CLONE 2047003
  misc_feature: Functional homolog of the protein sequence given in SEQ ID NO 50750
  misc_feature: Useful for making plants with modulated flowering time
  misc_feature: Functional homolog of the protein sequence given in SEQ ID NO 51759
  misc_feature: Useful for making plants with altered alkaloid content
MPRDLSRSRSPPRRRQRSPSPARYRGRMGRRDRSPSPVRSRSPYRPAYR

SEQ ID NO: 48991 - DNA, 730 bp, Panicum virgatum
  misc_feature: Ceres CLONE 2047011
  misc_feature: Encodes the peptide sequence at SEQ ID NO. 48992
tctggtactctgcctggttttttcccccatcggttctcttccccgccgccgctctgccctgtatccagtgtccaccccacctccgcccgcgtccacccaccccaccccgctcccagacctaaccgccggcgacgatgagcggcggcggcccgccgaggaagcgcaacttcaagatcgaggcgttcaagcaccgcgtggagctcgaccccaagtacgcggagcggacatggaaggtcctcgagcacgccatccacgagatctacaaccacaacgccagcgggctctccttcgaggagctttacaggagtgcctacaacatggtgcttcacaagtatggagagaagctctacgatggccttcagaacacaatgacatggcgattgaaggaaatatcgaaatcaatagagactgcgcagggtggtttatttctggaggagctgaatgcaaagtggatggatcacaacaaggcgctacagatgatccgagatattctaatgtacatggataggacatatgtcccgacagctcataggacacctgttcatgaactgggtctgaatttgtggagggatcatattattcactcccccatgatccatagtcggctgcttgacacccttctggatctaatagacagggaaagaatgggtgaagtgattaaccgtggcctgatgaggagcataacaaagatgctgatggatcttggtcctgctgtatatcaagatgattt

SEQ ID NO: 48992 - protein, 198 aa, Panicum virgatum
  misc_feature: Ceres CLONE 2047011
  misc_feature (32)..(198): Pfam Name: Cullin Pfam Description: Cullin family
  misc_feature: Functional homolog of the protein sequence given in SEQ ID NO 50517
  misc_feature: Useful for making plants with modulated biomass
MSGGGPPRKRNFKIEAFKHRVELDPKYAERTWKVLEHAIHEIYNHNASGLSFEELYRSAYNMVLHKYGEKLYDGLQNTMTWRLKEISKSIETAQGGLFLEELNAKWMDHNKALQMIRDILMYMDRTYVPTAHRTPVHELGLNLWRDHIIHSPMIHSRLLDTLLDLIDRERMGEVINRGLMRSITKMLMDLGPAVYQDD

SEQ ID NO: 48993 - DNA, 477 bp, Panicum virgatum
  misc_feature: Ceres CLONE 2047023
  misc_feature: Encodes the peptide sequence at SEQ ID NO. 48994
atccttatctgaagatctgataactgagatgtgccggtttgggggtgcagagattcatacagtggctgcttttattggtggcattgcttcccaagaagtaataaagctggtgaccaagcagtctgtgcccttgcggggaacatttatattcaacggaatcgacctcaaatctcaagttttggaactataatgtggctgtggaggctccatttgagatgccccagtttttttgtgccgtgacctcgcgcttcaatggaatcagtttgcccgtgtacttggccaagatcaggtctgaactggatcattgtaccgacgaggagcctaattcgcatgatatttagatgagtggcattctcgccatgtaggttcatataatctgctgctctgtttccaccttttgggacacggaaaatgaatccgagaaaagtggtcaatatttaagaatgcatctgaaatctatgtcactcccccatgttg

SEQ ID NO: 48994 - protein, 62 aa, Panicum virgatum
  misc_feature: Ceres CLONE 2047023
  misc_feature: Functional homolog of the protein sequence given in SEQ ID NO 50870
  misc_feature: Useful for making plants with modulated biomass
SLSEDLITEMCRFGGAEIHTVAAFIGGIASQEVIKLVTKQSVPLRGTFIFNGIDLKSQVLEL

SEQ ID NO: 48995 - DNA, 755 bp, Panicum virgatum
  misc_feature: Ceres CLONE 2047024
  misc_feature: Encodes the peptide sequence at SEQ ID NO. 48996
ctttgataatatgcccttctacattagtggcccactgggaatatgaaatagagaagtacatagacagctctatcatgaaacctcttcagtacgttggttcttcacaggacagagtcacactccgtagtcaattcgataagtttaatgttatcataacatcgtatgatattatacgcaaggatattgattttcttgggaatatcccttggaactactgtgttctggatgaagggcacataatcaaaaactcaagatctaaaatcacgtctgctgtgaaacagctgaaagcacaacaccgccttatcttgagtggcactcctatccagaataatgtcttggagctatggtctttatttgacttccttatgcctgggtttcttggtacagaaaaacaattccaagctacatatggaaaaccattactagcagccaaagattctaaatgttcagcaaaggatgctgaagctggtattcttgcaatggaagcgttgcataagcaggtcatgccatttctactgagaagaacaaaggatgaagttttgtctgatcttccagagaagattatccaggatagatattgtgatctgagtctgttgcagctcaaactttatgacaaattctccagctccaatgcaaaagaggagaattcaactatagtgaaagcaaatgaatcggaggaatctgcacctcagccaaaggcaactcgtcatgtgtttcagtcattgcagtacctattaaaactctgcagcaatcct

SEQ ID NO: 48996 - protein, 250 aa, Panicum virgatum
  misc_feature: Ceres CLONE 2047024
  misc_feature (1)..(249): Pfam Name: SNF2_N Pfam Description: SNF2 family N-terminal domain
LIICPSTLVAHWEYEIEKYIDSSIMKPLQYVGSSQDRVTLRSQFDKFNVIITSYDIIRKDIDFLGNIPWNYCVLDEGHIIKNSRSKITSAVKQLKAQHRLILSGTPIQNNVLELWSLFDFLMPGFLGTEKQFQATYGKPLLAAKDSKCSAKDAEAGILAMEALHKQVMPFLLRRTKDEVLSDLPEKIIQDRYCDLSLLQLKLYDKFSSSNAKEENSTIVKANESEESAPQPKATRHVFQSLQYLLKLCSN

SEQ ID NO: 48997 - DNA, 668 bp, Panicum virgatum
  misc_feature: Ceres CLONE 2047031
  misc_feature: Encodes the peptide sequence at SEQ ID NO. 48998
acagttttcagacaccagaacccagcaaaagcacgcagtgagacgcagggaaggctgctgccaatgttacgcgctctcctgccgaccagagagatcttccgtgctcaatccgcagtggccaaatttgtattatcacacaataatttggaaggcccactgtctcttgagatcggtaatcttcaacaactcactgaactatatgtttcgtccaataagcttactggggaaattccaactaccttaggaaattgtcaagggctacagatcatcgaaatggatcataatttcttcgaagggaatatttctactactctgagtgatctgaagagcctcaccctgttaaatctatcacacaacaatttgtccggtctcatcccaacagaactgggtgatctacaatatctcacccagctggacctctcttacaatgatctgcaaggtgaagtaccaaagaatggagtatttggaagtgccatatccgtgtcacttattggcaaccagcgactttgtggaggtgtgcaagatctacatatgcgcccatgtcccatggcctctcggagaaaagaaacacagtactacctaattaggatactcattccagtatttggtttcatgtcactcataatgttgatttattttctgattaccgagagggaaatgtccagacc

SEQ ID NO: 48998 - protein, 222 aa, Panicum virgatum
  misc_feature: Ceres CLONE 2047031
  misc_feature: SWISSPROT Homolog: EC 2.7.11.1 Non-specific serine/threonine protein kinase
TVFRHQNPAKARSETQGRLLPMLRALLPTREIFRAQSAVAKFVLSHNNLEGPLSLEIGNLQQLTELYVSSNKLTGEIPTTLGNCQGLQIIEMDHNFFEGNISTTLSDLKSLTLLNLSHNNLSGLIPTELGDLQYLTQLDLSYNDLQGEVPKNGVFGSAISVSLIGNQRLCGGVQDLHMRPCPMASRRKETQYYLIRILIPVFGFMSLIMLIYFLITEREMSR

SEQ ID NO: 48999 - DNA, 589 bp, Panicum virgatum
  misc_feature: Ceres CLONE 2047060
  misc_feature: Encodes the peptide sequence at SEQ ID NO. 49000
atcgagacaaaaatatcccccacccacgacgagcgccagcagcagccgcagccatggggatagccgtggtggctcccgtcgcggcggcctcctcctcctacctcggggcgccgccgaggcgcgccgcggcgccggcgcgcgcccacgtcgcggcggccgggatgtccgcgagggcgtcttccttcgtcgggaccgggctcgcgggggcggccgcgcggccgaggaggagggccggctcggggggcggcggggcgctcgggtgcaagtgcctgttcgggctcggggtgcctgagctcgcggttatcgccggcgtcgccgcgctcgtgttcgggcccaagcagctccccgagatcggccgcagcatcggcaagaccgtcaagagcttccagcaggcggctaaggagtttgaaactgaactgaagaaagagcctggggaaggcggcgatgagcccccgcctgcaacccccacggcggtaggcgatggggaggagaaaaagggggcttgaggcatcgtctagtagcaaggagcacacatgaggatccatcttgttagcgttctgtatgtacaactgtattctgggcttctgga

SEQ ID NO: 49000 - protein, 150 aa, Panicum virgatum
  misc_feature: Ceres CLONE 2047060
  misc_feature (76)..(128): Pfam Name: MttA_Hcf106 Pfam Description: mttA/Hcf106 family
MGIAVVAPVAAASSSYLGAPPRRAAAPARAHVAAAGMSARASSFVGTGLAGAAARPRRRAGSGGGGALGCKCLFGLGVPELAVIAGVAALVFGPKQLPEIGRSIGKTVKSFQQAAKEFETELKKEPGEGGDEPPPATPTAVGDGEEKKGA

SEQ ID NO: 49001 - DNA, 720 bp, Panicum virgatum
  misc_feature: Ceres CLONE 2047064
  misc_feature: Encodes the peptide sequence at SEQ ID NO. 49002
acgcagcactgttgcagtggcattgcaaggtcgtcaagccaagatggcagtgtcctccagaggcttagcgctagcgctcatcctaagcttctcctctctctgctacctcgccgctccatcctcagcagctacgactacctccgaccccgacggcttcctgcagtgcctgtcggggagcgtacccagcgggctcatctacacgcagggctcgagcaacttcaccgacgtgctggcgacctccgtccggaacccccgggtcttcaccggcgacacagcgcgcccgctctgcgtcgtcacggccaccgacgcctcccacgtgcaggccgccgtgcgctgcggccgcgcgcgcggcgtgcgcctccgcgtgcgcagcggcgggcacgactacgagggcctctcgtaccggtccctgcagcggggcgaggtgttcgcggtggtcgacctcgcgcgcctccgcgccgtcgccgtcagcgccggcggcggcggcgcgtggccggcggcccccacggcgtgggtcgagtccggcgccacgctcggggaactctactacacggtcgccgggaacaactccgggctcgcgttcccggcagggatctgcccgaccatcggcgtgggcggccacttgagcggcggcgggatcggcatgctcatgcgcaggttcgggctcgccgcccgacacgtcctcgacgccaagctggtgaccgccgacggcgacctcgt

SEQ ID NO: 49002 - protein, 225 aa, Panicum virgatum
  misc_feature: Ceres CLONE 2047064
  misc_feature (80)..(225): Pfam Name: FAD_binding_4 Pfam Description: FAD binding domain
  misc_feature: SWISSPROT Homolog: EC 1.21.3.3 Reticuline oxidase
MAVSSRGLALALILSFSSLCYLAAPSSAATTTSDPDGFLQCLSGSVPSGLIYTQGSSNFTDVLATSVRNPRVFTGDTARPLCVVTATDASHVQAAVRCGRARGVRLRVRSGGHDYEGLSYRSLQRGEVFAVVDLARLRAVAVSAGGGGAWPAAPTAWVESGATLGELYYTVAGNNSGLAFPAGICPTIGVGGHLSGGGIGMLMRRFGLAARHVLDAKLVTADGDL

SEQ ID NO: 49003 - DNA, 706 bp, Panicum virgatum
  misc_feature: Ceres CLONE 2047077
  misc_feature: Encodes the peptide sequence at SEQ ID NO. 49004
gacggcctgacgggtttagtagggttcagactccgcttgtctcgcttcccatggcggcggcggaggcggcgccgccgcccgaagcgagcggcttctatgctggtgccggcggcctctccaccggccggaagctggtgccgtggtcgagctgggcagagtggagcttcgtgcgcgacggcctcttctcccccttccccgcagccgctcttcgcagggtaacaccctcctccccatagcacaagggtgtgatttttctgagtgtttcgttgattggttcagatcgctgcgtggcggagcaggggctccgtcctgatccccgtggacgttaccgcagccttcgtcgagatacggctgcgggatcccttcttccggagcggattggctggtgatgataccatggagtcggaggaaatgctcgcgatgctgtacagtatggcaatcatgaggcttgtaaatggttttgtggagaatcaacataagaaaactggccgttcaatatctgaactagctgaggctgttggaataccacgagttctggtggacattcgccatgaaagttcccatcgcaaccttccctccctgcgactgttacacctggcaagtattaaggcatttgattggttgaagtgtatttactgggatcgccagactaattccattcctgatgttcaagtggaactgaggtcgagattgcatgagatttctt

SEQ ID NO: 49004 - protein, 103 aa, Panicum virgatum
  misc_feature: Ceres CLONE 2047077
  misc_feature (1)..(84): Pfam Name: Las1 Pfam Description: Las1-like
MESEEMLAMLYSMAIMRLVNGFVENQHKKTGRSISELAEAVGIPRVLVDIRHESSHRNLPSLRLLHLASIKAFDWLKCIYWDRQTNSIPDVQVELRSRLHEIS

SEQ ID NO: 49005 - DNA, 694 bp, Panicum virgatum
  misc_feature: Ceres CLONE 2047085
  misc_feature: Encodes the peptide sequence at SEQ ID NO. 49006
gtcgtcaaagcccgagagaaccagcaagctagctactggagcgttcagccagagacaaacgcacaccacgaagctcgcggagcatctcaggcaggcagcaagaagagcacggcagcggcgagatggcgcaggagggcctaaggctgtcagcgagcgcggcggcgccggtggcgcaggagagcctgaggctggtgtcgcactcgatcgcgtcgcacgacgggcggctgccgcggcagtacacggcggaggggcagggcgcgaagaaggacatgtcgccggcgctggagtggtacggcgtccccgagggcacgcggtcgctggcgctggtggcgcaggacatcgacgcggaccccgccgtgccgtggacgcactgggtggtggccaacatcccgcccgacaccaagggcctccccgaggggttctccggcaaggagggcgcggcagggcgcgagttcggcggcctgcaggagggcgtaaacgactggaagcagcccgggtggcgcgggcccgtgctgccgtcccgcggccaccgcatccagttcaagctctacgcgctcgacgacgagctgcacctcggcaacaaggtgagatgctctcttctgaagtctgactccggatcttattggcgtactcatactggggtgctgatcagactggtgtgccatgattttctattttttttaaaaatctttgc

SEQ ID NO: 49006 - protein, 190 aa, Panicum virgatum
  misc_feature: Ceres CLONE 2047085
  misc_feature (30)..(158): Pfam Name: PBP Pfam Description: Phosphatidylethanolamine-binding protein
MAQEGLRLSASAAAPVAQESLRLVSHSIASHDGRLPRQYTAEGQGAKKDMSPALEWYGVPEGTRSLALVAQDIDADPAVPWTHWVVANIPPDTKGLPEGFSGKEGAAGREFGGLQEGVNDWKQPGWRGPVLPSRGHRIQFKLYALDDELHLGNKVRCSLLKSDSGSYWRTHTGVLIRLVCHDFLFFLKIF

SEQ ID NO: 49007 - DNA, 718 bp, Panicum virgatum
  misc_feature: Ceres CLONE 2047087
  misc_feature: Encodes the peptide sequence at SEQ ID NO. 49008
gagcatccaagctcatacttccagttcaaacatcgtttccaggcaagactaggggtggtaaagggccggactctaatcttatataattttgagctaaaaaatttaaaagtcttgttaggttgtgaaaaggccactggagctataactcattaccaccgagaccaagccgatcagaaaggccgctgtctccggcacaagcagaggtggcagttaagtgcatcatgtgtcattccaagcagctggtgaaagtcgccatgcccatgcttatactattgccgttgctgctgctgtgctatggagttggaaacatccattgctcaaccgttcatgataacagcggagatctgaaggcactcctcgatttcaggcagggcatccccagcgatccatatggagccatgagcaattggaccatgaactcccacttctgtcggtggaatggtatcacgtgcacctggacacgacgacagtggcgtgtcctgtcgctcaccctcaccgggaaaggtttatctggccaaatcagctcctctcttggcaaccttaccttccttaattatcttgacctctctgacaataacttctttggtcccttgcctcttcttggtggcctccaccaactgcagaacctttatctttacagcaacaatttgtctgggaacattccggatgcacttacaaactgctccaacctgatcgacttagacatctctttcaactc

SEQ ID NO: 49008 - protein, 165 aa, Panicum virgatum
  misc_feature: Ceres CLONE 2047087
  misc_feature (38)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MCHSKQLVKVAMPMLILLPLLLLCYGVGNIHCSTVHDNSGDLKALLDFRQGIPSDPYGAMSNWTMNSHFCRWNGITCTWTRRQWRVLSLTLTGKGLSGQISSSLGNLTFLNYLDLSDNNFFGPLPLLGGLHQLQNLYLYSNNLSGNIPDALTNCSNLIDLDISFN

SEQ ID NO: 49009 - DNA, 658 bp, Panicum virgatum
  misc_feature: Ceres CLONE 2047089
  misc_feature: Encodes the peptide sequence at SEQ ID NO. 49010
aaaagcgctgtcgcccacaccctctccgtcccctccgccccctccccttccgcgcccgccggatctccaaccgccgttcaggatccagatgttagtggcagaggtgctcagggcaggaccatacatctctaggttttctcgacatgcatggttgcgagattttccggcattggttgttcagttgtttcacaatttaaaaaacctcaatttctggacttgctcagcaaaataagttcgttccgctgtagtcaatcccgactggtagcaatggcaaccgctccagccaatggtaattcgcagagtggccctcagcggaactatcaggttgttgttgctgccacttgtgacttgggcattgggaaggatgggatcttgccatggaagcttcctggtgaccttaagttcttcaaggagcttacgcgttcaacatctgaccctggcaagaagaatgcagttataatgggaaggaaaacatgggagagcattcctgttaagttgaggccattgcctggtcgtttgaatgtcatacttactcgttctggtagttttgattttgcaacagtagaaaatgttgttatctgtggaagcatgaagtctgccttagaattgctagcatcaactccatattgcttatcaattgagaaagtttttgttataa

SEQ ID NO: 49010 - protein, 170 aa, Panicum virgatum
  misc_feature: Ceres CLONE 2047089
  misc_feature (57)..(170): Pfam Name: DHFR_1 Pfam Description: Dihydrofolate reductase
  misc_feature: SWISSPROT Homolog: EC 1.5.1.3 Dihydrofolate reductase
MVARFSGIGCSVVSQFKKPQFLDLLSKISSFRCSQSRLVAMATAPANGNSQSGPQRNYQVVVAATCDLGIGKDGILPWKLPGDLKFFKELTRSTSDPGKKNAVIMGRKTWESIPVKLRPLPGRLNVILTRSGSFDFATVENVVICGSMKSALELLASTPYCLSIEKVFVI

SEQ ID NO: 49011 - DNA, 700 bp, Panicum virgatum
  misc_feature: Ceres CLONE 2047099
  misc_feature: Encodes the peptide sequence at SEQ ID NO. 49012
gtccgcagcccgcccgcgccccaacacagacccgcacccgcgcgccccagccagcccaggcaggcagccagccagcaccccttgccgccggcggccgcattgccccctcgcggcgcctccggagcgagcgatggacgcggcggcggggctgccggaggcgtggtcgcaggtgcgcgcgccggtgatcgtgccgctgctgcggctggcggtggccgtgtgcctcaccatgtccgtgctgctcttcctggagcggatgtacatggccgtcgtcatcgccggggtgcgcctgctgcggctccgccccgaccgccgctaccgctgcgaccccatccccgacgacgacccggagctcggctccgccgccttcccctccgtgctcgtccagatccccatgttcaacgagcgcgaggtataccagctgtcgatcggcgcggtgtgcgggctggcgtggccgtcggaccggctggtggtgcaggtgctcgacgactccacggacgaagtgattaaggaaatggtgcgggcggagtgcgagcggtgggcgcgcaagggcgtgcgcatcacgtaccagatccgggaggaccggcgcgggtacaaggccggcgcgctccgggccgggatgaagcacgcctacgtgcgggactgcgagtacgtggccatcttcgacgccgacttccagcccgaccccaacttcctccgccgc

SEQ ID NO: 49012 - protein, 189 aa, Panicum virgatum
  misc_feature: Ceres CLONE 2047099
  misc_feature: SWISSPROT Homolog: EC 2.4.1.12 Cellulose synthase (UDP-forming)
  misc_feature: Functional homolog of the protein sequence given in SEQ ID NO 51028
  misc_feature: Useful for making plants with altered cell wall content and/or composition
  misc_feature: Functional homolog of the protein sequence given in SEQ ID NO 51760
  misc_feature: Useful for making plants with altered carbohydrate content
MDAAAGLPEAWSQVRAPVIVPLLRLAVAVCLTMSVLLFLERMYMAVVIAGVRLLRLRPDRRYRCDPIPDDDPELGSAAFPSVLVQIPMFNEREVYQLSIGAVCGLAWPSDRLVVQVLDDSTDEVIKEMVRAECERWARKGVRITYQIREDRRGYKAGALRAGMKHAYVRDCEYVAIFDADFQPDPNFLR

SEQ ID NO: 49013 - DNA, 715 bp, Panicum virgatum
  misc_feature: Ceres CLONE 2047107
  misc_feature: Encodes the peptide sequence at SEQ ID NO. 49014
accaagggagcagcacccgcgcatgtttacccgcttcgccgggcgcgcctcctccaccgcatcgagcatcgtcgccagcagcctcgccgcccccgcccccgcgccgtcgcccaagccccgcagccccgcctccgccgcccgccccaggctcatcatgagcaagcccgtcttcgccgcccccagcgccgtcgtgggcatggacgccgtcgagcgcttgaagagcgggttcgagcagttcaagacccaggtctatgacaagaagccggagctgttcgagccgctcaaggccggccaatcccccaggtacatggtgttcgcctgcgccgactcccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgccctcaaggtggaggtcctcaccgtcattggccacagccgctgcggtggcatcaaggcgctcctctccctccaggacggcgcagccgacaccttccacttcgtcgaggactgggtcaggatcggcttccaggccaagaagaaggtgctgaaagagcacccccatgctccgttcgatgaccagtgctccatcttggagaaggaggccgtgaacgtgtccctctacaacctcttgacctacccctgggtc

SEQ ID NO: 49014 - protein, 230 aa, Panicum virgatum
  misc_feature: Ceres CLONE 2047107
  misc_feature (88)..(229): Pfam Name: Pro_CA Pfam Description: Carbonic anhydrase
  misc_feature: SWISSPROT Homolog: EC 4.2.1.1 Carbonate dehydratase
MFTRFAGRASSTASSIVASSLAAPAPAPSPKPRSPASAARPRLIMSKPVFAAPSAVVGMDAVERLKSGFEQFKTQVYDKKPELFEPLKAGQSPRYMVFACADSRCCPSVTLGLQPGEAFTMRNIAAMVPPYDKNKYAGIGAAIEYAVCALKVEVLTVIGHSRCGGIKALLSLQDGAADTFHFVEDWVRIGFQAKKKVLKEHPHAPFDDQCSILEKEAVNVSLYNLLTYPW

SEQ ID NO: 49015 - DNA, 655 bp, Panicum virgatum
  misc_feature: Ceres CLONE 2047112
  misc_feature: Encodes the peptide sequence at SEQ ID NO. 49016
ctcttctccccatctccatttttttcctcctatggtttttgcattttagcccctcaagaagctgcgattttgtgtccgatccgtcggctcgattctgcgtgtgctctgcttcgatcgggcgcgccggccgttggaagatccctgcgaggctcctcgtttagcgggctgctgattcccccctcctcaggaagtcaagtaagggctttcttccggaggagctcttccagttccttaactttgcgcgccgtggctatttaatctccattccaatccaagattcgcaatcgtgtgaaactgggaactccggaatttgtttggataaggtgttctaggaatggggaatcaatgcccaaacgggactcttgggagtgattactacaatcgtcccgcttctaggttcgctgatggatacctcgaggaggatcgctactctgacttgaagaagtttgagaagccatggcctgaggtgaactcatttaagcccactgctgctggtattctgaagcggggattggatccaacatctatcactgtccttgaaaggaagacatcggacctaagggaacattatatcattggtcgaaagcttggtcaagggcagtttggcacaacatacctttgcacggagatcagtactgggtgtgagtatgcatgc

SEQ ID NO: 49016 - protein, 106 aa, Panicum virgatum
  misc_feature: Ceres CLONE 2047112
  misc_feature: SWISSPROT Homolog: EC 2.7.11.1 Non-specific serine/threonine protein kinase
MGNQCPNGTLGSDYYNRPASRFADGYLEEDRYSDLKKFEKPWPEVNSFKPTAAGILKRGLDPTSITVLERKTSDLREHYIIGRKLGQGQFGTTYLCTEISTGCEYA

SEQ ID NO: 49017 - DNA, 735 bp, Panicum virgatum
  misc_feature: Ceres CLONE 2047131
  misc_feature: Encodes the peptide sequence at SEQ ID NO. 49018
accaccaggggagaacaaaatacaaccaggcatctgatccacacaacattagctaggtagcgagacctgtcgcgaggaaccacccaccggagcagcatggagtacggccagcaggggcagcacggccacggaaacaccggccgcgtcgaccagtacggcaacccggtcggcggcgtcgggcacggcaccaccgggaccggcggcatggggtacggtggtactaccggaaccggcggcatgggccagctgggagagcacggcggcgccggcatgggtggcggccagttccagcctgtgagggaggagcacaagacaggcggcattctgcaccgctccggcagctccagctccagctcgtccgaggacgacgggatgggcgggaggaggaagaagggcatcaaggagaagatcaaggagaaattgcccggaggccacaaggacaaccagcacaccgcggccaccggcggtgcctacgggcagcagggacacaccggcatgaccggcacaggaaccggcggcgcctacaccaccgagggcgccggcgagaagaagggcatcatggacaagatcaaggagaagttgcccggacagcactaagcgcggctaccttatacacgctagaagccgtgctagcctgtcacggcgtttcgagagaatataagacgaacagagcaggaataaagtgtctcttgatcgcggccgctcgcgtggagcggacggtcagcacctgtgtgt

SEQ ID NO: 49018 - protein, 166 aa, Panicum virgatum
  misc_feature: Ceres CLONE 2047131
  misc_feature (14)..(166): Pfam Name: Dehydrin Pfam Description: Dehydrin
MEYGQQGQHGHGNTGRVDQYGNPVGGVGHGTTGTGGMGYGGTTGTGGMGQLGEHGGAGMGGGQFQPVREEHKTGGILHRSGSSSSSSSEDDGMGGRRKKGIKEKIKEKLPGGHKDNQHTAATGGAYGQQGHTGMTGTGTGGAYTTEGAGEKKGIMDKIKEKLPGQH

SEQ ID NO: 49019 - DNA, 648 bp, Panicum virgatum
  misc_feature: Ceres CLONE 2047136
  misc_feature: Encodes the peptide sequence at SEQ ID NO. 49020
aaaaaatcactagaccagttcctctgttcctgcacgagctcaatcaagctcgaggccaatggagaccccagctcgtcctccgcagcagcagatgcacttcctgttcgtgaccagcccgctgcagggccacatcaacccggtgcgccgcctggccgcccgagtgatggcggccaatccggacgcgctcgtcaccttctccaccgccgtctccgggcaccgccgcatgttcccctccctggcgcgccccgacgacgaggccgtggacgccgcgggcgtgctgcacgtccccttctccgacgggttcgacgacggtttcagctccgcggcgcacggcgcgggcacctacagggcccgcgccagcgcggccgggcgcgcgacgctgtccgccgccgtgtcgcgcctcgccgcgcgggggcgccccgtgacgcgcgtggtgtacacgttcctcgtgccgtgggtgcccgacgtcgcgcgcgcgcacggcatccccgcggcgctcttctggatccagccggccgccgtgctcgccgtgtactaccattacttccacggccacgccgcggccctcgccgcgtgcgcgaacggcgcggcggaccccggcgccgcggccgcgtgcctgccgggcctgccgccgctcgaggccagtgc

SEQ ID NO: 49020 - protein, 196 aa, Panicum virgatum
  misc_feature: Ceres CLONE 2047136
  misc_feature: SWISSPROT Homolog: EC 2.4.1.210 Limonoid glucosyltransferase
  misc_feature: Functional homolog of the protein sequence given in SEQ ID NO 51387
  misc_feature: Useful for making plants with altered carbohydrate content
METPARPPQQQMHFLFVTSPLQGHINPVRRLAARVMAANPDALVTFSTAVSGHRRMFPSLARPDDEAVDAAGVLHVPFSDGFDDGFSSAAHGAGTYRARASAAGRATLSAAVSRLAARGRPVTRVVYTFLVPWVPDVARAHGIPAALFWIQPAAVLAVYYHYFHGHAAALAACANGAADPGAAAACLPGLPPLEAS

SEQ ID NO: 49021 - DNA, 624 bp, Panicum virgatum
  misc_feature: Ceres CLONE 2047143
  misc_feature: Encodes the peptide sequence at SEQ ID NO. 49022
caaaattcgggacataaatgcatgttcagcacagtttcagaatgctgtggtcaaagattcctcgatatccattaatcgagttacctggagccctgatggagaattgattggagtcgcattcacaaaacatttgatccatctacatgcttatcaacagccaaatgagacacgccatgttctagagattgaggctcattctggaggagtaaatgacatagctttctcccgaccaaacaagcaactttgtgttgtcacctgtggagatgataaactaataaaggtttgggatatgcacggacagaaactattcacatttgaaggacatgaggcgcctgtgtattctatctgtcctcatcataaagagagtattcagttcatcttctcaacttccctcgatggaaaaataaaggcctggctttatgacaatatgggatctagggtggactatgatgctcctggaaagtggtgtactactatgctctatagtgctgatggaactaggttgttctcatgtggaacgggcaaagagggagactcatatttggttgagtggaatgaaagtgaaggatctattaagaggacatattctggatttcgtaaaagatctgctggtgttgctggtgt

SEQ ID NO: 49022 - protein, 207 aa, Panicum virgatum
  misc_feature: Ceres CLONE 2047143
  misc_feature (56)..(96): Pfam Name: WD40 Pfam Description: WD domain, G-beta repeat
  misc_feature (99)..(139): Pfam Name: WD40 Pfam Description: WD domain, G-beta repeat
  misc_feature: SWISSPROT Homolog: EC 2.3.1.48 Histone acetyltransferase
KIRDINACSAQFQNAVVKDSSISINRVTWSPDGELIGVAFTKHLIHLHAYQQPNETRHVLEIEAHSGGVNDIAFSRPNKQLCVVTCGDDKLIKVWDMHGQKLFTFEGHEAPVYSICPHHKESIQFIFSTSLDGKIKAWLYDNMGSRVDYDAPGKWCTTMLYSADGTRLFSCGTGKEGDSYLVEWNESEGSIKRTYSGFRKRSAGVAG

SEQ ID NO: 49023 - DNA, 457 bp, Panicum virgatum
  misc_feature: Ceres CLONE 2047164
  misc_feature: Encodes the peptide sequence at SEQ ID NO. 49024
tgatggtgaagttgcagagttcgacacaccccagaagcttttagaggacaagtcatctatgttcatgcagctagtatctgaatactccactcggtcgagctgtatataagagaggcttagcttaaacccacccccaaaccaagaaatagagtatgggaggtaaaatagccgtatctgccagtgtacttacaccatagaggtttgcaccgacagcataggtgagatagaaaacaaggtgtatatgagtgggaggaacacttggttgctccctgacctgaacaaccatggaatctgagggaacacagttggtaggcacgggagaagttggcgacactagtacattacccaaagctgatgcgtatgtatgtatgtacaacaacaatgcatactgctttctcccttgcaaagtggagaatgaagggaataacgtgcgtaataagagtgggggggttttctc

SEQ ID NO: 49024 - protein, 35 aa, Panicum virgatum
  misc_feature: Ceres CLONE 2047164
  misc_feature: SWISSPROT Homolog: EC 3.6.3.44 Xenobiotic-transporting ATPase
DGEVAEFDTPQKLLEDKSSMFMQLVSEYSTRSSCI

SEQ ID NO: 49025 - DNA, 527 bp, Panicum virgatum
  misc_feature: Ceres CLONE 2047166
  misc_feature: Encodes the peptide sequence at SEQ ID NO. 49026
agcacgcaccagtgtacaaacaatacaactatccgtagcgaccttgaaaaggcagctcggtagcctaggcgcggcggcagggggaacaaggtaaccggagagagagagagagagagagagcacgcggcgatgctggactgggcgccggtggtggtgggcgtggcgctcttcgtggtgctgtcgccgggcctgctcatcgagttccccggcacgcgccgctgggtcgacttcggcagcctgcgcgtcaccggcaaggccgccaccatccacaccctcatcttcttcgccctcttcgccatcatcaccatggcctgcaacctccacatctacacctagccgcccgcccgacgacagctagctgctgacggtcgtctcgtcgagtcggacctacctcttcatcgctatctgttcgtcactaccaccgtaccagtgttgtctttgtgcaccggccacactacgctcgcctagctagttaacggccggcggcctatccggcggctatgcgtaaagcctctgttcatctttcg

SEQ ID NO: 49026 - protein, 68 aa, Panicum virgatum
  misc_feature: Ceres CLONE 2047166
  misc_feature: Functional homolog of the protein sequence given in SEQ ID NO 50117
  misc_feature: Useful for making plants with altered cell wall content and/or composition
MLDWAPVVVGVALFVVLSPGLLIEFPGTRRWVDFGSLRVTGKAATIHTLIFFALFAIITMACNLHIYT

SEQ ID NO: 49027 - DNA, 716 bp, Panicum virgatum
  misc_feature: Ceres CLONE 2047183
  misc_feature: Encodes the peptide sequence at SEQ ID NO. 49028
accaatttcttcaacactggtgactgctctaccaccgtggccactagcctttgcaggtgcagcccagtcctcccatggcgaccggtgactcgagtgttcaagtaggccccgtcccgttcaaggacgtcgaggacgacggcgacatggtcaccgccctgccggagagaccctcggaagagcacgtcggcctggtctccgccctaccatgctgtacgatcgccgacatgaagctccgctgctaccaggggttctggctaccggagggcatggtcccggcggccgccgccctccagcgccgcttcgagccccggcccagcgacgtcatcgtggccagcctgcccaagtgcggcaccacgtggctcgtcgccctggcgttcgccacgctggcgcgccgcgcgtacccgcccggcgccgccgaccacccgctccgccgcctcaacccgcaccagtgcctcccgttcctggaggggctgttcgccggcggccgggagggcaagctcgacgcgctcccgtccccgcgcctcatgaacacgcacatgccgctcgccatgatcccgggagccgtgccggccggcggcggctgcaaggtcgtgtacatctgcagggagcccaaggacatggtcgtctccctgtggcactacctccggcgactgcacccggacctggagttcagcgaagtcttcgacatggcctgcgacggcaccacgctatggggg

SEQ ID NO: 49028 - protein, 213 aa, Panicum virgatum
  misc_feature: Ceres CLONE 2047183
  misc_feature (80)..(211): Pfam Name: Sulfotransfer_1 Pfam Description: Sulfotransferase domain
  misc_feature: SWISSPROT Homolog: EC 2.8.2.1 Aryl sulfotransferase
MATGDSSVQVGPVPFKDVEDDGDMVTALPERPSEEHVGLVSALPCCTIADMKLRCYQGFWLPEGMVPAAAALQRRFEPRPSDVIVASLPKCGTTWLVALAFATLARRAYPPGAADHPLRRLNPHQCLPFLEGLFAGGREGKLDALPSPRLMNTHMPLAMIPGAVPAGGGCKVVYICREPKDMVVSLWHYLRRLHPDLEFSEVFDMACDGTTLW

SEQ ID NO: 49029 - DNA, 394 bp, Panicum virgatum
  misc_feature: Ceres CLONE 2047188
  misc_feature: Encodes the peptide sequence at SEQ ID NO. 49030
tgttttcttgctatcccaagtgtatgattagtacttcatgttgctgtgttgagaagcacacgcttgaatccaaagaattccttttttccagttcaatttttgcccagaggaccatatggatattacgccgtgttccattagggcactcgaggggttatatgacatatcgggtgtagaagtcggccaagtgttctgttggcagataggaggttttcgcatgcatcgcccgaatactcatcacttctagggtcggacctactattcggcacggttcagaggattactagttgttcggaatccacgaaccttcccgactgacggtcagaaatttttcgaattggttcttgagtttattcgagacttgatcataactgagattggagaagaatatggt

SEQ ID NO: 49030 - protein, 43 aa, Panicum virgatum
  misc_feature: Ceres CLONE 2047188
  misc_feature: SWISSPROT Homolog: EC 3.6.3.14 H(+)-transporting two-sector ATPase
MDITPCSIRALEGLYDISGVEVGQVFCWQIGGFRMHRPNTHHF

SEQ ID NO: 49031 - DNA, 714 bp, Panicum virgatum
  misc_feature: Ceres CLONE 2047200
  misc_feature: Encodes the peptide sequence at SEQ ID NO. 49032
aaacgctgaaatacccagacaagagatcgagagagagagagatctcttttaagagagagagagagcgcgcgcgcacggaagatgctggcgtttactacagagctcctcaatgttcccttgcttcgccagccgacgcccggcgtacaacagccatggcggcggcctttcctacagctgcaccctcgccgtcgaccatgtgggcccgcgctaataagcaaatcgccatactcggagtctggaaaagcacgggaacaggcagttgatggacatcttgaacaaaaggatgaaccaaaggaaacggaaagcatggttgatgccatcagaacagcattgaggtcaatcggagagggtgagatcaccatttcagcctatgacacggcaatggtagcccttctcaggaacccagatgggggtgatgtgccactgttcccatcgacctttgactggatcatccagaatcagctacccgatggttcatggggtgatgaagccttctacatgatcagcgacaggatcatgagcaccctagcatgtgttgtggcattgaagacttggaacatccatgccgataaatgcgagagaggtcagttatttatcaaagaaaatatttggaggttggcacacgaggaagaggattggatgctagtcggattcgagattgccttgccgtcactcctagacatggccaaaggatctgacctcgacatcccctac

SEQ ID NO: 49032 - protein, 210 aa, Panicum virgatum
  misc_feature: Ceres CLONE 2047200
  misc_feature: SWISSPROT Homolog: EC 5.5.1.13 Ent-copalyl diphosphate synthase
MLAFTTELLNVPLLRQPTPGVQQPWRRPFLQLHPRRRPCGPALISKSPYSESGKAREQAVDGHLEQKDEPKETESMVDAIRTALRSIGEGEITISAYDTAMVALLRNPDGGDVPLFPSTFDWIIQNQLPDGSWGDEAFYMISDRIMSTLACVVALKTWNIHADKCERGQLFIKENIWRLAHEEEDWMLVGFEIALPSLLDMAKGSDLDIP

SEQ ID NO: 49033 - DNA, 682 bp, Panicum virgatum
  misc_feature: Ceres CLONE 2047203
  misc_feature: Encodes the peptide sequence at SEQ ID NO. 49034
acagctagcggcggcctgtcaactgtcatacccatccctctcgccccgggatctctctcctctcggccagccatggcggagcggctggaggcggcgccgggcgccggcgacgagtacacgcaggacggcacggtggacctccacggcaaccccgtgctccggtccaagcggggagggtggaaagcctgcggcttcgttgtagtgtacgaggtgttcgagcggatggcgttctacggcatctcgtcgaacctggtgctgtacctgacgacgaagctgcaccagggcgtggtgccgtcggcgaacaacgtcaccaactgggtgggcaccatctggatgacgcccatcatcggcgcctacgtcgccgacgcgcacctcggccgctaccgcaccttcatggccgcctccgtcatctacctctgcggcatgatcctgctgacgctggcggtgtcgctgccggcgctgcggccgcccaagtgcggcgacggcacggcggacccgaactgcacgcacgaggcgacgagcgcgcagctgggcgtcttcttcctgggcctgtacatcctggccgtgggcacgggcggcaccaagcccaacatctccaccatcggcgccgaccagttcgacgacaaccacccgcgggagcgccgcacaagctctccttctttcactggtggatgttcagcat

SEQ ID NO: 49034 - protein, 203 aa, Panicum virgatum
  misc_feature: Ceres CLONE 2047203
  misc_feature: Functional homolog of the protein sequence given in SEQ ID NO 50283
  misc_feature: Useful for making plants with altered carbon content
  misc_feature: Useful for making plants with altered nitrogen content
MAERLEAAPGAGDEYTQDGTVDLHGNPVLRSKRGGWKACGFVVVYEVFERMAFYGISSNLVLYLTTKLHQGVVPSANNVTNWVGTIWMTPIIGAYVADAHLGRYRTFMAASVIYLCGMILLTLAVSLPALRPPKCGDGTADPNCTHEATSAQLGVFFLGLYILAVGTGGTKPNISTIGADQFDDNHPRERRTSSPSFTGGCSA

SEQ ID NO: 49035 - DNA, 736 bp, Panicum virgatum
  misc_feature: Ceres CLONE 2047209
  misc_feature: Encodes the peptide sequence at SEQ ID NO. 49036
gccaccttcgtctccggcggccagacagcgcaattgctggtccagaacggcctgcagagccagcagttcgccaccgtgcgctacttccccgcggacaacaggaagtactgctacaccatgaacgtcaggaacaggacgcgctacctcgtcagagccaccttcctctatggcaacttcgacaacagcaacgtctatccgaagttcgacatctccctgggagcgtctccctggtccaccattgtcgtagacgacgccaccacccccgtcgttgaggaagcaattatcttggctgctgctcccacgctcagcgtctgcctctccaatgccagcacgggacagcccttcatctctactctcgagctccgccagtttaacggttcgctctactacaccactgatgaggcacgcttctttcttgcactgtctgcaaggataaattttggagcagaaagcaatgattcagtcagataccctgatgacccatttgatagaatctgggaatctgattctgtgaggagagcaaattaccttgttgatgttgctccagggactgaaagaatatcaactacaaagcccatatttgtcagtatcaacgaagaaccgcctgaaaaggtcatgcaaacagcagtagttggccaggatgggtccttgaactaccgtcttgatttggaaggtttcccagcaaatgcatggggcgtctcgtattttgcagaaattgaagatttagcaccaaatg

SEQ ID NO: 49036 - protein, 245 aa, Panicum virgatum
  misc_feature: Ceres CLONE 2047209
  misc_feature: SWISSPROT Homolog: EC 2.7.11.1 Non-specific serine/threonine protein kinase
ATFVSGGQTAQLLVQNGLQSQQFATVRYFPADNRKYCYTMNVRNRTRYLVRATFLYGNFDNSNVYPKFDISLGASPWSTIVVDDATTPVVEEAIILAAAPTLSVCLSNASTGQPFISTLELRQFNGSLYYTTDEARFFLALSARINFGAESNDSVRYPDDPFDRIWESDSVRRANYLVDVAPGTERISTTKPIFVSINEEPPEKVMQTAVVGQDGSLNYRLDLEGFPANAWGVSYFAEIEDLAPN

SEQ ID NO: 49037 - DNA, 701 bp, Panicum virgatum
  misc_feature: Ceres CLONE 2047225
  misc_feature: Encodes the peptide sequence at SEQ ID NO. 49038
aaaaagcaacaccaggagcttgcattgggagcaacacaaatggaagaccaccatcactacctctaccttggattagctctcgtctcgctgctcgtcatcatgctggcgcagcgccgccggcgctccgccatggagcacgggcacggcctgcggctgccacccgggccatggcagctgccaatcctcggcagcctgcaccacatgatcggcaagctcccgcaccacgcgttgcgtgacctcgcgcggcgccacgggccgctcatgctggtccggctcggcgaggtgcccacgctggtggtgtcgtcccgggaggcggcgcgggaggtgatgaagacgcacgacacggtgttcgcgacgcggccgctgagccccaccatgcgggcgctcaccaagggcggccggggaatcatcatggcgccctacggggcacactggcggcagctccgccggatcaccatcaccaagctcctcagcgcgcgccgcgtcaactccttccgcgccgtccgcgaggaggaggccgccgctatgctgcgcgcgtgcgccgccgccgcggcggcggggcctcgctctcgccccgtggacatgcgcgcgcggctgtccgcgctcatcacggacaccacgatgcgcgccgcgatgggcgaccggttcaaggaccgcgaggtcttcctacgggcgctcgaccgcgccatcgtgctctccgc

SEQ ID NO: 49038 - protein, 220 aa, Panicum virgatum
  misc_feature: Ceres CLONE 2047225
  misc_feature: SWISSPROT Homolog: EC 1.14.13.68 4-hydroxyphenylacetaldehyde oxime monooxygenase
MEDHHHYLYLGLALVSLLVIMLAQRRRRSAMEHGHGLRLPPGPWQLPILGSLHHMIGKLPHHALRDLARRHGPLMLVRLGEVPTLVVSSREAAREVMKTHDTVFATRPLSPTMRALTKGGRGIIMAPYGAHWRQLRRITITKLLSARRVNSFRAVREEEAAAMLRACAAAAAAGPRSRPVDMRARLSALITDTTMRAAMGDRFKDREVFLRALDRAIVLS

SEQ ID NO: 49039 - DNA, 692 bp, Panicum virgatum
  misc_feature: Ceres CLONE 2047229
  misc_feature: Encodes the peptide sequence at SEQ ID NO. 49040
accgcagcctctcgccggctcgccgcgacgcgcggaaaccctagccccacccgccggtgcccctccccctcctcgctcgccccgtccgttctccggtccggtgagccatggcaagcttcggcgtcgacacccggccggccgccgcggcctcgggcggcggcggcggcggggcgggagcggcggggaccggggagggcgcgctgtccttcctctcgcgcagcctgcgggaggacctccgcctcatccgcgcgcgggccggggagctcgagacgttcctcagcgcgccggtggcggagcccgagctgctggcgcgcctccgccgcgcctactcctcctcggcctcctccgcgcggacgcggctggacctgtcggcgatcgggaaggcgttcgaggccgagtcgtggaggggcgcccggggccgggccaggtgggggtgggaggaggaggccgaggagtgggagcccgtgcggatggtcaaggcgcgcctcagggagctcgagcggagcacgcagggccagtccgccaccgacatgctgcacaaggtcaagctcagcttgaaatcaatgagctttgcacctgaagcatccgaggatgttccaccactggatttaggagaactttttgcttattttctaaagcaatctgtaccattatttgatcaacttggtataaaaagagatgtatgcgacaag

SEQ ID NO: 49040 - protein, 194 aa, Panicum virgatum
  misc_feature: Ceres CLONE 2047229
  misc_feature: SWISSPROT Homolog: EC 2.4.1.241 Digalactosyldiacylglycerol synthase
MASFGVDTRPAAAASGGGGGGAGAAGTGEGALSFLSRSLREDLRLIRARAGELETFLSAPVAEPELLARLRRAYSSSASSARTRLDLSAIGKAFEAESWRGARGRARWGWEEEAEEWEPVRMVKARLRELERSTQGQSATDMLHKVKLSLKSMSFAPEASEDVPPLDLGELFAYFLKQSVPLFDQLGIKRDVCD

SEQ ID NO: 49041 - DNA, 632 bp, Panicum virgatum
  misc_feature: Ceres CLONE 2047242
  misc_feature: Encodes the peptide sequence at SEQ ID NO. 49042
atttatttccaactcttcaagttcttagctttacttgtgctctaacccctctgatagagttcttgaagcggcttcttttcgatggttcaactttgatcggttttcgtgttttcgcgcatctgagttttcgcttgagtttctcatcgctgtacttttgcgtgcgtgttccgaatttgacgtgtgagtattcctagtgccgatagtcgttctgagctatgcggtactgatactcttcgtccgaggtgcgttgggtgtaatcgagacttttttcttcggtttttcaaatcgaatttgaggctcccattcaccccccctctggtcgcctatttggtccttcatcaaggtaccatacctaatgaggtcttccgtactatgtcccgagtgaccaactgtgtattgtccaacaacaatttagaaggtctgatacctccagaggttggaaaccttagacaactcttagagctgcatctttcatcaaacaagttaactggggaagtccctgatagtttgggccattgtcaagagctacaagaaataaagattgaccagaaccttctcacaggaaacattccaatgtctttgggcaatatgaagagtttgagcatgatcaatttttcccataataacttatc

SEQ ID NO: 49042 - protein, 86 aa, Panicum virgatum
  misc_feature: Ceres CLONE 2047242
  misc_feature: SWISSPROT Homolog: EC 2.7.11.1 Non-specific serine/threonine protein kinase
MSRVTNCVLSNNNLEGLIPPEVGNLRQLLELHLSSNKLTGEVPDSLGHCQELQEIKIDQNLLTGNIPMSLGNMKSLSMINFSHNNL

SEQ ID NO: 49043 - DNA, 674 bp, Panicum virgatum
  misc_feature: Ceres CLONE 2047260
  misc_feature: Encodes the peptide sequence at SEQ ID NO. 49044
caatgtgtacgcgaccactgcttcaaatgcagacgagagtagctggggaacttactgccctggcgagaacccgagccctccgccagagtatgacacctgcttgggagacttgtatagtattgcttggatggaagacaggtacttggttttcttttatatatcttcactggattttcttactgtgaaatcttgtccagaccttgtgacaccaattcacacgtagggctatggaattgagtctcttttgatttcactcacatcagttaacatgtacttgataaaccaatatgttagctaacatagaaacatagtactgtacacatttgttattggggaatgattaattaattaccatgatattagtacctggtgacatgactacctctgtctttgttaattaaagtgagacagaggatatgcatgtgttgctttacttttaggtgcatgtgcttgacaagaaatttattgatttgccccacgatatgatatctcacagcagttgatttggaccatgtgctctgtattgactcagggaagaatgggctgagcatgtcaaatttccctattcccttaataagatagagaacaaatggcatactagtagcatgaataatccccagacaccagctattctgctttccttctagctcacagtctacttctgagcttgacca

SEQ ID NO: 49044 - protein, 73 aa, Panicum virgatum
  misc_feature: Ceres CLONE 2047260
  misc_feature: SWISSPROT Homolog: EC 3.4.22.34 Legumain
NVYATTASNADESSWGTYCPGENPSPPPEYDTCLGDLYSIAWMEDRYLVFFYISSLDFLTVKSCPDLVTPIHT

SEQ ID NO: 49045 - DNA, 674 bp, Panicum virgatum
  misc_feature: Ceres CLONE 2047266
  misc_feature: Encodes the peptide sequence at SEQ ID NO. 49046
ttatttctctagagattgcaggacaactttatgatggtgcaacagactgtaagatttttgcactcccaaaagcagccccgaatactactcaaattggacattactaaggcgtttgattcagtttcctgggcatttctcttggaattacttggcaaattgggttttggaccacgatggcgggacctgttgagtggcctactgacttcatcctcaactcagatacttcttaatggtacccctggagaattcatacagcacaggagagggctcaggcaaggagatcccttctccccgatgctctttatcttggtcatggatgcactaaattggatggtcactagggcagcggaggccggccttctacagcccctgtctagacgaccaattcaacaccgaatatccttatatgccgatgatgtggccctcttccttagacctgctgcagaagatatttccctgacattgcagctgctacagctatttggggatgcctctgggctcagaaccaatgttcagaaaagtagtgtgatgccaatccagtgctctgatgataacatggctgtgatacaaagtttgctgccatgtgaaatcatgagttttccgtgcaagtatctgtttttacctctgtctctcaggaagctcacaagagaacaatttcagcccataattgacag

SEQ ID NO: 49046 - protein, 214 aa, Panicum virgatum
  misc_feature: Ceres CLONE 2047266
  misc_feature: SWISSPROT Homolog: EC 2.7.7.49 RNA-directed DNA polymerase
MMVQQTVRFLHSQKQPRILLKLDITKAFDSVSWAFLLELLGKLGFGPRWRDLLSGLLTSSSTQILLNGTPGEFIQHRRGLRQGDPFSPMLFILVMDALNWMVTRAAEAGLLQPLSRRPIQHRISLYADDVALFLRPAAEDISLTLQLLQLFGDASGLRTNVQKSSVMPIQCSDDNMAVIQSLLPCEIMSFPCKYLFLPLSLRKLTREQFQPIID

SEQ ID NO: 49047 - DNA, 572 bp, Panicum virgatum
  misc_feature: Ceres CLONE 2047299
  misc_feature: Encodes the peptide sequence at SEQ ID NO. 49048
aagggcaggttctcccagaaggaactcttctggtagatggcaagaaagttgctgtggtgtactatagagctggatatacaccaaatgattacccttcagaagctgaatggagtgcaagacttttgattgaacaatcatgtgctgtgaagtgtccttcaatatcgtatcatttagtgggaaccaaaaagattcaacaagaactagcaaagcccaatgtgcttgaaaggtttcttgaaaataaggaggaaattgctaagcttcgtaaatgctttgctggtctatggagtttggatgatgaagagattgttaaaactgcaattgaaaagcctgagttgtttgtgttgaagcctcaacgtgaaggcggagggaacaacatttatggccttgatttgagagaaacacttaccagactccagaaggaaggaggggatgcacttgcagcctatatacttatgcaaagaatcttcccaaaagcttctcctgcttatctagttcgtggtggtatttgccacgagggtcttgtgatttctgagcttggaatatatggcgcttacttgaggaataaagataag

SEQ ID NO: 49048 - protein, 189 aa, Panicum virgatum
  misc_feature: Ceres CLONE 2047299
  misc_feature (1)..(58): Pfam Name: GSH_synthase Pfam Description: Eukaryotic glutathione synthase
  misc_feature: SWISSPROT Homolog: EC 6.3.2.3 Glutathione synthase
GQVLPEGTLLVDGKKVAVVYYRAGYTPNDYPSEAEWSARLLIEQSCAVKCPSISYHLVGTKKIQQELAKPNVLERFLENKEEIAKLRKCFAGLWSLDDEEIVKTAIEKPELFVLKPQREGGGNNIYGLDLRETLTRLQKEGGDALAAYILMQRIFPKASPAYLVRGGICHEGLVISELGIYGAYLRNKD

SEQ ID NO: 49049 - DNA, 741 bp, Panicum virgatum
  misc_feature: Ceres CLONE 2047305
  misc_feature: Encodes the peptide sequence at SEQ ID NO. 49050
ctctcgaaaccctagtcccgctccaccccccgccgccgccgcagctcccccgggccccgtctcgccccccacctccggccctcgcgaagcgcctcctcgaccgccgggagtgagagaagagatggcgggcaagggcgacgggccggcgatcggcatcgacctcggcaccacctactcgtgcgtcggcgtgtggcagcacgaccgcgtcgagatcatcgccaacgaccaggggaaccgcaccaccccctcgtacgtcgccttcaccgactccgagcgcctcatcggagatgccgccaagaaccaggtcgccatgaaccccatcaacaccgtctttgatgccaagcgtctcatcggcagaaggttctctgatgcttctgtccagagtgatatcaagctctggcccttcaaggtcatttctggacctggtgagaagcccatgattgttgtccagcacaagggtgaggataagcagtttgctgctgaggagatctcctccatggttctgatcaagatgcgtgagattgctgaagcttaccttggcagcactatcaagaacgctgttgtcacagttcctgcctatttcaacgactcacagaggcaggccaccaaggatgctggggtgattgctggcctcaacgtgctacgtatcatcaatgagccgactgctgctgctattgcctatggtcttgacaagaaggccaccagtgtgggcgagaagaatgtcctcatctttgactttgg

SEQ ID NO: 49050 - protein, 206 aa, Panicum virgatum
  misc_feature: Ceres CLONE 2047305
  misc_feature (9)..(205): Pfam Name: HSP70 Pfam Description: Hsp70 protein
  misc_feature: Functional homolog of the protein sequence given in SEQ ID NO 50336
  misc_feature: Useful for making plants with modulated heat sensitivity
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEDKQFAAEEISSMVLIKMREIAEAYLGSTIKNAVVTVPAYFNDSQRQATKDAGVIAGLNVLRIINEPTAAAIAYGLDKKATSVGEKNVLIFDF

SEQ ID NO: 49051 - DNA, 643 bp, Panicum virgatum
  misc_feature: Ceres CLONE 2047339
  misc_feature: Encodes the peptide sequence at SEQ ID NO. 49052
aatccaccaccgtgggcgctcccttcaatcttctccgtcgtcagggatggcggcgaccgcgctgctggcgggctcgccgtggctgcgcctccgcctccgcgcggacgctcccgcgcgccgccccttcgcccgccacacccacctccgccgggccctctcctcctgcgcccgcgcctccgccgccgaccccgcctccggccccgtccgcgtccgcttcgcgccgtcgcccacgggcaacctccacgtcggcggcgcccgcaccgcgctcttcaactacctcttcgcgcgctccaacggcggccgcttcgtgctccgcgtcgaggacaccgacctcgagcgctccaccaggaagtccgaggaggccgtcctcgccgacctcgcgtggctcggcctccagtgggacgaaggtcactccgctatccgccgcgcccttcacgatcccgagtctcttctagtctagctctgcgctgattcatttcgacctccgaggcctgcggttgggtcgctgactcaacttgattacccacttcgtagatttagaggattagtccgtgcctcgcgcagcgactcgtaatgctgctattacatttatctgctgctagacacgtctggtgcagtggctccaggagtttaattaaatttg

SEQ ID NO: 49052 - protein, 137 aa, Panicum virgatum
  misc_feature: Ceres CLONE 2047339
  misc_feature (52)..(137): Pfam Name: tRNA-synt_1c Pfam Description: tRNA synthetases class I (E and Q), catalytic domain
  misc_feature: SWISSPROT Homolog: EC 6.1.1.17 Glutamate--tRNA ligase
MAATALLAGSPWLRLRLRADAPARRPFARHTHLRRALSSCARASAADPASGPVRVRFAPSPTGNLHVGGARTALFNYLFARSNGGRFVLRVEDTDLERSTRKSEEAVLADLAWLGLQWDEGHSAIRRALHDPESLLV

SEQ ID NO: 49053 - DNA, 584 bp, Panicum virgatum
  misc_feature: Ceres CLONE 2047345
  misc_feature: Encodes the peptide sequence at SEQ ID NO. 49054
cttatcgcatccctgaacctgaacaacaagggagacagcctaaccgcagcttactaccacaatgttaaccaattgactagcacagctgttggggcagagctgacccactgcttctccaccaacgagaacacccttaccttcggcacccagcatgctttggatccactgactgtcgtgaaggcccgcttcaacaactccggtaaggccagcgcgctgatccagcatgagtggaggccaaagtcactggtgaccatctcagctgaggtcgacaccaagaccattgagaagagctcgaaggttgggatagccgtggccctcaagccctgattgttcaccaagtcctttttttctctctctcttaagctcccagcatgtacttccttcccagctgaaattgggaccaggtcagcttggggagacaaaacagtttgggttccccgcatcttttggtcgttgcagtctgtctattgatttcatgaactgtgatgtttccttgagttttttttttcagtcgccggtgtagcactctgttaatgagcaaccttcacaataattcaagctcggtagaattctgaacttgtgtt

SEQ ID NO: 49054 - protein, 108 aa, Panicum virgatum
  misc_feature: Ceres CLONE 2047345
  misc_feature: Functional homolog of the protein sequence given in SEQ ID NO 50463
  misc_feature: Useful for making plants with modulated drought sensitivity
LIASLNLNNKGDSLTAAYYHNVNQLTSTAVGAELTHCFSTNENTLTFGTQHALDPLTVVKARFNNSGKASALIQHEWRPKSLVTISAEVDTKTIEKSSKVGIAVALKP

SEQ ID NO: 49055 - DNA, 633 bp, Panicum virgatum
  misc_feature: Ceres CLONE 2047369
  misc_feature: Encodes the peptide sequence at SEQ ID NO. 49056
aagctcacagttttcagacaccagaacccagcaaaagcacgcagtgagacgcagggaaggctgctgccaatgttacgcgctctcctgccgaccagagagatcttccgtgctcaatctgcagtggccaaatttgtattatcacacaataatttggaaggccgactgtctcttgagatcggaaattgtcaagggctagagatcatcgaaatggatcataatttcttcgaagggaatatttctactactctgagtgatctgaagagcctcaccctgttaaatctatcacacaacaatttgtccggtctcatcccaacagaactgggtgatctacaatatctcacccagctggacctctcttacaatgatctgcaaggtgaagtaccaaagaatggagtatttggaagtgccatatccgtgtcacttattggcaaccagcgactttgtggaggtgtgcaagatctacatatgcgccaatgtcccatggcctctcggagaaaagaaacacagtactacctaattaggatactcattccagtatttggtttcatgtcactcataatgttgatttattttctgattaccgagaggaaaatgttgagaccaaaaagtttagcatttcctttctttgaagag

SEQ ID NO: 49056 - protein, 210 aa, Panicum virgatum
  misc_feature: Ceres CLONE 2047369
  misc_feature: SWISSPROT Homolog: EC 2.7.11.1 Non-specific serine/threonine protein kinase
KLTVFRHQNPAKARSETQGRLLPMLRALLPTREIFRAQSAVAKFVLSHNNLEGRLSLEIGNCQGLEIIEMDHNFFEGNISTTLSDLKSLTLLNLSHNNLSGLIPTELGDLQYLTQLDLSYNDLQGEVPKNGVFGSAISVSLIGNQRLCGGVQDLHMRQCPMASRRKETQYYLIRILIPVFGFMSLIMLIYFLITERKMLRPKSLAFPFFE

SEQ ID NO: 49057 - DNA, 692 bp, Panicum virgatum
  misc_feature: Ceres CLONE 2047395
  misc_feature: Encodes the peptide sequence at SEQ ID NO. 49058
acatcggccgcaccgcgtttgtttggttaggaattgatacgcccgcccccacgtctcatcgtcgccgagagaaatcaggaagcctctgcttttccggagaggggaacaggggaatttcgtcgtcgccctcgatcggatcgagacatctctctgatcaggagcagagttgaaggtgctctgcagcgggggtccaatcttcttgggatttgaaaatttgatgctctaatggagtccaagggtggcaagaagaagtctagcagtagtcgttcctccctgatgtacgaagctcccctcggctacagcatcgaggacatccgacccgccggcggcatcaagaaattctccgctgcttactcaaactgcgcgaggaagccatcctgatattcccctcgttctcttcctagtagtttagaatcaaacttaatttctcgtctgttcttcctaaatctttctggctagctgctgtccagtgacaaaaaaattccaaggagctgtctgctgtcttcccttccccagcatccatcttctttcttcgaaacaatggcagtcatgcatgctggtgacgttgccccggtctctgcaattgggtttgagggatatgagaaacgccttgagatcagcttttctgaggcgcccatctttgctgaccccagtggaaagggcttgcgcgccctctcacgtgcccatattga

SEQ ID NO: 49058 - protein, 50 aa, Panicum virgatum
  misc_feature: Ceres CLONE 2047395
  misc_feature: SWISSPROT Homolog: EC 4.1.1.50 Adenosylmethionine decarboxylase
  misc_feature: Functional homolog of the protein sequence given in SEQ ID NO 51543
  misc_feature: Useful for making plants with modulated nitrogen use efficiency
MAVMHAGDVAPVSAIGFEGYEKRLEISFSEAPIFADPSGKGLRALSRAHI

SEQ ID NO: 49059 - DNA, 630 bp, Panicum virgatum
  misc_feature: Ceres CLONE 2047410
  misc_feature: Encodes the peptide sequence at SEQ ID NO. 49060
ttggtttagaggatttgcctgtgttacttaagctgaaagattggccacaacatagttcctttgagcagagactgccacggcataatgctgagttcatgtctgccttgccatttcgtgaatatacagaccctaaatctgggcctctcaatctggcggtgaagctgccaaaagatgttataaagccagaccttggtccaaagacttatattgcttatggcgtcagccaagagttgggaattggtgattctgttaccaagattcattgcgacatgtctgatgccgctggtccaatatacaatctacgagcgcagtactattagtcctgaaaacaagtgatgggtgcttgcgtaaggattacacagcggcaacggttgtgtcccgatcttcttgaaggattcttgaacttgataactatcactgcgtaacctggtgatgaggctgcgcaccgcgagatcttgctcacgcgacgaacaaccgagacaatcgcccttccatgtactgacgtagctagaccacgcaatcacgccatatagacgtgaaggtgccaactgggtgaactgcagttcggcgttccacaactccctcaggaatcgaaagaacaagttgtcaatatcctcacacatactgatg

SEQ ID NO: 49060 - protein, 105 aa, Panicum virgatum
  misc_feature: Ceres CLONE 2047410
  misc_feature: The sequence is a functional homolog of SEQ ID NO 958 in the 10/666,642 US patent application
  misc_feature: The sequence is a functional homolog of SEQ ID NO 956 in the 10/666,642 US patent application
  misc_feature: The sequence is a functional homolog of SEQ ID NO 959 in the 10/666,642 US patent application
  misc_feature: The sequence is a functional homolog of SEQ ID NO 1596 in the 11/479,226 US patent application
  misc_feature: The sequence is a functional homolog of SEQ ID NO 1432 in the 10/666,642 US patent application
  misc_feature: The sequence is a functional homolog of SEQ ID NO 190 in the 10/666,642 US patent application
  misc_feature: The sequence is a functional homolog of SEQ ID NO 424 in the 10/666,642 US patent application
GLEDLPVLLKLKDWPQHSSFEQRLPRHNAEFMSALPFREYTDPKSGPLNLAVKLPKDVIKPDLGPKTYIAYGVSQELGIGDSVTKIHCDMSDAAGPIYNLRAQYY

SEQ ID NO: 49061 - DNA, 655 bp, Panicum virgatum
  misc_feature: Ceres CLONE 2047414
  misc_feature: Encodes the peptide sequence at SEQ ID NO. 49062
atcacgaatccgaagaatccccacgagcagaagagaaaacccagagaaaccaagcgaaaaatccaatcttttcctcgattcagcccccgattccgcggcgagaagagccatggccgagtccgccaacaacgacgccccggccgccaccaacaaccagcccactacggtaagagatggttccgtgttcttggatttcccctgattcggttgcgtttggtgccgtttctggtggtgctgatttggggggtgttgttggttcgcaggaggaggtgacgattgagagggcggcgacccaggaggaggaggagaggctgcggtacctcgagttcgtgcagcaggcggcggcgcaggcgctggtgctggccgccgcggcgtacgcgtacgccaagcagggcgcggggccgctccgccccggtgtcgaccacgtcgagggcaccgtcaagaccgtcgtggggcccgtctacgaccgcttccatgccgtcccgctcgacctcctcaagttcctcgaccgcaaggtaaggaggaccattctctttagttggttttaatttttagtttcaaattgttccattcttgtagttgctacttgttaagttccatcctgcgtcccaaaatgaatcttttagggtgaaattttttgtatctaatagcgctt

SEQ ID NO: 49062 - protein, 124 aa, Panicum virgatum
  misc_feature: Ceres CLONE 2047414
  misc_feature (38)..(122): Pfam Name: REF Pfam Description: Rubber elongation factor protein (REF)
MVPCSWISPDSVAFGAVSGGADLGGVVGSQEEVTIERAATQEEEERLRYLEFVQQAAAQALVLAAAAYAYAKQGAGPLRPGVDHVEGTVKTVVGPVYDRFHAVPLDLLKFLDRKVRRTILFSWF

SEQ ID NO: 49063 - DNA, 655 bp, Panicum virgatum
  misc_feature: Ceres CLONE 2047415
  misc_feature: Encodes the peptide sequence at SEQ ID NO. 49064
ttctgtggaggtttcgatatcaatatgttctcacaggttcataagactggaaacatctctcttctgccaaacgtgtctgttgacctcgtgtcaaatatcatggaagagggcaaaaagccttcggtggctgctattcagggccttgctctgggtggtgggcttgagttgactatggcttgtcatgctcggttatctacccctgatgctcaacttggattaccagagctgactcttggcataattcctggatccggaggaactcaacgtcttccaaggcttgtaggtctgcccaaagcaatagaaatgatgctgcaatcaaagttcattacagcaaagcaagggaaggaatttggtcttgttgatgccctttgctcccctgatgaattgataaagatgtcacgtctttgggctttagagattgcgaattgtcgtaaaccttggataagatctcttgccagaacagataggcttggttcgctatctgaagctcgtgctgtattaaatacggcaagacagcaggcgaagaaagttgcatcacatttgccacagcaccaagcctgccttgatgttattgaagaaggagtattatttggtggccatgctggtgttctgaaggaagagaaagttttcaaggagttggtgccatcaccaacat

SEQ ID NO: 49064 - protein, 218 aa, Panicum virgatum
  misc_feature: Ceres CLONE 2047415
  misc_feature (1)..(125): Pfam Name: ECH Pfam Description: Enoyl-CoA hydratase/isomerase family
  misc_feature: SWISSPROT Homolog: EC 4.2.1.55 3-hydroxybutyryl-CoA dehydratase
FCGGFDINMFSQVHKTGNISLLPNVSVDLVSNIMEEGKKPSVAAIQGLALGGGLELTMACHARLSTPDAQLGLPELTLGIIPGSGGTQRLPRLVGLPKAIEMMLQSKFITAKQGKEFGLVDALCSPDELIKMSRLWALEIANCRKPWIRSLARTDRLGSLSEARAVLNTARQQAKKVASHLPQHQACLDVIEEGVLFGGHAGVLKEEKVFKELVPSPT

SEQ ID NO: 49065 - DNA, 637 bp, Panicum virgatum
  misc_feature: Ceres CLONE 2047417
  misc_feature: Encodes the peptide sequence at SEQ ID NO. 49066
gaaaatcccaaacctcttcccctcgaccttctctctcggacgcgggctctcctcaagcccacgggcagaacaggaccccgagaggcgagaggtgcagtgatgtcacatcattttcacgccatcatccacagcccatttcttcccgtggccttcgcccccggggccgatgctccctcgctcggagttagtgtagcgtcaccctcgagaagagctgtgcggctgccgagggcgagggcgtccgtggagaagcgagagcaaacgatggaggagcaaggcggcgcggcggcgctcggctgggcggcgagggacgccaccggtgtcctctcaccctacaacttctccagaagggttccgagggacgacgatgtcacgatcaaggtgctctactgcgggatctgccacaccgacctgcacgtcatcaagaactactggggcagcgccatgtaccccgtcgtccccgggtaatccccggatgtcgcaaacgctgcagatttaattagagcccagaacagtaacgttgcggatccaaacaacggccttttgatctccccgctggtctgctcgcgcaggcacgagatcgtcggcgtggtgaccggcgtcggcggcggcgtcacgaggttcaagcccggcgacaccg

SEQ ID NO: 49066 - protein, 67 aa, Panicum virgatum
  misc_feature: Ceres CLONE 2047417
  misc_feature: SWISSPROT Homolog: EC 1.1.1.255 Mannitol dehydrogenase
  misc_feature: The sequence is a functional homolog of SEQ ID NO 2 in US patent 7288696
  misc_feature: Functional homolog of the protein sequence given in SEQ ID NO 51761
  misc_feature: Useful for making plants with altered cell wall content and/or composition
  misc_feature: Functional homolog of the protein sequence given in SEQ ID NO 51762
  misc_feature: Useful for making plants with altered lignin content
  misc_feature: Functional homolog of the protein sequence given in SEQ ID NO 50552
  misc_feature: Useful for making plants with altered carbohydrate content
MEEQGGAAALGWAARDATGVLSPYNFSRRVPRDDDVTIKVLYCGICHTDLHVIKNYWGSAMYPVVPG

SEQ ID NO: 49067 - DNA, 709 bp, Panicum virgatum
  misc_feature: Ceres CLONE 2047429
  misc_feature: Encodes the peptide sequence at SEQ ID NO. 49068
gctctcgcgacccgaaagccccctccaaccctagccgcctcctgcaagcttcagaagttcagagctcaggaatcaggccgccatggcgacggagacggagaccttcgccttccaggccgagatcaaccagctgctctccctcatcatcaacaccttctactccaacaaggagatcttcctccgcgagctcatctccaactcttccgatgcgttggacaaaataaggttcgagagcctcactgacaagagcaagctcgatgcgcagccggagctgttcatccacattgtccccgacaaggccagcaacactctctccatcatcgacagcggcatcggcatgaccaagtccgacctcgtcaacaacctcgggaccatcgccaggtccggtaccaaggagttcatggaggcccttgccgccggcgcggacgtgtccatgattgggcagttcggtgttggtttctactccgcctacctcgttgctgagagggtggttgtgaccaccaagcacaacgacgacgagcagtacgtgtgggagtcccaggccggcggatcgttcactgttacccgtgacacgtccggggagcagcttggcaggggtactaagatcacgctcttcctcaaggacgaccagttggaatatcttgaggagcgccgcctcaaggatctggtcaagaagcactctgagttcatcagttaccccatctccctg

SEQ ID NO: 49068 - protein, 208 aa, Panicum virgatum
  misc_feature: Ceres CLONE 2047429
  misc_feature (28)..(182): Pfam Name: HATPase_c Pfam Description: Histidine kinase-, DNA gyrase B-, and HSP90-like ATPase
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKDDQLEYLEERRLKDLVKKHSEFISYPIS

SEQ ID NO: 49069 - DNA, 668 bp, Panicum virgatum
  misc_feature: Ceres CLONE 2047433
  misc_feature: Encodes the peptide sequence at SEQ ID NO. 49070
tccgctcccgactgcccaggtcggctagtcccccgcccttcctccccctcacgaagcggcggcggcggcggcggcggcaagatggtgaagaaaagcaagaagagcaagagcaagcgcgtcacgctgcgccagaagcacaaggtgctgcgcaaggtgaaggagcaccaccgtaagaagcgcaaggaggccaagaaggagggcagggcgggccagcggaagaaggtcgaaaaggaccccgggatccccaacgagtggcccttcaaggagcaggagctcaaggccctcgaggcgcgccgcgcgcaggcgctgcaggagctcgagctcaagaaggaggcgcgcaaggagagggctcggaagaggaagctcgggttgcttgaggatgaggacattactaatttggcctctgcagcttctgcgcagggcagtgagtttgcacaaaaagatgcagaaaaagagaatgctcctttagcagtggcaaagaaccatgatcattcagagaggtctttctacaaggaacttgttaaagtaattgaagcttctgatgtgattctcgaggttcttgatgcaagggacccattgggaacccgttgcattgacatggaaaatatggttaggaaggccgacccaagcaaacggattgtgctacttctgaacaagatagatctttg

SEQ ID NO: 49070 - protein, 195 aa, Panicum virgatum
  misc_feature: Ceres CLONE 2047433
  misc_feature (16)..(96): Pfam Name: GN3L_Grn1 Pfam Description: GNL3L/Grn1 putative GTPase
MVKKSKKSKSKRVTLRQKHKVLRKVKEHHRKKRKEAKKEGRAGQRKKVEKDPGIPNEWPFKEQELKALEARRAQALQELELKKEARKERARKRKLGLLEDEDITNLASAASAQGSEFAQKDAEKENAPLAVAKNHDHSERSFYKELVKVIEASDVILEVLDARDPLGTRCIDMENMVRKADPSKRIVLLLNKIDL

SEQ ID NO: 49071 - DNA, 671 bp, Panicum virgatum
  misc_feature: Ceres CLONE 2047459
  misc_feature: Encodes the peptide sequence at SEQ ID NO. 49072
atcgcattacagtgatccttcgcacacgccgcgctcgccctgccagctgacctgctctgctccgcccgacccgacccgacgcggcctcctcccccgacgaccctcccccagagcgagcgaccggaagccgcgatgcgcgaggaggtgcggagctcgtcggcggcgccgcccgacccgccgcccgcgcgctcggcctcgccgccgcccactcccgtcgccagttccgctggtgcttcatcacctcctgcacaaggcagtgaccaagtctccaaggcggggtcaccgtgggaacgaggcgacttgcttcggcgcctggccacatttaagcattcaacatgggcttctaagccaaaggctactagttcactggcttgtgctcaaagaggctgggtgaacattgacgtggacaagattgagtgtgaatcatgtggtgcacatcttatatttactgcattgacatcctggtcccctgctgaagttgcaaatgctggggaagcttttgctgagcagcttgatgcatcacaccagaatgattgtccctggagggggaatagctgtgctgatagcctggtccagttccaccttaccccatcagctcttgttggtggttttaaagatcgatgtgatggattgttgcagtttgcatctcttcctgttattgcctcgtctgc

SEQ ID NO: 49072 - protein, 179 aa, Panicum virgatum
  misc_feature: Ceres CLONE 2047459
  misc_feature (51)..(178): Pfam Name: zf-C3HC Pfam Description: C3HC zinc finger-like
MREEVRSSSAAPPDPPPARSASPPPTPVASSAGASSPPAQGSDQVSKAGSPWERGDLLRRLATFKHSTWASKPKATSSLACAQRGWVNIDVDKIECESCGAHLIFTALTSWSPAEVANAGEAFAEQLDASHQNDCPWRGNSCADSLVQFHLTPSALVGGFKDRCDGLLQFASLPVIASS

SEQ ID NO: 49073 - DNA, 665 bp, Panicum virgatum
  misc_feature: Ceres CLONE 2047473
  misc_feature: Encodes the peptide sequence at SEQ ID NO. 49074
aaaagaaaaaaaaaagaaaaaaatcgagtccctccggcacggcggcaccaccagtgcgcccgccgccgtcatccgccggtcctccagcctcctcctcctccctgtctcgcatagccacgccgcatccccgccctcctcctgcctttcccagcggatttcctcgcccttcctccgccatctccccttgccgctgcggtgctctccgccgccgccgccgcctccttctgcccccgccttcgtcgtctctctcccgccagctgctgccgccgcttctcgagcagggatacaatctgaagagagaaaatgtcgtcgaagaagaactactacaaggagaagatgatgcggcggaaagaggagaaaaaagaagaaccagagacacccaggtatcgtgatcgtgctaaagagcgtcgtgaagatcaaaacccagactatgaacctacagagcttggttcatttcatgctgtggcacctcctgggacagatttgaggctggctgatgcacacaagatttcaattgagaaaagcaaatacctaggaggtgatttggagcatacacatctggtcaaaggcttggactatgctctacttcacaaaatacggagtgaaattgaaaagaaacctgatgcagaggatgagaaggaggcaaagtcgagggcaacaaaaga

SEQ ID NO: 49074 - protein, 120 aa, Panicum virgatum
  misc_feature: Ceres CLONE 2047473
  misc_feature (5)..(120): Pfam Name: RED_N Pfam Description: RED-like protein N-terminal region
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKIRSEIEKKPDAEDEKEAKSRATK

SEQ ID NO: 49075 - DNA, 616 bp, Panicum virgatum
  misc_feature: Ceres CLONE 2047499
  misc_feature: Encodes the peptide sequence at SEQ ID NO. 49076
acttacaggatcggagctcacacgagtggcgcgcagctacctcaagcgaaacccggccccctgtgcaattgcgcgtggtcgtcgtctcaccagcgcaaacgcgacgacgatggtgttcggcgagcgcgccgcgggcggcccgggcgccgacgcggcgggcacgatgctgttcgcgcggcacgtggtgcgcgggcggtggttcatgttcttcgcgtccatcctgatcatggcggcggccggcggcacctacatcttcggcatctactccaaggccgtcaagacgtcgctcgggtacgaccagcagacgctcaacacgctgagcttcttcaaggacgtgggcgccaacgtcggcatcctcccggggctcatcaacgaggtcaccccgccgtgggtggtgctggcctgcggcgccggcatgaacctggccggctacctcatgatctacctcgccgtctcggggcgcacggcgcggccgcccgtgtggctcatgtgcgtgtacatcgccgtcggcgccaactcgcagtcgttcgccaactccggcgcgctcgtcaccgccgtcaagaacttccccgaggaccgcggcgtcgtgctcggcctgctcaagggcttcgtcgga

SEQ ID NO: 49076 - protein, 168 aa, Panicum virgatum
  misc_feature: Ceres CLONE 2047499
  misc_feature (29)..(168): Pfam Name: Nodulin-like Pfam Description: Nodulin-like
MVFGERAAGGPGADAAGTMLFARHVVRGRWFMFFASILIMAAAGGTYIFGIYSKAVKTSLGYDQQTLNTLSFFKDVGANVGILPGLINEVTPPWVVLACGAGMNLAGYLMIYLAVSGRTARPPVWLMCVYIAVGANSQSFANSGALVTAVKNFPEDRGVVLGLLKGFV

SEQ ID NO: 49077 - DNA, 719 bp, Panicum virgatum
  misc_feature: Ceres CLONE 2047507
  misc_feature: Encodes the peptide sequence at SEQ ID NO. 49078
accgcgtgcatccctcccctcccctgctttggcattttcgcttcgcttgtccccgacgcgcaattcccaccgcgatctcaagttctcaacagctctgatcccgcccgccccgcgcccccgcctctactcaacgcgacccaccgaccaggccccggcgggagcgatggaagcggggggcgacggccggagggagtcggcgctgggggctctcgccgtgctcccagacgaggtgctctgcgccgtcgtcgacctcctcccgcccgccgacatcgggcgcctcgcctgcgtcagcagtgtcatgtacatactttgtaacgaagaacctctctggatgagcaaatgtctttcaattgggggtcctcttgaatacaaaggttcttggaagaagacaacattgcccaggcttggcctatattcaggaaatgatgagaactggcagaaacctcgtcagtttgatgggttcagttctttatatctatacaggagatggtatagatgttttactagtttgagtagtttttcatttgatgatggacacgtggaaaggaaagatgaccttctattggaccaatttcgttctcaatatgatggaaaaggcccagttttgcttactaagttggctgaaacctggcctgcaaggacgaaatggacattgcagcaactgacaaaggattttgggtgaagttccattcagaatatcacaaagaagtcctcagaag

SEQ ID NO: 49078 - protein, 172 aa, Panicum virgatum
  misc_feature: Ceres CLONE 2047507
  misc_feature (14)..(61): Pfam Name: F-box Pfam Description: F-box domain
MEAGGDGRRESALGALAVLPDEVLCAVVDLLPPADIGRLACVSSVMYILCNEEPLWMSKCLSIGGPLEYKGSWKKTTLPRLGLYSGNDENWQKPRQFDGFSSLYLYRRWYRCFTSLSSFSFDDGHVERKDDLLLDQFRSQYDGKGPVLLTKLAETWPARTKWTLQQLTKDFG

SEQ ID NO: 49079 - DNA, 639 bp, Panicum virgatum
  misc_feature: Ceres CLONE 2047510
  misc_feature: Encodes the peptide sequence at SEQ ID NO. 49080
agaagcttggcccacacagcacagcgcgcaggcggcggcggccgggggcacggggaccccgcgctcgccgaggcggggggcgagggcgggggcggccggccgctgcggctggtgtactgcgacgagcgcggccggttccggatggacccggaggccgtggccgcgctgcagctcgtcaaggggcccgtcggggtcgtctccgtgtgcggccgcgcgcgccaagggaagagcttcatccttaaccagcttctaggaaggagcagcggatttcaagtagcaagtacccatcggccctgcaccaagggcctttggatgtggagtgccccaataaagagaactgcccttgatggaactgaatacagtcttctgctacttgacagtgagggcattgatgcctacgatcagacgggcacctacagcattcagattttttctttggcggtcctactatcgagcatgttcatatacaatcagataggtggtatagatgaggcagcccttgatcgcctttcacttgttactgaaatgaccaagcttatccgtgtgagggctaatggtgggaggtctactgcatctgagcttgggccattttcacctatcttcatctggctactgagggatttttttctagatttagtg

SEQ ID NO: 49080 - protein, 212 aa, Panicum virgatum
  misc_feature: Ceres CLONE 2047510
  misc_feature (43)..(212): Pfam Name: GBP Pfam Description: Guanylate-binding protein, N-terminal domain
RSLAHTAQRAGGGGRGHGDPALAEAGGEGGGGRPLRLVYCDERGRFRMDPEAVAALQLVKGPVGVVSVCGRARQGKSFILNQLLGRSSGFQVASTHRPCTKGLWMWSAPIKRTALDGTEYSLLLLDSEGIDAYDQTGTYSIQIFSLAVLLSSMFIYNQIGGIDEAALDRLSLVTEMTKLIRVRANGGRSTASELGPFSPIFIWLLRDFFLDL

SEQ ID NO: 49081 - DNA, 694 bp, Panicum virgatum
  misc_feature: Ceres CLONE 2047522
  misc_feature: Encodes the peptide sequence at SEQ ID NO. 49082
tgattgtaagcttccgagacaacaagatatctggtcagctcacagcagagtttagcacaaaatgcagtgctatcagagctttggatttagctggcaatcaaatttcaggagtgatgcctgctaatattggttcgttgggagctcttgtcaagatggacatgagcagaaatttgctgcagggtcaaatacctgctagtttcaaaggattcaagagcttgaaatttctgtcattagctggtaacaaccttagtggtagaataccgtcctgtttgggtcagttgagatcactgaaggttttagatctctcttcaaattctcttgttgggaagatcccaagtaaccttgtgacactaagagatctcagtgtgcttctactcaataataataggctctctggaaacattcctgatcttacctcttctccatcgctgtccgtattcaatgtttcatttaatgacttgtcagggccactgccttcaaaatttcacttactgacatgcgacagtgttcgtggaaatccatccctccaaccttgtggattgtcagcactcactgatccactagtgaatgtccgaactctaagtgagacagacactaatccaccagctgacaatacagctcctgatggcagtagtggcggtggattcagcaaaatagagattgcctcaataacttcagcatcagcaattgttgc

SEQ ID NO: 49082 - protein, 230 aa, Panicum virgatum
  misc_feature: Ceres CLONE 2047522
  misc_feature: SWISSPROT Homolog: EC 2.7.11.1 Non-specific serine/threonine protein kinase
IVSFRDNKISGQLTAEFSTKCSAIRALDLAGNQISGVMPANIGSLGALVKMDMSRNLLQGQIPASFKGFKSLKFLSLAGNNLSGRIPSCLGQLRSLKVLDLSSNSLVGKIPSNLVTLRDLSVLLLNNNRLSGNIPDLTSSPSLSVFNVSFNDLSGPLPSKFHLLTCDSVRGNPSLQPCGLSALTDPLVNVRTLSETDTNPPADNTAPDGSSGGGFSKIEIASITSASAIV

SEQ ID NO: 49083 - DNA, 684 bp, Panicum virgatum
  misc_feature: Ceres CLONE 2047524
  misc_feature: Encodes the peptide sequence at SEQ ID NO. 49084
gtctcttattttccgcgctcgcgcgctcccgccacacaccccccccaaccttcctcgcttctccagactccagcctcgccaaggcttcctgatcaggttgggagcgcaggagaggagcttggaaggatggcgtcggtttccagggctgtctgcggcgtgcagatgccatgcttgaacggcagggaggcgcccgccggccgccgatcggtcgcggcgccgaaggcccggaacgccaagcggggcgtcatccgctccgtgtcggtctccggctccggctccggctccggctccggctccgtctccggccgcggccagcattgcgcgcctgccaacgccgtcgccgacgccgcgccaattacagcgacaaagagggtgttccccttcggcaagggcaagagcgagggcaacaggggcatgaaggatctgctgggcgggaagggcgcgaacctggcggagatgtcgagcatcgggctgtcggtgccgccggggttcacggtgtcgacggaggcgtgccagcagtaccaggaggccgggcgcgcgctgccggcggggctctgggcggagatcctcgacggcctggcgtgggtggaggagtacatgggcgcgcgcctcggcgacccacagcgcccgctcctgctctccgtccgctccggcgccgcggtgtcgatgcccggcatgatggac

SEQ ID NO: 49084 - protein, 185 aa, Panicum virgatum
  misc_feature: Ceres CLONE 2047524
  misc_feature: SWISSPROT Homolog: EC 2.7.9.1 Pyruvate, phosphate dikinase
MASVSRAVCGVQMPCLNGREAPAGRRSVAAPKARNAKRGVIRSVSVSGSGSGSGSGSVSGRGQHCAPANAVADAAPITATKRVFPFGKGKSEGNRGMKDLLGGKGANLAEMSSIGLSVPPGFTVSTEACQQYQEAGRALPAGLWAEILDGLAWVEEYMGARLGDPQRPLLLSVRSGAAVSMPGMM

SEQ ID NO: 49085 - DNA, 169 bp, Panicum virgatum
  misc_feature: Ceres CLONE 2047528
  misc_feature: Encodes the peptide sequence at SEQ ID NO. 49086
tcgctgcccgtcattttgctacatccgttacgtctcggtggcccccccgcatttggtcatgctggtgactccggggatggggcttctgatccctctggctgaactggtcaactctttggcctcccgcctccgcgcctctgggacgctcctcatgttctcctctacggcg

SEQ ID NO: 49086 - protein, 55 aa, Panicum virgatum
  misc_feature: Ceres CLONE 2047528
  misc_feature: Functional homolog of the protein sequence given in SEQ ID NO 51763
  misc_feature: Useful for making plants with altered carbohydrate content
RCPSFCYIRYVSVAPPHLVMLVTPGMGLLIPLAELVNSLASRLRASGTLLMFSST

SEQ ID NO: 49087 - DNA, 682 bp, Panicum virgatum
  misc_feature: Ceres CLONE 2047531
  misc_feature: Encodes the peptide sequence at SEQ ID NO. 49088
aagaggccgtgtcgcctctcttcctccgtccttcgatacgcccgataaaaccccaggacgcgcccccttctccagctgatcatcccaattcccatcctctccacccccggcttcgtagcccaatccatggcgctctcctgcatgaggtgccccgcgggcgccgccgcccgacgcgccgcggcgccgccgccgtccccgacggccgccgtctccttcgccagatgcggcttcgggaggtcaaccgccgccgccgccggaagttggcgcatccacgccgtcgctccgcagggagtgaaagctccgatggatcccaatgtgaagaatgcagtcacacctactagccctccaaaggtggaaaacggctccccttcagaaatcactctagatgaatttgaagacttgagtgctctatccaagaatgacgattctactgttagcatcactgtagttggcgcatctggtgaccttgccaagaagaagatatttcctgctctttttgctctctactatgaagattgccttcccaagcatttcaccatctttggctatgcacggagcaagatgacagatgctgaactgaggaacatggtcagcaaaacactgacttgcagaatagataaaagggaaaactgtaatgagaaaatggatgaattcctcaaaagatgcttctatcattcgggcc

SEQ ID NO: 49088 - protein, 185 aa, Panicum virgatum
  misc_feature: Ceres CLONE 2047531
  misc_feature (106)..(185): Pfam Name: G6PD_N Pfam Description: Glucose-6-phosphate dehydrogenase, NAD binding domain
  misc_feature: SWISSPROT Homolog: EC 1.1.1.49 Glucose-6-phosphate 1-dehydrogenase
MALSCMRCPAGAAARRAAAPPPSPTAAVSFARCGFGRSTAAAAGSWRIHAVAPQGVKAPMDPNVKNAVTPTSPPKVENGSPSEITLDEFEDLSALSKNDDSTVSITVVGASGDLAKKKIFPALFALYYEDCLPKHFTIFGYARSKMTDAELRNMVSKTLTCRIDKRENCNEKMDEFLKRCFYHSG

SEQ ID NO: 49089 - DNA, 694 bp, Panicum virgatum
  misc_feature: Ceres CLONE 2047540
  misc_feature: Encodes the peptide sequence at SEQ ID NO. 49090
agagctgctaaagccacaccatcacgcttctgagcattctcccgtcctatacccatcaactggtctgtcatcttcatctcggccgcaaggcaaatcaacttgttcgccctgtccagcatctctgcgggtgttctccagcttttctacgattggtttcacaaaatccagagtctctgcgggtgttctccaggtgaactctgcttctggtttgtgaagggtgattccagcgcaccaatagaatgcagaactcacaactttcaagtgcatttccaagggaaccaacactagaatttctaaaacacatcacagaagacttctcaagtgaacgagaggtcgggcgtggtggattcggtgtggtttacaagggcatacttcaaagtggacaacaggttactgtgaagaagcttgtgcgaacaacaggaattcatgacagacggtttcagaatgaggttggcaatctcctgatgctggagcacaaaaatatcgtcaagctacttggttcttgctaccacgcagaaaagaaattggtggaggtaaatggcagatttgttttctcagatgtcccggaaaagtttctctgctatgagtatctctctaatggcagccttgacaactacatctatggtactgtaactcagtctctgcataatttatttcactgtttcgttgttggactgtttaagtatcgaattgc

SEQ ID NO: 49090 - protein, 151 aa, Panicum virgatum
  misc_feature: Ceres CLONE 2047540
  misc_feature: SWISSPROT Homolog: EC 2.7.11.1 Non-specific serine/threonine protein kinase
MQNSQLSSAFPREPTLEFLKHITEDFSSEREVGRGGFGVVYKGILQSGQQVTVKKLVRTTGIHDRRFQNEVGNLLMLEHKNIVKLLGSCYHAEKKLVEVNGRFVFSDVPEKFLCYEYLSNGSLDNYIYGTVTQSLHNLFHCFVVGLFKYRI

SEQ ID NO: 49091 - DNA, 699 bp, Panicum virgatum
  misc_feature: Ceres CLONE 2047571
  misc_feature: Encodes the peptide sequence at SEQ ID NO. 49092
gactcgaaccaaacctcgccgccgcctccgtctccgtctcttcttctcatcccatctctctctcctacaccctccctcccgcaatcccacctccccctctaaacccgcacccgcagcggcactcctagggtttgctccgccccgccgaactccgccgccctccgatcgctctggttccgaggcggcggctgcgagagagcttgcggcatggcggggtacccggaggacaaccagcacgcgctgaacgggtacgaggaggaggaggtcgacgaggaggagggccaccccgggaggcggggaggccgggacgggggctccgggtacggcgatgccggcggagaggacgggaggggcgccgccggcgactcgtcggggaagattttcgtcggaggcgttgcttgggagacgactgaagaaacgttctccaagcattttgagaagtatggggcaataactgattctgtaattatgaaggacaagcatactaagatgcctcgtggatttggatttgttacattttctgatccatctgttatagacaaggttttggaggatgagcacgttatagatggcagaacggtaggacatctaaatttagaccggccgtaatgtgggacctcagtttgcagttcactctcatatgcaaacttctgcaattggatcggagttaagtttgtctcgaccactttcaactttctt

SEQ ID NO: 49092 - protein, 133 aa, Panicum virgatum
  misc_feature: Ceres CLONE 2047571
  misc_feature (58)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAGYPEDNQHALNGYEEEEVDEEEGHPGRRGGRDGGSGYGDAGGEDGRGAAGDSSGKIFVGGVAWETTEETFSKHFEKYGAITDSVIMKDKHTKMPRGFGFVTFSDPSVIDKVLEDEHVIDGRTVGHLNLDRP

SEQ ID NO: 49093 - DNA, 412 bp, Panicum virgatum
  misc_feature: Ceres CLONE 2047596
  misc_feature: Encodes the peptide sequence at SEQ ID NO. 49094
tttaagaggatcaacaaaaagctctcgatccacggatccccttgccggcctctcgttcccctccctcctccaaaagcctaggccagcctaccggcggagctcgcccgccccggaccatgggcgaagaccactactccctgtcggccgccgccccgtccggggcggcgaccgctgaggccgctgcatcggaggctgtcgggactgccgtgatcccgatcctcaacaagctgcaagacatctccgcgcagctggggagcagctccacgatcgacctgcctcaggtggccgtggtggggagccagaccatcggcaagaccctcgtcctcgaggagctcgtcagccgcgacttcctcgcgcggggctccgacatctgcacgcgccgcccgctcgtgcttcagctcgtgcaccagcc

SEQ ID NO: 49094 - protein, 98 aa, Panicum virgatum
  misc_feature: Ceres CLONE 2047596
  misc_feature: SWISSPROT Homolog: EC 3.6.5.5 Dynamin GTPase
MGEDHYSLSAAAPSGAATAEAAASEAVGTAVIPILNKLQDISAQLGSSSTIDLPQVAVVGSQTIGKTLVLEELVSRDFLARGSDICTRRPLVLQLVHQ

SEQ ID NO: 49095 - DNA, 646 bp, Panicum virgatum
  misc_feature: Ceres CLONE 2047607
  misc_feature: Encodes the peptide sequence at SEQ ID NO. 49096
gacgccattggtggcttctctattgtatctgtcgcccgcgcggccacgcttcctcttcttcaaccccgcctcctccttgacttcgccaccgtccttcctcgtcgtctcggtcttggaagcaagcaaggtagctgcacggaggcaaccgcgcagtaaggtgctcttggttctctgggatgatgaggcgcaggcagctcttgctggcgactgcctgcttgtgggctctgtcgtgcgccccgctgctccgtgcttccacccctgacggacttctcagggtcggcctgaacaagaacaagctcgaccgcgaggcgctggccgcggccaaggttgaaaggcagcacgacagccgccgcctgagggctgccggcgccgacgaggtccctctcatcgactacctcaacacccagtacttcggggtcgtcggcatcggcacgccgccgcagaacttcaccgtcatcttcgacaccgggagctccaacctctggatcccctcctccaaatgctatttctcgatagcatgttacttccaccacagatacaggtccggcaagtctagcacttacaaggctgatggtacatggcctgatgtcctgatcttctttaatgttactgctttctcgcaccattcaaagatgggtgctgaatc

SEQ ID NO: 49096 - protein, 156 aa, Panicum virgatum
  misc_feature: Ceres CLONE 2047607
  misc_feature: SWISSPROT Homolog: EC 3.4.23.40 Phytepsin
MMRRRQLLLATACLWALSCAPLLRASTPDGLLRVGLNKNKLDREALAAAKVERQHDSRRLRAAGADEVPLIDYLNTQYFGVVGIGTPPQNFTVIFDTGSSNLWIPSSKCYFSIACYFHHRYRSGKSSTYKADGTWPDVLIFFNVTAFSHHSKMGAE

SEQ ID NO: 49097 - DNA, 573 bp, Panicum virgatum
  misc_feature: Ceres CLONE 2047635
  misc_feature: Encodes the peptide sequence at SEQ ID NO. 49098
gcaaatcccaaggcccgccactagggttttcggattaggtttctagaacattccgccgccgcttcatgcacgcgccgccgctggtcgcgctcgccgggggcgcctgccccgtcgccgcctcgccgccgccgtggctggcctcgccccgggctgccatcctcgccgcgccggcgaggctcctccggtcccgccgcggggcgctccggctggaagccaaggccgcgtggagggcggcctggggcgggcggggcccgcgggtcccggccaagggcgccgtgctcgcctcctacatgggtgccgaggaggtggcgggaccctcgcccctgctcgacgatgaagagctcattttacacatcagaaaggaactggaggagggaaatctgcctgcagatgttgctagcagcttggaggagctctattacaattacaagaatgctgttctgcaaactggaaatccagatgcatatgaagatcatgctttcaaatatgatggctttgtttgatcgtgtcatactggatgtacagaatccaatttacctttccaccatatcacaaagctatccaagaaccatt

SEQ ID NO: 49098 - protein, 145 aa, Panicum virgatum
  misc_feature: Ceres CLONE 2047635
  misc_feature: SWISSPROT Homolog: EC 2.3.1.15 Glycerol-3-phosphate O-acyltransferase
MHAPPLVALAGGACPVAASPPPWLASPRAAILAAPARLLRSRRGALRLEAKAAWRAAWGGRGPRVPAKGAVLASYMGAEEVAGPSPLLDDEELILHIRKELEEGNLPADVASSLEELYYNYKNAVLQTGNPDAYEDHAFKYDGFV

SEQ ID NO: 49099 - DNA, 652 bp, Panicum virgatum
  misc_feature: Ceres CLONE 2047642
  misc_feature: Encodes the peptide sequence at SEQ ID NO. 49100
actgctcgagcgagctccagctctcaagaaagcacgcgggatcatggcgcctctccttcgcccgctcgtcctcgcgctcctggtcgcgtcctgcgccgcgcagcaggcgccgccggcgcagcccccgcagacgccgaacgccccgccgcaggcgcctccggctccccaggcgcctccagcagggaacccaccgccggctccccaggcacctccggccggcaacccgcctcccgcacccaccacccctccgccgcagcagcagcagtagaggatctccatcgccaggtcggggtcgccggtgccgtcggcaccgacctcgccccggccccgccgctcgtcgtccagggggacgagatcgagcggagatcgagcggactgcttcgccgccgagatcgagcggaccctgcgccccagcggcgttgccgtcctccacgtcgccgtgcaccgccgcggggacaagtactccgccaacgacatgctcgacgttcagggcctcatcggcctcttccggggctgcgacgtcgtcaggatcccactgctagctgacagagccgagtactgctgctggctgctgctcgctcatcatctcacatgctgcttcatttaccagtgcttggatttggtttatttatttatttaattgccgtgcttt

SEQ ID NO: 49100 - protein, 74 aa, Panicum virgatum
  misc_feature: Ceres CLONE 2047642
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
MAPLLRPLVLALLVASCAAQQAPPAQPPQTPNAPPQAPPAPQAPPAGNPPPAPQAPPAGNPPPAPTTPPPQQQQ

SEQ ID NO: 49101 - DNA, 700 bp, Panicum virgatum
  misc_feature: Ceres CLONE 2047644
  misc_feature: Encodes the peptide sequence at SEQ ID NO. 49102
aaaccagatcagtgcgacgcactcggctccccctctctcttcgagccgggacacatggcggcggcggcgaacgggccgtcgcccgggcggctggcctccgtgtacagcgaggtgcagacgagccgcctcctgcacgcgctgcccctcccctccgtcctccgctccgacttctccgtcgtcgacgggcccgccagctccgccgcgggcaaccccgatgagatcgccaagctcttccccaacctgttcggccagccttctgcgtcgctggtgccatcggctgagcccgcggcgacaaggccgctcaaggtcggcgtcgtgctctccggtggacaggcgccaggcgggcacaatgtgatctgcggcatcttcgattacctgcaggagcgtgctaaaggcagtgctatgtatggattcaagggaggtccagctgggatcatgaagtgcaagtacgtggagctcaattctgactttgtatacccatacagaaaccagggaggatttgatatgatctgcagtggaagggacaaaattgaaacgccagagcagttcaagcaagctgaagacacagccaacaagcttgatttggacggacttgttgtcattggtggtgatgattcaaacaccaatgcctgcctccttgcagaatattttaggtcaaaaaacatgaagactcgtgtcattggctgccccaagactattg

SEQ ID NO: 49102 - protein, 215 aa, Panicum virgatum
  misc_feature: Ceres CLONE 2047644
  misc_feature: SWISSPROT Homolog: EC 2.7.1.90 Diphosphate--fructose-6-phosphate 1-phosphotransferase
MAAAANGPSPGRLASVYSEVQTSRLLHALPLPSVLRSDFSVVDGPASSAAGNPDEIAKLFPNLFGQPSASLVPSAEPAATRPLKVGVVLSGGQAPGGHNVICGIFDYLQERAKGSAMYGFKGGPAGIMKCKYVELNSDFVYPYRNQGGFDMICSGRDKIETPEQFKQAEDTANKLDLDGLVVIGGDDSNTNACLLAEYFRSKNMKTRVIGCPKTI

SEQ ID NO: 49103 - DNA, 674 bp, Panicum virgatum
  misc_feature: Ceres CLONE 2047648
  misc_feature: Encodes the peptide sequence at SEQ ID NO. 49104
tggaagctttcgcctcttcctcttcctcgccctccgtcgtcttccttcccagtaagccaaagcttccacacgccgccagtcgccaaagcttaacacacccgcgcacgccgccccatcgcccccacccccccaccccccgcctcgccgcccttccatctctctctctctcgcgccgtctcgccgccctcgccccccgccgcgatccagggagccagcgagcggccggccatggccgcgggggcgatccgggtcaccatggaggtgggcgccgacggcgtcgcgctcatcaccatcgccaacccgcccgtcaacgcgctccaccccatcatcatcgccgggctcaaggacaagtacgcggaggccgcgcgccgcgacgacgtcaaggccatcgtgctcaccggtgctggaggcaagttctgcggaggatttgatatcaatgttttcacgaaggttcatcagactggggatgtgtcgcttatgccagatgtatctgttgagcttgtgtcaaacatgatggaagagggcaaaaaaccttctgttgcagctattcaaggccttgctctgggtggtggcctagaattggctatgggttgtcatgctcggatatctacccctgaagctcagcttgggttaccagagctgacgctgggcatcatccctggatttggaggaac

SEQ ID NO: 49104 - protein, 148 aa, Panicum virgatum
  misc_feature: Ceres CLONE 2047648
  misc_feature (18)..(148): Pfam Name: ECH Pfam Description: Enoyl-CoA hydratase/isomerase family
  misc_feature: SWISSPROT Homolog: EC 4.2.1.55 3-hydroxybutyryl-CoA dehydratase
MAAGAIRVTMEVGADGVALITIANPPVNALHPIIIAGLKDKYAEAARRDDVKAIVLTGAGGKFCGGFDINVFTKVHQTGDVSLMPDVSVELVSNMMEEGKKPSVAAIQGLALGGGLELAMGCHARISTPEAQLGLPELTLGIIPGFGG

SEQ ID NO: 49105 - DNA, 684 bp, Panicum virgatum
  misc_feature: Ceres CLONE 2047666
  misc_feature: Encodes the peptide sequence at SEQ ID NO. 49106
tgtagcattgaagaaaggtggaagcctcttgtgaagtatctgtatcacctgaatgtttcacgggatggcatgaagcgaatgctgctggtccaacctacaatattctgtcttgatttggagacagtgatagcaccaaaggtacaatttctacaagatattggtgtaaggagtgatgcaatcagcaatgtgtttgtgaagttccctccggtattaacttacagcctgtacaagaaaatacgcccagtggttatattcctgttgacaaaaggtggagtaaaacaggatgacattggaaaggttattgctctggatccacagctcttgggctgtagtattgcacacaagctagaagttagcgtcaagtacttccggtcactgggtatctaccactttgtgctcggtcagatggttgccgactttccagcacttctcagatacaacgtggacatcctaaagccaaaataccagtacttgaggcgtgtaatggtgcggccactgaaagacctcatcgaatttccgcggttcttcagttactccctggaggacaggatagagcctcggcaccaaacattagtggccaacaggatcaacatgaagctgcggtacatgctgacaggatctgatgaagaatttgcacagagggtgcgggaggccgttgagaggagagcgagattcgaagctagc

SEQ ID NO: 49106 - protein, 227 aa, Panicum virgatum
  misc_feature: Ceres CLONE 2047666
  misc_feature (1)..(213): Pfam Name: mTERF Pfam Description: mTERF
CSIEERWKPLVKYLYHLNVSRDGMKRMLLVQPTIFCLDLETVIAPKVQFLQDIGVRSDAISNVFVKFPPVLTYSLYKKIRPVVIFLLTKGGVKQDDIGKVIALDPQLLGCSIAHKLEVSVKYFRSLGIYHFVLGQMVADFPALLRYNVDILKPKYQYLRRVMVRPLKDLIEFPRFFSYSLEDRIEPRHQTLVANRINMKLRYMLTGSDEEFAQRVREAVERRARFEA

SEQ ID NO: 49107 - DNA, 668 bp, Panicum virgatum
  misc_feature: Ceres CLONE 2047667
  misc_feature: Encodes the peptide sequence at SEQ ID NO. 49108
ccacgctagcgcgcacgctagccgatgccgccccctctcataggcacgctcgtccacgctaccgccggtattgtgccgagctcgtttgagctggctgctgacttttgcagttggagacggccttatcccgcctgtcgcgcgcggaccggagccacgccaacgatgtccgccaccacggaggccggcgcggccacgggcggctatgaccgccggcgcaaggagttgcaggctttcgacgacaccaaggcgggcgtcaagggcctcgtcgacgccggcgtcacggccgtcccggccatcttccgccacccgccggaggccctgcgtgagctgtcgtcccggttctcggccgacgcgcccgccgccatcccggtcgtggacctctctgccgcgccgcgggaggaggtggccgcgcgggtgcggcgcgcggccgggacggtggggttcttccaggtggtcaaccacggcgtgcccgtcgagctcatggccagcgtgctcgccggtgtgaggcggttccacgagggctcccccgaggcgaagcggcgggtgtacaccagggatgccgcccgcaaggtgaggttcaactccaacttcggcctctttaagtttcaagaaaacaacttcgacctgttggagtccgcggcggccaactggcgcgacaccctcttctg

SEQ ID NO: 49108 - protein, 168 aa, Panicum virgatum
  misc_feature: Ceres CLONE 2047667
  misc_feature: SWISSPROT Homolog: EC 1.14.11.20 Desacetoxyvindoline 4-hydroxylase
MSATTEAGAATGGYDRRRKELQAFDDTKAGVKGLVDAGVTAVPAIFRHPPEALRELSSRFSADAPAAIPVVDLSAAPREEVAARVRRAAGTVGFFQVVNHGVPVELMASVLAGVRRFHEGSPEAKRRVYTRDAARKVRFNSNFGLFKFQENNFDLLESAAANWRDTLF

SEQ ID NO: 49109 - DNA, 693 bp, Panicum virgatum
  misc_feature: Ceres CLONE 2047681
  misc_feature: Encodes the peptide sequence at SEQ ID NO. 49110
gtctctctcacacattccccgacccctcctcgcctcccctctcccactgctgcagccgcgattccatctgctctcccgtcccttccgccgctcgccactccccccgccgccacgccgctagggtttcgcctcggggctccgctccccacttccgtgtcgcgcgagccacccgcccgccgcgcccccggcggggcgtccgcccgcccgcccgcggaggccgtcgctgtcgccgctcgcttcctcgctaggctctagggtgcggcgactggccggcgcgccgcgggaggagcagccatgtcgcagactaactgggaggcggacaagatgctggatgtttacatatacgactattttatgaagagaaatttgcaggcaactgcaaaggccttccaagcagaaggaaaggtctcttcagatccagttgcaattgatgcacctggtggctttcttttcgagtggtggtcagttttttgggatatattcatagcacgaacaaacgagaagcattcggatgttgcagcgtcatacattgagactcagctcatgaaagccagggagcaacagcagcaacagccacctcaacagaggcagcagcagccacagcatatacaaatgcaacaaatgctgctacaaagagctgtgcatcagcagcagcagcagcagcagcagcagcagcagcaacaacaacaacag

SEQ ID NO: 49110 - protein, 132 aa, Panicum virgatum
  misc_feature: Ceres CLONE 2047681
  misc_feature (10)..(36): Pfam Name: LisH Pfam Description: LisH
MSQTNWEADKMLDVYIYDYFMKRNLQATAKAFQAEGKVSSDPVAIDAPGGFLFEWWSVFWDIFIARTNEKHSDVAASYIETQLMKAREQQQQQPPQQRQQQPQHIQMQQMLLQRAVHQQQQQQQQQQQQQQQ

SEQ ID NO: 49111 - DNA, 737 bp, Panicum virgatum
  misc_feature: Ceres CLONE 2047683
  misc_feature: Encodes the peptide sequence at SEQ ID NO. 49112
aatcctccatagcctaatcctgctgccgcagtgccgctgtccggccaccgccgccgcttccgcttcgagctgtcccgcgaggcgacgagccgagagcggttcgccgccggaggagcatcgcttcttgctccgcgctgccctctccggtgtgtcttactcaggggctccaccactgacggcgcggttgccttgatggggagttggtgaccggtggagagtgttcatcagcccgagcaggaagatgagtagatctgcgagcacatttcaagtccttttggttttagcgacgactgttgctcagacacaatgggctagtgtatcaggcatgtactgcaatgacttgacaccaaacgttgaaaggccccacagtgcctcaataaccgattttggtgctgttggtgatggcacaactctgaacacgaaagcatttcagaatgcactcttctacctcaactcatttgcaaacaagggtggggcacagctgtttgtgcctgctggaaggtggttgaccgggagttttagcctaatcagccatctcactctatcactggacaaggatgcagtaattcttggatcaccagtaaaatgatttaacaaatggtttgtagacaataatttgcccactttatttgctgttttgcatcacctgtaatttcaaatctgtgattctcatgttgttctcaccttgtggaaagaaagtagaatgacctgcgcatcttaatctaacaataataaat

SEQ ID NO: 49112 - protein, 115 aa, Panicum virgatum
  misc_feature: Ceres CLONE 2047683
  misc_feature: SWISSPROT Homolog: EC 3.2.1.82 Exo-poly-alpha-galacturonosidase
  misc_feature: Functional homolog of the protein sequence given in SEQ ID NO 50944
  misc_feature: Useful for making plants with altered carbohydrate content
  misc_feature: Functional homolog of the protein sequence given in SEQ ID NO 51598
  misc_feature: Useful for making plants with altered cell wall content and/or composition
MSRSASTFQVLLVLATTVAQTQWASVSGMYCNDLTPNVERPHSASITDFGAVGDGTTLNTKAFQNALFYLNSFANKGGAQLFVPAGRWLTGSFSLISHLTLSLDKDAVILGSPVK

SEQ ID NO: 49113 - DNA, 649 bp, Panicum virgatum
  misc_feature: Ceres CLONE 2047684
  misc_feature: Encodes the peptide sequence at SEQ ID NO. 49114
attttagctttagaagaagcaatcgatactgaatgggtgtatatgtgggacaattttggcggttatttgcttctgttgcttggactgactgccaaagctgaacaaatacaggatgaagttcgtctaagactcttcttggatagcataggtctttctgaccttagtgccaaagaaattaagaaatggatgccagaagatcggaggcaattcgagctcattcaagaaagctacataagggaaaaagaaatggaagaggaggcattgatgcaaaggcgagaggaagaagggaagggaagagaaaggaggagggcattgctggaaagagaggaacggaaatggaaggaacttgaaatatcattgctttcttctattcctaatactggaagcagagatgctgcagctatggcagcagctgtcagagctgttggaggtgattctgctctggaagattcttttgcaagagatagggtatcttcaatagccaatcacatacgaaaggcacagttggctcggcgagcagaacagactggcattccaggcactgtatgcatacttgatgacgaactgaggagtactggtcgtcattgtggagaacttgagtcatgcctctgtctaagtcaaaaagttactttgtccattgctgtaatgg

SEQ ID NO: 49114 - protein, 216 aa, Panicum virgatum
  misc_feature: Ceres CLONE 2047684
  misc_feature: The sequence is a functional homolog of SEQ ID NO 24 in US patent 7189889
ILALEEAIDTEWVYMWDNFGGYLLLLLGLTAKAEQIQDEVRLRLFLDSIGLSDLSAKEIKKWMPEDRRQFELIQESYIREKEMEEEALMQRREEEGKGRERRRALLEREERKWKELEISLLSSIPNTGSRDAAAMAAAVRAVGGDSALEDSFARDRVSSIANHIRKAQLARRAEQTGIPGTVCILDDELRSTGRHCGELESCLCLSQKVTLSIAVM

SEQ ID NO: 49115 - DNA, 705 bp, Panicum virgatum
  misc_feature: Ceres CLONE 2047689
  misc_feature: Encodes the peptide sequence at SEQ ID NO. 49116
atataggagcccccagcaggttccccatccgacgcggccgccgccccagcggcggcgaccgtcacctccggccaagctcccctgccccgctgatccgccggcgaccgtcatctacgtccgagcctgcttgctccggcgactgcgccccacctgccactcccgatggcagcgatggggaagctgcgcgccgccgcctccaactccggcgacctgcccctgtacgcgctgagcgagatcctgctgcgtttctcagccaaggagctctgccgcctccgcgccgtcagccccacctggcggtccctcacctacgaccgggccttcatcgctgcccacagggcccgccaccgggagccgctccttgtgttcgctcatggcgacgacgaccatgatcacaacgtcgacatcgtggatctgtccggcgagctcgtgaggcggatgccaagacccgagaacggcgccggcgtgcttggcactcgcctcgacctcgtccccgtcgcgtgcaggtaccggcacatggctctctgggtgctgaacccggccaccggtgctgctctggcgttgccagattgccactcggagtacatggggaacgggccggacaagcggttcctctttggctatggctttgtggagaggtatgcattcggccgggtctctaccggagagtacaaggcactccgcatcacccgctactcttttgactct

SEQ ID NO: 49116 - protein, 177 aa, Panicum virgatum
  misc_feature: Ceres CLONE 2047689
  misc_feature (9)..(56): Pfam Name: F-box Pfam Description: F-box domain
MGKLRAAASNSGDLPLYALSEILLRFSAKELCRLRAVSPTWRSLTYDRAFIAAHRARHREPLLVFAHGDDDHDHNVDIVDLSGELVRRMPRPENGAGVLGTRLDLVPVACRYRHMALWVLNPATGAALALPDCHSEYMGNGPDKRFLFGYGFVERYAFGRVSTGEYKALRITRYSFD

SEQ ID NO: 49117 - DNA, 617 bp, Panicum virgatum
  misc_feature: Ceres CLONE 2047696
  misc_feature: Encodes the peptide sequence at SEQ ID NO. 49118
acccggatctcgcgcgcgacgcaggcagaccccgccacctcccagaagcttctagaaggccctccccggcgccatccagctcccgcgcggatgagcggcggctcgggccccctcccctactcgatgcgcgatgtggacgacggcggcgcctacaacaacgccaagttccgccaccgttcgcgcctcaagatagttttacagtcccaggctactaacagcagcaagtactgttgtggaaagttcactgttggtaaattcttgagcctgttgatggtttctggcttattatacttatttctgcacaaaagcccagagggtcttgtacctgatgagctactcggcaaagaggtaaataataacaatgtcaggagagctcccaatattcgcacattttggagaaaaccaccaaggctgcccccacgtctcccaccaaatgaaatttacaaaaataattctctgcttcagcagtctccatctgagtggacatctaggcagaagaaagttaaagaagcatttgaacatgcatggtctggttacaggaattatgcgatgggttatgatgagcttatgcctttgagccacaggggcactgatggattaggaggtttaggtgctac

SEQ ID NO: 49118 - protein, 175 aa, Panicum virgatum
  misc_feature: Ceres CLONE 2047696
  misc_feature: SWISSPROT Homolog: EC 3.2.1.113 Mannosyl-oligosaccharide 1,2-alpha-mannosidase
  misc_feature: Functional homolog of the protein sequence given in SEQ ID NO 51764
  misc_feature: Useful for making plants with altered carbohydrate content
MSGGSGPLPYSMRDVDDGGAYNNAKFRHRSRLKIVLQSQATNSSKYCCGKFTVGKFLSLLMVSGLLYLFLHKSPEGLVPDELLGKEVNNNNVRRAPNIRTFWRKPPRLPPRLPPNEIYKNNSLLQQSPSEWTSRQKKVKEAFEHAWSGYRNYAMGYDELMPLSHRGTDGLGGLGA

SEQ ID NO: 49119 - DNA, 565 bp, Panicum virgatum
  misc_feature: Ceres CLONE 2047714
  misc_feature: Encodes the peptide sequence at SEQ ID NO. 49120
actcgccgcaacttctcaccagggtagggagcacgccgccgaagagctagcccctgcgcctccctccgccgccaaaatggtgaacgttcctaagaccaagaagacctactgcaagaacaaggagtgcaagaagcacactctccacaaggtcactcagtacaagaagggtaaggacagcctgtctgcccagggaaagcgtcgttacgaccgcaagcagtcaggatatggtggtcagaccaagcccgttttccacaagaaggccaagaccaccaagaagattgtgctgaagctgcagtgccagagctgcaagcactactcccagcacgctatcaagaggtgcaagcattttgagattggtggagacaagaagggcaagggaacatctctcttctaagctgctcttcacctacctggatgctgaagttgtggtgttcttaatactctatgtcgaatgtctatgttactaggagtttaaaagcagactgtgctatgtattcaaatttcaatgtctgacatttacttctaagagttggtcgacttttgcctgaatgaagttttgtagctc

SEQ ID NO: 49120 - protein, 105 aa, Panicum virgatum; identical to SEQ ID NO: 44397
  misc_feature: Ceres CLONE 2047714
  misc_feature (19)..(95): Pfam Name: Ribosomal_L44 Pfam Description: Ribosomal protein L44

SEQ ID NO: 49121 - DNA, 479 bp, Panicum virgatum
  misc_feature: Ceres CLONE 2047736
  misc_feature: Encodes the peptide sequence at SEQ ID NO. 49122
agttgagtgtgctccatcaacaagcaaatcaacctcgcctcgatctcccaagcatcattatgcgatcatcttcttcctagatgtcttgtctcctgcagatcacgctacaactgcggttccagctgaaactgcgcctagatgtaccctgaccttgaggagaagagcagcggcggtgctcaggccaccgtcgtcctcggcctgtccccggagaagaacgcccgccacttcgaggcggcggcggaggccggtgagaccgcccacgcctgcaagtgcgacaacagctgcacctgctacccctgcaactgctgatttggaaggggaacgtacactcctgcgcgcctgctagatactgcctactctgcttgtgtgtgacttgattgaacgagattaacgatgagcctgaaccaacgtgcccgacgtatcggatcggctccagcctcatccagcatgcatgcctcctctgcccttatgcgagcttt

SEQ ID NO: 49122 - protein, 56 aa, Panicum virgatum
  misc_feature: Ceres CLONE 2047736
  misc_feature (1)..(56): Pfam Name: Metallothio_2 Pfam Description: Metallothionein
MYPDLEEKSSGGAQATVVLGLSPEKNARHFEAAAEAGETAHACKCDNSCTCYPCNC

SEQ ID NO: 49123 - DNA, 559 bp, Panicum virgatum
  misc_feature: Ceres CLONE 2047761
  misc_feature: Encodes the peptide sequence at SEQ ID NO. 49124
gagcttcccgtaaaccctaatccctcctgaatctttccccgcctccatctcgcgctcgattcgaatccgagccccctcgcttgctgctgctgctgctgctgctgctgctgcaatggaggacccagctgtcgaggaggccgaggtgagcggtgccgcagagttcgctccggcgcttatcgccgcccacccccacggaaactccgtcgccgtcgccatcgggccggagctccgcgtgtttgatctccagtaaataccctctccggtattcgctcaaatcgctgcttcatgattaacactgaacctcgtatgtagaaagagttcgtgttctgattacgctgtcggtagattttgatggaggatgtgtggtagtgccttttttgaattgagcctaactgctcattgtccagctttagagttgttatatatatatatatatatatatatatatatatatatatatatgtatatatatatatatatatatatatatatatatatatatatatatatatatatatatatatatatatatatatatatatatatatatatatatata

SEQ ID NO: 49124 - protein, 45 aa, Panicum virgatum
  misc_feature: Ceres CLONE 2047761
  misc_feature: Functional homolog of the protein sequence given in SEQ ID NO 51765
  misc_feature: Useful for making plants with altered protein content
MEDPAVEEAEVSGAAEFAPALIAAHPHGNSVAVAIGPELRVFDLQ

SEQ ID NO: 49125 - DNA, 675 bp, Panicum virgatum
  misc_feature: Ceres CLONE 2047825
  misc_feature: Encodes the peptide sequence at SEQ ID NO. 49126
gtccagagctcagaccatcttcccagcacactccggcgatggcgccgcccggggacccgccgccggcgaccaagtacttctggggcgacacccccgagcccgacgagtactacgccgcgcaggggctccggcacgccgagtcctacttccagtcccctcacggccgcctcttcacccacgccttccacccgctcgccggcgacgtcaagggcgtcgtcttcatgacccacggctacggttccgactcctcgtggctcttccagaccgccgccatcagctacgcgcgctgggggtacgccgtcttctgcgccgacctcctcggccacggccgctccgacggcctccgcgggtacgtcggcgacatggaggccgccgccgcggcgtccctcgctttcttcctctccgtgcgcgccagcgcggcgtacgccgcgctcccggcgttcctgttcggcgagtccatgggcggcgccgccacgctgctcatgtacctccgctccccgccgtccgcgcgctggacggggctcgtgctctcggcgccgctcctcgtcatccccgacggcatgtacccgtcccgcctccgcctcttcctgtacggcctcctcttcggcctcgccgacacctgggccgtgctcccggacaagaggatggtggggaaggcaccccaccacggattaa

SEQ ID NO: 49126 - protein, 212 aa, Panicum virgatum
  misc_feature: Ceres CLONE 2047825
  misc_feature: SWISSPROT Homolog: EC 3.1.1.23 Acylglycerol lipase
MAPPGDPPPATKYFWGDTPEPDEYYAAQGLRHAESYFQSPHGRLFTHAFHPLAGDVKGVVFMTHGYGSDSSWLFQTAAISYARWGYAVFCADLLGHGRSDGLRGYVGDMEAAAAASLAFFLSVRASAAYAALPAFLFGESMGGAATLLMYLRSPPSARWTGLVLSAPLLVIPDGMYPSRLRLFLYGLLFGLADTWAVLPDKRMVGKAPHHGL

SEQ ID NO: 49127 - DNA, 651 bp, Panicum virgatum
  misc_feature: Ceres CLONE 2047827
  misc_feature: Encodes the peptide sequence at SEQ ID NO. 49128
agaccatggatgcgagtacatgactggaggtactgtggttatccttggaaaaacaggacggaactttgctgctgggatgagtggaggcattgcttatgtttatgatgttgatgggaaattcagttctcgctgcaacaatgagttagttgatctatatcctgtcgaggaagaggatgacatcatcacattgaaaatgatgattgaacaacatcgacgcaacactgagagtgttttagccagagacatactctctgactttagtaatcttcttccaaaattcgtaaaagtatatccaagggattataagagggttttggaaaacatgaaagtggaaaaggctgctgctaagccggcaaaggatcctaagatggcaaatggtatttctgtgacaaccaagaaagtacaacctgatcagtcagctggccgaccaacacgtgttaccaatgccaaaaagtaccggggttttatttcatatgagcgagagagtatttcttaccgagatccaaaagagcgtgttaaagattggaaggaagttgcgattgagtcaacaccgggcccgctattgaacacacaatctgctcgctgtatggattgtggcacttcctttctgtcatcaggaaagctcaagtgctggctgtcctcttggaaata

SEQ ID NO: 49128 - protein, 216 aa, Panicum virgatum
  misc_feature: Ceres CLONE 2047827
  misc_feature: SWISSPROT Homolog: EC 1.4.1.14 Glutamate synthase (NADH)
DHGCEYMTGGTVVILGKTGRNFAAGMSGGIAYVYDVDGKFSSRCNNELVDLYPVEEEDDIITLKMMIEQHRRNTESVLARDILSDFSNLLPKFVKVYPRDYKRVLENMKVEKAAAKPAKDPKMANGISVTTKKVQPDQSAGRPTRVTNAKKYRGFISYERESISYRDPKERVKDWKEVAIESTPGPLLNTQSARCMDCGTSFLSSGKLKCWLSSWK

SEQ ID NO: 49129 - DNA, 656 bp, Panicum virgatum
  misc_feature: Ceres CLONE 2047843
  misc_feature: Encodes the peptide sequence at SEQ ID NO. 49130
atgacaattccgataaactgaaacccctgctgctagcttgtaactctatagcccagacttgtggaaatcattgtggcactgcccctagtgcctgtgctgaagagaatggctacaaactctgtcaacaacgacgcaaatttttgagttattctaatttcttctgctgcgctgcgcatcttgtgctgtgcgaaagattattgtggattatatcattcaggtgatgtggcgaagtctttgactgctgaatgtatattcgagaatacaagaataataatcaaaagttcctcccttcaaccaaggaggccgagtgggagatgcataacaagtgagcgtgatgcactgctctcattcaaagccagcttatcagacccccgaggccaactctcatcatggcatggagaggattgctgcgagtggaagggtgtccactgcagcaacagaaccagccacgttgtcaagctcaacctgcacggccaaaacttttactgcggccactattgtactgattgtgtctacggactgggaggtgagatgagctcatctttagttgaattaaaacatttgaagtatttcgacttgagctgtaacaacttcagtacggcaagcatcccaaggtttatcgggtctcttaaaagtcttgaacatcttaacctttc

SEQ ID NO: 49130 - protein, 41 aa, Panicum virgatum
  misc_feature: Ceres CLONE 2047843
  misc_feature: Functional homolog of the protein sequence given in SEQ ID NO 51766
  misc_feature: Useful for making plants with altered cell wall content and/or composition
MSSSLVELKHLKYFDLSCNNFSTASIPRFIGSLKSLEHLNL

SEQ ID NO: 49131 - DNA, 681 bp, Panicum virgatum
  misc_feature: Ceres CLONE 2047848
  misc_feature: Encodes the peptide sequence at SEQ ID NO. 49132
cctttcgctcctctcgccgctttgggttggggtttaagcgagtgtgcgggaggccggaggcgacgacgacggcgccggcgtcggagaagaagaagcagccagctctcgtgtatatgtcttcttgccccttctccgatctggtggtcgttgtgctcatcgtcgccgtcctcctccgcgccctcgcctgctccagccgatctatgcgccaggggctcaacggctggaacaaatcctcgtcgatgctcagggacgggttcggggtgaagtattccggattcctccacataaggccgtgtggcttctgtcgaggagactgacggattcggtcgattcgcgcccggctccgtccaatttttgcacccgcctgagaaattttcatcttttctagagtttttttccccttcagttttagcaattttggtgtcaagtttgggagtcctctccggcacaagagatagaagagagatggctccgttgaaccaccagcagattctcatcaggaaggccctggcgaagaagcccaagagcaagaggatctccgggtttggccttaaaccctccgctgctctcctcaaggccaggccgcagcagcagcagccggcgccggtccagcagaggcgccgcgtccgcgtcctctttgaggaccctgacgcgacggactcggactccgacgacgaagag

SEQ ID NO: 49132 - protein, 71 aa, Panicum virgatum
  misc_feature: Ceres CLONE 2047848
  misc_feature: The sequence is a functional homolog of SEQ ID NO 1191 in the 10/374,780 US patent application
  misc_feature: The sequence is a functional homolog of SEQ ID NO 1383 in the 10/412,699 US patent application
MAPLNHQQILIRKALAKKPKSKRISGFGLKPSAALLKARPQQQQPAPVQQRRRVRVLFEDPDATDSDSDDE

SEQ ID NO: 49133 - DNA, 698 bp, Panicum virgatum
  misc_feature: Ceres CLONE 2047861
  misc_feature: Encodes the peptide sequence at SEQ ID NO. 49134
atcacatctcgacggggaaaaaagaaaaggaaaataattttaaaaaaatctcaagatccaggtacaggcatccttccacgactccacgtttccaccgcagcttgacctctctccccgccctcggcgtcacctccttcttctgccgcggagtggagatccatctgagctaggattgatctccagttcccggtggtggttgtttcttgctcgttaggcctccaatatgggtctggcgaaggatgtcgccgagatggaggagggaactttggagatcggcatggagtatagaactgtctctggtgtggcaggaccactggttatcctggacaaagtaaagggcccgaagtatcaggaaattgtgaacattcgattgggagacggcaccactcgtcgtggtcaagttctagaagtcgatggcgaaaaagctgttgtgcaggtctttgaaggtacctctgggatagacaacaaatatactaccgtgcagtttacaggcgaggttctgaaaactcctgtctcacttgatatgcttgggcgaatttttaacggttctggaaaacctattgataatggtcccccgatattgcctgaggcctacttggatatttctggaagttctatcaacccaagtgagaggacctatccagaagagatgattcaaacaggaatatccaccatagatgtgatgaactcgattgctc

SEQ ID NO: 49134 - protein, 158 aa, Panicum virgatum
  misc_feature: Ceres CLONE 2047861
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLAKDVAEMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIA

SEQ ID NO: 49135 - DNA, 695 bp, Panicum virgatum
  misc_feature: Ceres CLONE 2047864
  misc_feature: Encodes the peptide sequence at SEQ ID NO. 49136
attgtcagaaaaagtatcgaggatgcaatcccaaaggctgtaatgcactttctggtgaactatacaaagcgggatctgcacagttttttaattcgcaaactatacagagagaacctgctcaatgaattgatgagggaaactgacgaagtacttatcagacggcagcgcattcaagaaacacttgaagttcttgagcaggcacacaggacacttgaagaatttccccttgaagctgaaaagattgagaagggctacgaccttgctggacatgcaactgggctgccaaaaatccatggactcggtgaggatggcccaaatggcatcttcacatcttcccctaatcgctatggtgcacaccaaacatctcatctagtcatataaaccagcatgtgtcagtggcattatatttgtacgtggaccccaaaggagcatggcttcccgcgtggtcatgatcctgccaaggaatttgtgggcgatgagcttgaacctgtaaatgccatttatttgctagcaagctgtttgctttctagtcggaagctattgctgatggagagccctcattacgtattgctgaagttgccaggacaaggcagatatatgcaagtgaataggggtaacaggttagttgtatagaccagtgttcaactagcccaggtatcaattttttgttgcctcggagaatgaggacatctgtt

SEQ ID NO: 49136 - protein, 126 aa, Panicum virgatum
  misc_feature: Ceres CLONE 2047864
  misc_feature (1)..(74): Pfam Name: GED Pfam Description: Dynamin GTPase effector domain
  misc_feature: SWISSPROT Homolog: EC 3.6.5.5 Dynamin GTPase
IVRKSIEDAIPKAVMHFLVNYTKRDLHSFLIRKLYRENLLNELMRETDEVLIRRQRIQETLEVLEQAHRTLEEFPLEAEKIEKGYDLAGHATGLPKIHGLGEDGPNGIFTSSPNRYGAHQTSHLVI

SEQ ID NO: 49137 - DNA, 616 bp, Panicum virgatum
  misc_feature: Ceres CLONE 2047865
  misc_feature: Encodes the peptide sequence at SEQ ID NO. 49138
agcctgagacctaatccaatcaagcatttacacgaaaacaaaagaagaaatcatgccgtgctgttcgctccatgatggcccaagcagaggtaacatcattggtcgtacgtgctccaagcagcagctcatgaagtccgctatagctgtactggcactgatgctggtttataggtgtggatacgtccgttgcgcgacggtcccccaagacagcacggacatgctggcactgatcgatttcaggcaagcaatcaccggagatcccaaaggattcttctattcctggaacaacagtgtcaactactgcaattggaatggggtcacatgcagcaaaacgcaccgagggcgcgtcagggagctcaacctcacaggccagagcttggaaggcaggatctctctatctcttgggaacttaaccatacttaagatactcgatctctcctcaaatagcctctctgctcagttgcccgatcttaactgcctccgtaagctgcagttccttgttatgagcaataacaagttgcagcactctgcttctaactcacttacaaactgttccaacttactatacctagacctttctgcaaacaatttagcgggttcatccccccccccccca

SEQ ID NO: 49138 - protein, 187 aa, Panicum virgatum
  misc_feature: Ceres CLONE 2047865
  misc_feature (52)..(92): Pfam Name: LRRNT_2 Pfam Description: Leucine rich repeat N-terminal domain
  misc_feature: SWISSPROT Homolog: EC 2.7.11.1 Non-specific serine/threonine protein kinase
MPCCSLHDGPSRGNIIGRTCSKQQLMKSAIAVLALMLVYRCGYVRCATVPQDSTDMLALIDFRQAITGDPKGFFYSWNNSVNYCNWNGVTCSKTHRGRVRELNLTGQSLEGRISLSLGNLTILKILDLSSNSLSAQLPDLNCLRKLQFLVMSNNKLQHSASNSLTNCSNLLYLDLSANNLAGSSPPP

SEQ ID NO: 49139 - DNA, 687 bp, Panicum virgatum
  misc_feature: Ceres CLONE 2047875
  misc_feature: Encodes the peptide sequence at SEQ ID NO. 49140
agcgccaataatccaagccatttctttgtgttttgcaagaaagctagaaagaaatgggaagcaaggatcttaagagtgtaatcatgtgtgtgctgatactagggataatcttggatgtagagggcatgagttgctgcaggaacactacggcaagaaactgctacaacatgtgtcgtatgaccccgccagcttgtgcagcaagatgtggctgtataatcataagtggcaatcaatgcccatgctaccctagtttgaaccttcttccgaactccggtgaaccagatgccattaagtactgcaacatgggatgtgtgtcttctatgtgcgacaccatgaacaatgaatctgtcggtgaagagatgaaaatcgacagggaacactgcagtgatgcatgtgaccgtttttgcaatggggatgcccgcattgcatccgttgctgcttaatcatgcatgtgcatgccatgggatatgttgtcgaaggccaaggtctcatcatgatggatggtattctaaataaaggatctcatgggacagaatcaagtcagtgtgtgtcatcttgtacatatgtacgtgtgtgctcttttatttgtttctttgttacaataaaggtaacctcacgatggatgccatgttattacctgtatgtgctcatctctatcgacatgtatgcatgtagccttggccagtt

SEQ ID NO: 49140 - protein, 129 aa, Panicum virgatum
  misc_feature: Ceres CLONE 2047875
  misc_feature (25)..(67): Pfam Name: Thionin Pfam Description: Plant thionin
MGSKDLKSVIMCVLILGIILDVEGMSCCRNTTARNCYNMCRMTPPACAARCGCIIISGNQCPCYPSLNLLPNSGEPDAIKYCNMGCVSSMCDTMNNESVGEEMKIDREHCSDACDRFCNGDARIASVAA

SEQ ID NO: 49141 - DNA, 700 bp, Panicum virgatum
  misc_feature: Ceres CLONE 2047892
  misc_feature: Encodes the peptide sequence at SEQ ID NO. 49142
agatgtggtagatgggtattctccaacacttccccatcttaaaggtcttcagaatggtgacaccgccacaagtgcaatcaagcaggttgcatctgggcgttttggagttacacctacatttttagtaaatgctgagcaaattgagataaagatcgcgcaaggtgcgaagcctggtgaaggtggtcaacttcctgggaaaaaagtcagcgcatacattgctcgtctaaggaattccaaacctggagttcctcttatatccccacctccacaccatgacatatattccattgaggatcttgcacagttaatttatgacctccatcagatcaatcctaaagccaaggtgtctgtaaagcttgtagctgaagctgggattggaactgtagcttctggagtttcaaagggaaatgcagatgtaattcagatatcaggtcatgatggtggtactggagctagcccaatcagctcaatcaaacatgctgggggtccatgggaacttggtcttacagaaacgaatcagacactcatacaaaatggattgagagagagggtggtacttagggtggatggtggattcaggagtggtcaagatgttcttatggctgctgccatgggcgctgatgaatatggttttggttctgtagctatgattgctactggctgtgtcatggcacgcatttgccacacaaataaattgccc

SEQ ID NO: 49142 - protein, 232 aa, Panicum virgatum
  misc_feature: Ceres CLONE 2047892
  misc_feature (1)..(232): Pfam Name: Glu_synthase Pfam Description: Conserved region in glutamate synthase
  misc_feature: SWISSPROT Homolog: EC 1.4.7.1 Glutamate synthase (ferredoxin)
DVVDGYSPTLPHLKGLQNGDTATSAIKQVASGRFGVTPTFLVNAEQIEIKIAQGAKPGEGGQLPGKKVSAYIARLRNSKPGVPLISPPPHHDIYSIEDLAQLIYDLHQINPKAKVSVKLVAEAGIGTVASGVSKGNADVIQISGHDGGTGASPISSIKHAGGPWELGLTETNQTLIQNGLRERVVLRVDGGFRSGQDVLMAAAMGADEYGFGSVAMIATGCVMARICHTNKL

SEQ ID NO: 49143 - DNA, 329 bp, Panicum virgatum
  misc_feature: Ceres CLONE 2047924
  misc_feature: Encodes the peptide sequence at SEQ ID NO. 49144
ggttgctggggcttgcatctatatggtcctagctccctgtatgggtcaacgctgcacccatgttattttgatatcgcttggacaggcacccgatagaagaaatggagccatggacaacgtcctaaactgccatcttagaccatggtggacccacttttatgacctcatggggaaaattttgggtctcggttattgatgtgtctgaatcgactgatcacaaccctgtgccacctcaactatggctgctaccatatagcctgccatttcatcgagcgacgatgtggagttattgcccactggtgcctttgccaagccgtgacatttacggt

SEQ ID NO: 49144 - protein, 56 aa, Panicum virgatum
  misc_feature: Ceres CLONE 2047924
  misc_feature: SWISSPROT Homolog: EC 5.4.99.8 Cycloartenol synthase
  misc_feature: The sequence is a functional homolog of SEQ ID NO 6 in US patent 7122717
MTSWGKFWVSVIDVSESTDHNPVPPQLWLLPYSLPFHRATMWSYCPLVPLPSRDIY

SEQ ID NO: 49145 - DNA, 692 bp, Panicum virgatum
  misc_feature: Ceres CLONE 2047940
  misc_feature: Encodes the peptide sequence at SEQ ID NO. 49146
atcttcgtaccaccaaacctcgcgcagcagcagccagcaacagcaacgacgagaacgcgtaaacgaggcagaccctcccgcgattacgaagagcccaggcacgccgaagcggcgaagcgccgagaaaggaagggagcaacatccatggggctcgactactacaagatcctgggcgtcgacaagggcgccaccgacgacgacctcaagaaggcctaccgcaagctcgccatgaagtggcaccccgacaagaaccccaacaacaagaaggaggccgagaacaagttcaagcagatctcggaagcatacgaggtaagcatcctgaggagatccatggcggattcataagcctgtccagtcgagtccggcaatgtagtgacgcgcccttgatgcgccgtgctgcgacaggtcctgagcgaccctcagaagcgcgcggtgtacgaccagtacggcgaggaggggctcaaggggcaggtgccgccgccgggcgccggcggggcgggccccgggggtgccaccttcttctccacgggcggcgacgggccgacgatgttccggttcaacccgcgcaacgcggaggacatcttcgcggagttcttcggcgggtccagcctcttcggcggcatgggtggcggcatgggcggcggcgccggcggaatgggggggaggatgcccggcatgcggaccggtgggac

SEQ ID NO: 49146 - protein, 66 aa, Panicum virgatum
  misc_feature: Ceres CLONE 2047940
  misc_feature (4)..(65): Pfam Name: DnaJ Pfam Description: DnaJ domain
  misc_feature: Functional homolog of the protein sequence given in SEQ ID NO 50153
  misc_feature: Useful for making plants with modulated heat sensitivity
MGLDYYKILGVDKGATDDDLKKAYRKLAMKWHPDKNPNNKKEAENKFKQISEAYEVSILRRSMADS

SEQ ID NO: 49147 - DNA, 693 bp, Panicum virgatum
  misc_feature: Ceres CLONE 2047951
  misc_feature: Encodes the peptide sequence at SEQ ID NO. 49148
gattcccccggcacagcacacttttttccccctctcctgttcgttcgctctgatcttgtttggatcatgaaaacaatgagcaggcggaacagccgcaccatctatgtaggcaacctccctggggacatccgtgagagggaagttgaggacctcttctacaagtatggtcgaattttggatattgacctgaagatacctccaagacctcctggatacgctttcgttgagtttgaggacccacgtgacgctgatgacgcaatttatgggcgtgatgggtataactttgatggctacaggttgcgggttgaattagctcatggtggaagaggtcagtcttactcttatgatcgttctagcagctatagcagcacacgccgtggaggtgtttctaggcgctctgattactgtgttatggtcacgggtttaccttcatcagcatcatggcaagatctgaaggaccacatgcggcgcgccggtgatgtttgtttctctgatgtataccgtgaggccggagaaactattggaattgtggattatacaaactatgaagacatgaaatatgcgatcaagaagcttgatgactcactgttcaggaatgcattttctagggcgtacatcagagtgagggagtatgatgctagatcacgaagcagaagccgtagccgctcgtactcgagaagccccagttacagc

SEQ ID NO: 49148 - protein, 205 aa, Panicum virgatum
  misc_feature: Ceres CLONE 2047951
  misc_feature (9)..(77): Pfam Name: RRM_1 Pfam Description: RNA recognition motif. (a.k.a. RRM, RBD, or RNP domain)
  misc_feature (112)..(179): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Functional homolog of the protein sequence given in SEQ ID NO 51213
  misc_feature: Useful for making plants with altered alkaloid content
  misc_feature: Useful for making plants with altered lignin content
MSRRNSRTIYVGNLPGDIREREVEDLFYKYGRILDIDLKIPPRPPGYAFVEFEDPRDADDAIYGRDGYNFDGYRLRVELAHGGRGQSYSYDRSSSYSSTRRGGVSRRSDYCVMVTGLPSSASWQDLKDHMRRAGDVCFSDVYREAGETIGIVDYTNYEDMKYAIKKLDDSLFRNAFSRAYIRVREYDARSRSRSRSRSYSRSPSY

SEQ ID NO: 49149 - DNA, 693 bp, Panicum virgatum
  misc_feature: Ceres CLONE 2047952
  misc_feature: Encodes the peptide sequence at SEQ ID NO. 49150
ggccgccgccctgctgcctggacacgccgccgccgcggcgcccgcccgcgccacataaaaaatccctccgtgcccggccgccggccgcgagctgtcccgactcgacaggagcagcaaatctctgtggctctccaccgcctcgatccaatcgaagcgggcacgagtcggttccccctccccttcgcaacccccgccccgcgcgatggactcggcgtcggcggggctgaagccctcggcgctggacctgctggcggcgctgctgacggggcggggccccgaggggggcggggcgcactgggcgtccccgctcgccgagaaccgccacctgctcgtgctgctcaccacctccctcgccgtgctcgtcggctgcggggtcgcgctgctcgtccgccgctccgccgcgccccgcgccgggctggctgcccaggcgcagccgcggcccctcgccgcgaagcccagggacgagccggaccccgacgacggcaggcagagggtcgtcatcttcttcgggacgcagaccggcaccgccgagggcttcgccaaggcgctggcggaagaggccaaggcgaggtacgacagagccgtcttcaaggttgtcgatctggatgactacgccgccgaggacgaggagtacgaggagaagctcaagaaggagaacattgcgttgttcttcctggcaacttatggtgatgg

SEQ ID NO: 49150 - protein, 163 aa, Panicum virgatum
  misc_feature: Ceres CLONE 2047952
  misc_feature: SWISSPROT Homolog: EC 1.6.2.4 NADPH--hemoprotein reductase
MDSASAGLKPSALDLLAALLTGRGPEGGGAHWASPLAENRHLLVLLTTSLAVLVGCGVALLVRRSAAPRAGLAAQAQPRPLAAKPRDEPDPDDGRQRVVIFFGTQTGTAEGFAKALAEEAKARYDRAVFKVVDLDDYAAEDEEYEEKLKKENIALFFLATYGD

SEQ ID NO: 49151 - DNA, 684 bp, Panicum virgatum
  misc_feature: Ceres CLONE 2047953
  misc_feature: Encodes the peptide sequence at SEQ ID NO. 49152
aacaatttctctggcaatcttccatactctataacaaacatggcttcaattgagtacctcaatctcagccacaactcactttccagtcaaatgggtgatctatttggaaacctcaattcactttcagaactagatgtgtctttcaacaaattgacaggggaccttcccaattctattggttctttatcaaatctttcaagcctttatatgcagaacaatcagttcacaggttctgtcaatgttctccgtggcctaagcgctgcccttactacattaaacattgcaaacaacaatttcagtggttggataccaaaagaattcagctccatccccgatctaacacttggaggaaactcatttgccaatggacctgctcccccgccaccaccttttatgccaccaccccctcaaaggccacggaatcgccctaagcatcctcaggggcaagaagatactccaaaagggtcccaaagccccaccattcaaagtgacaagaagcaaggccttgggacaggtctgcttgtggggataattgctggatcgatagttgctgccttatgtgtgcttctgcttttggtatgctgcatgcgtaatgttcggaaaagaaaggatgatgccagcagtgaaacaaaagattttgtaggtccactaacagtgaacatagagagagcttccagcagggaa

SEQ ID NO: 49152 - protein, 227 aa, Panicum virgatum
  misc_feature: Ceres CLONE 2047953
  misc_feature: SWISSPROT Homolog: EC 2.7.11.1 Non-specific serine/threonine protein kinase
NNFSGNLPYSITNMASIEYLNLSHNSLSSQMGDLFGNLNSLSELDVSFNKLTGDLPNSIGSLSNLSSLYMQNNQFTGSVNVLRGLSAALTTLNIANNNFSGWIPKEFSSIPDLTLGGNSFANGPAPPPPPFMPPPPQRPRNRPKHPQGQEDTPKGSQSPTIQSDKKQGLGTGLLVGIIAGSIVAALCVLLLLVCCMRNVRKRKDDASSETKDFVGPLTVNIERASSR

SEQ ID NO: 49153 - DNA, 700 bp, Panicum virgatum
  misc_feature: Ceres CLONE 2047960
  misc_feature: Encodes the peptide sequence at SEQ ID NO. 49154
tcgtcacatctccccattctcgccgccccgctccgttctcccctcgctccgttggattaggggggtcttcctctgctcgccggagctcggagctcggagctcgtcccccccatggcggatgaagaggtatctgatccaaaggcgctccttgaggaacgctcaaaggctaagtgtgtgtcacagtggtacgaatatcagaaatgtgtcaagagaattgaaaatgacgagactgggcacaagcactgtactggccagtacttcgattactggaaatgtgttgacaagaatgttgctgagaaactctttgatctgctaaaatgacaaggaaaatgccctctttcaattttctactcaaaattggtaataattgtatcgcctgtgcaccatatagactattcaggtgcttaatatctgtcagagaagttttgcctcttgtgtaacacaacaaattttccactgccagtttacatttcatttccatcactagtattgaactttacagcaggtttcctcctgcataaagcattgttggataaagagattcaatggattattccaagattgtgcctcagcattaaatgctctagttgacctttattgcttttatagtgcatttttacgagcatatagccagtcatttgggtccatctaacttgtatatgaagactgaaataccaatcaaaactagatttgccatgag

SEQ ID NO: 49154 - protein, 69 aa, Panicum virgatum; identical to SEQ ID NO: 14672
  misc_feature: Ceres CLONE 2047960
  misc_feature (7)..(69): Pfam Name: UCR_hinge Pfam Description: Ubiquinol-cytochrome C reductase hinge protein

SEQ ID NO: 49155 - DNA, 606 bp, Panicum virgatum
  misc_feature: Ceres CLONE 2047969
  misc_feature: Encodes the peptide sequence at SEQ ID NO. 49156
acagttcttggtaataaccgggtggctgacaaggaagagggaacgcgcatgtggatctgagcagaagcgaatgagtctttcgcctagttcagacaatagctaggccagttccttctagcccccgtcttctactaagttgtgccgtgggcaagcagctatgagctgctatcccttcaggatttccaggatttagtgacttacaagcatggttgatcaaataaacgaagtcaaagacctggagcgcatatttactgatacaagtgcggagcccatcaagataacgtatgcagctattaaatatataaccaaaaatttcgccgtaaagataggtgatggtgggtttggtgtggtttacctgggtggacttcaaaacaggatggttgctgtgaagaatcttttccattcgaaggatctttctgataagcaatttttggatgaagttatctgtctaaagaaggtaaaccaccataatattgtaagatttctaggctattgtgcagatacagaatgtgaaatcatggaaatagaaggaaaacataggatagttgaggtgcaaaagagattgctctgctttgagtacgtgcctaagggaaaccttcttcgttt

SEQ ID NO: 49156 - protein, 133 aa, Panicum virgatum
  misc_feature: Ceres CLONE 2047969
  misc_feature: SWISSPROT Homolog: EC 2.7.11.1 Non-specific serine/threonine protein kinase
MVDQINEVKDLERIFTDTSAEPIKITYAAIKYITKNFAVKIGDGGFGVVYLGGLQNRMVAVKNLFHSKDLSDKQFLDEVICLKKVNHHNIVRFLGYCADTECEIMEIEGKHRIVEVQKRLLCFEYVPKGNLLR

SEQ ID NO: 49157 - DNA, 693 bp, Panicum virgatum
  misc_feature: Ceres CLONE 2047979
  misc_feature: Encodes the peptide sequence at SEQ ID NO. 49158
gccatcgtgacaagagagcaaagcatccatccggcagcgatccatcgcgttctcgcacaccttcgattccccaagtcgagcagatcgatcagccatggcggcggccgacgtgcacatggccgggggcgcggagacggagacggagacgttcgcgttccaggccgagatcaaccagctgctctccctcatcatcaacaccttctactccaacaaggagatcttcctgcgggagctcatctcaaactcatcagatgcgcttgacaagatccggttcgagagcctgacggacaagagcaagctggacgcccagcccgagctcttcatccgcctggtgcccgacaaggcctccaagacgctctccatcatcgactccggcgtgggcatgaccaagtccgacctcgtcaacaacctcggcaccatcgcgcgctccggcaccaaggagttcatggaggcgctggcggccggcgccaccgacgtctccatgatcggccagttcggcgtggggttctactccgcctacctcgtcgccgacaaggtcgtcgtcaccaccaagcacaacgacgacgagcagtacatctgggagtcgcaggccggcggctccttcaccgtcacgctccacaccaccggcgagcgcctcggccggggcaccaagatcacgctcttccttcaggacgaccagctcgagtacctgga

SEQ ID NO: 49158 - protein, 199 aa, Panicum virgatum
  misc_feature: Ceres CLONE 2047979
  misc_feature (39)..(194): Pfam Name: HATPase_c Pfam Description: Histidine kinase-, DNA gyrase B-, and HSP90-like ATPase
MAAADVHMAGGAETETETFAFQAEINQLLSLIINTFYSNKEIFLRELISNSSDALDKIRFESLTDKSKLDAQPELFIRLVPDKASKTLSIIDSGVGMTKSDLVNNLGTIARSGTKEFMEALAAGATDVSMIGQFGVGFYSAYLVADKVVVTTKHNDDEQYIWESQAGGSFTVTLHTTGERLGRGTKITLFLQDDQLEYL

SEQ ID NO: 49159 - DNA, 696 bp, Panicum virgatum
  misc_feature: Ceres CLONE 2047982
  misc_feature: Encodes the peptide sequence at SEQ ID NO. 49160
cctggagagttgcattgtgctccatcggaattcttcatgctgttcgacacaaataatgatggcctcatctcctttgccgagtacatcttttttgtaacattgctcagcattcccgagtcaaatttcagtgcggctttcaaaatgttcgacgttgaccatagcggggtgatcgacaaagaggagtttaagaaaataatggcactgatgcggtcttttaatagacaaggagccacccataaggatggcttacgtattggacttaaagttggccagcctgtggaaaatggtggagtggttgagttcttctttggtaatgatggaaatgagcctctacactatgataagtttacaaagtttttgaaggacttgcatgatgagattattcgtctggagttcagtcattacgatgtcaagtcatctaaaactataccagcgaaggattttgccttgtccatggttacttctgctgacatgaatcacatcagcatgctgcttgatagagttgatgatttggtcaataagcctgatctgaaggacatacgcatatcctttgaggagtttaaggcctttgcttatttgcgccgaagattggagccactgtcgatggccatcttcgcatatgggaaagtgaatggattgttgacaaagcaggatctaaaacgtgcggcgcaggatgatgggaacctgagcttggaa

SEQ ID NO: 49160 - protein, 231 aa, Panicum virgatum
  misc_feature: Ceres CLONE 2047982
  misc_feature (41)..(69): Pfam Name: efhand Pfam Description: EF hand
PGELHCAPSEFFMLFDTNNDGLISFAEYIFFVTLLSIPESNFSAAFKMFDVDHSGVIDKEEFKKIMALMRSFNRQGATHKDGLRIGLKVGQPVENGGVVEFFFGNDGNEPLHYDKFTKFLKDLHDEIIRLEFSHYDVKSSKTIPAKDFALSMVTSADMNHISMLLDRVDDLVNKPDLKDIRISFEEFKAFAYLRRRLEPLSMAIFAYGKVNGLLTKQDLKRAAQDDGNLSL

SEQ ID NO: 49161 - DNA, 570 bp, Panicum virgatum
  misc_feature: Ceres CLONE 2047989
  misc_feature: Encodes the peptide sequence at SEQ ID NO. 49162
catgcgcgttgcttgacgcgagctcatcggggacgacgacgccagccatgagcgggagcaagcgcgaccggcgccggtggcccctatggcgctgggccttggtctcttgcgtgctcgcgacgacggcggtggtggaggcgggaggcgcggaggtgaccgagctggacttcgaggagcgccggggcgagcggcgcgacctgctggtgctgcgggacacgctgcggtcggcgctggacctgcactccaactggacgggccccccctgccacggcgggcgcagccggtggcgcggcgtgtcgtgcgacggcgacggccgcgtggtgggcgtggcgctcgacggcgcgcagctcacgggcgcgctcccgcgtggcgcgctccgcggcgtgtcgcggctccaggcgctctccctgagcgggaacgcgctccacggcgcgctgccggggctcgacggcctgccgcgcctccgcgccctcgacctgtccagcaaccggttctcgggccccatcccgcgcgggtacgccacgtcgctgcgggacctcgcgcggctcgagctccaggacaacctgctca

SEQ ID NO: 49162 - protein, 174 aa, Panicum virgatum
  misc_feature: Ceres CLONE 2047989
  misc_feature: SWISSPROT Homolog: EC 2.7.11.1 Non-specific serine/threonine protein kinase
MSGSKRDRRRWPLWRWALVSCVLATTAVVEAGGAEVTELDFEERRGERRDLLVLRDTLRSALDLHSNWTGPPCHGGRSRWRGVSCDGDGRVVGVALDGAQLTGALPRGALRGVSRLQALSLSGNALHGALPGLDGLPRLRALDLSSNRFSGPIPRGYATSLRDLARLELQDNLL

SEQ ID NO: 49163 - DNA, 669 bp, Panicum virgatum
  misc_feature: Ceres CLONE 2048002
  misc_feature: Encodes the peptide sequence at SEQ ID NO. 49164
atccattcattaagtttctagcaagctctgcagcacgctagctagcttgctcttccacgaagctcggcgatctctctgcttaccaccccttccagcagctaatagctacctacctgactacttgtgccatggcaacaagatttatcgccgttgcggccgtgatggcagctgccctcgtcggcatggcgtcggcggcggtctacaacgtcggcgagccggccgggtcctgggacctgcggaccaactacggcgactgggccgcctccaagcggttccacccgggcgaccagatcgtcttcaggtactccccgcaggcgcacgacgtggtggaggtgagcaaggcggactacgactcctgctccaacgccaggcccgtcgccatccacacctccggcaacgacgccatcgccctgacctccaccggcacgcgctacttcatctgcggcatcaccggccactgcgatgggggcatgaagctccaggtcgacgtcgtgcccggcgccacctccctcgccccggccggcgctcccggcgccaacgccccggtctctccccagaccccttccacgcccgcttccgccgctaccaaggccaccgccaccggcttcgctctcgccgggttcttgctcgccgccagtctcctggtctaagtagttgctattgtgctgc

SEQ ID NO: 49164 - protein, 173 aa, Panicum virgatum
  misc_feature: Ceres CLONE 2048002
  misc_feature (34)..(115): Pfam Name: Cu_bind_like Pfam Description: Plastocyanin-like domain
MATRFIAVAAVMAAALVGMASAAVYNVGEPAGSWDLRTNYGDWAASKRFHPGDQIVFRYSPQAHDVVEVSKADYDSCSNARPVAIHTSGNDAIALTSTGTRYFICGITGHCDGGMKLQVDVVPGATSLAPAGAPGANAPVSPQTPSTPASAATKATATGFALAGFLLAASLLV

SEQ ID NO: 49165 - DNA, 719 bp, Panicum virgatum
  misc_feature: Ceres CLONE 2048054
  misc_feature: Encodes the peptide sequence at SEQ ID NO. 49166
accagtacgacggcattgccatcgcagcttcgcttctcaccttcttcctcctcccaactcggaaagcttttccttcttccctcgcggcgcagcctttttctgcgagaagcgaagctctcgcttagcagttctggtccaggcagggaggagctaacgttgatgaggggaagacagcagctcctcttgctgctcttcgtcttgaatgccgccggatccagaatcgcttccgcggacaccaacccgcaagatgcggctgctctcaaatctctgatgaagaaatggaaaaatttgccttctagctgggggaagtccgacgatccttgcggcgccggatgggatggtattttgtgcgatggaaacggaagggtcacatcactgaatttattcgctatgaccataagaggcactcttggcgatgatataggaagcctgactgaactaagggtcttggatctgtcctcaaatccagatcttggtggcccactgcctgctgctattgggaagttggttaagcttgaacaactagcattgattggttgtagtttcagtggtcctgttcccagtgaattaggcaacctgtcacaagtcaaattttttgctctgaactcaaataaattaacgggcagcatcccgcccctcgtaagaaagctttccagtgtcacctggctagaccttgctgacaacctgctgactggaccactccaattccaaggacaatg

SEQ ID NO: 49166 - protein, 186 aa, Panicum virgatum
  misc_feature: Ceres CLONE 2048054
  misc_feature (27)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MRGRQQLLLLLFVLNAAGSRIASADTNPQDAAALKSLMKKWKNLPSSWGKSDDPCGAGWDGILCDGNGRVTSLNLFAMTIRGTLGDDIGSLTELRVLDLSSNPDLGGPLPAAIGKLVKLEQLALIGCSFSGPVPSELGNLSQVKFFALNSNKLTGSIPPLVRKLSSVTWLDLADNLLTGPLQFQGQ

SEQ ID NO: 49167 - DNA, 525 bp, Panicum virgatum
  misc_feature: Ceres CLONE 2048072
  misc_feature: Encodes the peptide sequence at SEQ ID NO. 49168
agagagaggattccaagtgacaacgaagatgaaagtgaggaggacagcagggaaacaaccagtgtcggttcacatgcccacagggtcatccttggattaccaccatgtggtccactaactctagaagatgttaaaactgctttccgggcatctgctctgcggtggcaccctgacaggcacccggggtcttcacaggctgtggccgaggagaagtttaagctctgcgtgaatgcgtacaattcactctgcagcatcctcaaggctgcttagagccccctgcgactacacacatgacatgacgaatgttgcagcttgtattatcagttttgcaaagcgcaggctattgctttgtttcagttttaatttgagatgcacacatttgtggcaagaggcaagctccgacatggaaggatggagccactgttgtacactagtgtcaatcaaatgtaacaacatttgattccttgatttgtttaatcaattcagttattcagaaagagggaataaaagcaagcaacttgtcag

SEQ ID NO: 49168 - protein, 89 aa, Panicum virgatum
  misc_feature: Ceres CLONE 2048072
  misc_feature (26)..(87): Pfam Name: DnaJ Pfam Description: DnaJ domain
RERIPSDNEDESEEDSRETTSVGSHAHRVILGLPPCGPLTLEDVKTAFRASALRWHPDRHPGSSQAVAEEKFKLCVNAYNSLCSILKAA

SEQ ID NO: 49169 - DNA, 660 bp, Panicum virgatum
  misc_feature: Ceres CLONE 2048101
  misc_feature: Encodes the peptide sequence at SEQ ID NO. 49170
caggtagagagccaagcagaggctgcgtcgcagcagcccgcgcctcgatcccacgaaccccacctttattttaaggggctgattggttcgtctcctctgctggttgcctctgttcgagctgcagagggagagggagggatcgaggaggacgaatcagaaaggtgcttgcagtgggtacagcggcaattattgtttcatcttatctgctgcagcaagtggaatccaagggtttaccaaacgctgggagagtatgggaagaagctgctatcaagtctgaagcttagcttagcacatcagtgttggaggcatgtataagaaccagctccaggagcttgctcagaggagttgcttcaatctaccgtcctatgcatgcatccgggagggaccagatcatgcgcctcggtttaaggccacagttaatttcaatggagagacattcgagagcccagtgttttgttctactttgcggcaggcagagcatgcagcggctgaggtagcactcaatgagttatcaaagagggggccttcatcgacactggctgccaaagttctggttagttttgttgatgcctctggaaacctatcctctgttgcagtaagttatggaattcgttttatggtgcttgtatggagaatctccttttgcatgtcctacctgga

SEQ ID NO: 49170 - protein, 117 aa, Panicum virgatum
  misc_feature: Ceres CLONE 2048101
  misc_feature (2)..(68): Pfam Name: dsrm Pfam Description: Double-stranded RNA binding motif
  misc_feature: SWISSPROT Homolog: EC 3.1.26.3 Ribonuclease III
MYKNQLQELAQRSCFNLPSYACIREGPDHAPRFKATVNFNGETFESPVFCSTLRQAEHAAAEVALNELSKRGPSSTLAAKVLVSFVDASGNLSSVAVSYGIRFMVLVWRISFCMSYL

SEQ ID NO: 49171 - DNA, 638 bp, Panicum virgatum
  misc_feature: Ceres CLONE 2048111
  misc_feature: Encodes the peptide sequence at SEQ ID NO. 49172
gaccactccgctccgcaccggcaccgcaccgcaccgcattgggtttggactttggaccccggccgagcggcgggcgtgccggcggatctctcgcgcggcgcggcgatgtggcgttcggcggcgcggcggtcgtcgcagatacggcggctcctgtcgtcgtccgcgcccccggcggggcccctcgccaccgtgccggcgccctgcatcgtgcagaagcgcgggaacgacatcctcaacgacccgtggtacaacaaggacacggcgttccccttgacggagcgcgaccgcctcggcctccgcggcctgctcccgccgcgggtcatgtccttcgagcagcagtacgagcggttcataaactcgtaccggtcgctggagaagaacacccggggcgagccggactccatcgtcgcgctggccaagtggaggatcctcaacaggctgcacgaccggaacgagacactgtacttcagggtgctgatcgacaacatcaaggattttgcgccggtaatatacactcccactgtcggcttggtctgtgaaaactacagtggtctcttcagacggcctcgtgggatgtatttcaccgcgaaggataagggggagatgatgtcgatgatttacaactggccacaagagaa

SEQ ID NO: 49172 - protein, 177 aa, Panicum virgatum
  misc_feature: Ceres CLONE 2048111
  misc_feature (113)..(177): Pfam Name: malic Pfam Description: Malic enzyme, N-terminal domain
  misc_feature: SWISSPROT Homolog: EC 1.1.1.39 Malate dehydrogenase (decarboxylating)
MWRSAARRSSQIRRLLSSSAPPAGPLATVPAPCIVQKRGNDILNDPWYNKDTAFPLTERDRLGLRGLLPPRVMSFEQQYERFINSYRSLEKNTRGEPDSIVALAKWRILNRLHDRNETLYFRVLIDNIKDFAPVIYTPTVGLVCENYSGLFRRPRGMYFTAKDKGEMMSMIYNWPQE

SEQ ID NO: 49173 - DNA, 639 bp, Panicum virgatum
  misc_feature: Ceres CLONE 2048114
  misc_feature: Encodes the peptide sequence at SEQ ID NO. 49174
acagaacgctctggtcctccgcttcctcaatcccgcgctccccgattcctcctttcctctccctccaccgcgaaccatggcggatcagctcaccgacgaccagatcgccgagttcaaggaagccttcagcctcttcgacaaggacggcgatggttgcatcacaaccaaggagcttggaactgtcatgcgttcactgggccagaaccctacagaggctgagctccaggacatgatcaatgaggtcgatgctgatggcaacggcaccattgatttccctgaatttctcaatcttatggctcgcaagatgaaggacactgattcagaggaagagctcaaggaggccttccgggtattcgacaaggaccaaaatggcttcatctctgctgccgagctccgccatgtcatgacaaatcttggtgagaagctaactgatgaagaggtggatgagatgatccgtgaggccgatgttgatggtgatggtcagatcaactatgaggagtttgtcaaggttatgatggccaagtgagcctcagaatcataatatcaaggcagagaagaatgtgcattgcatattagttaaagatgcaactcttattctatcaacttctagtgaaacattctgctagttgtagttgctaa

SEQ ID NO: 49174 - protein, 149 aa, Panicum virgatum; identical to SEQ ID NO: 12456
  misc_feature: Ceres CLONE 2048114
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 50110
  misc_feature: Useful for making plants with modulated salt sensitivity

SEQ ID NO: 49175 - DNA, 634 bp, Panicum virgatum
  misc_feature: Ceres CLONE 2048124
  misc_feature: Encodes the peptide sequence at SEQ ID NO. 49176
tagatgtttcacggataagagagaggcttgacagtgatagcatagttgttgtcagtaacatgggatactcgagttcaggagaagtgttaaattgcaacacctatgaggttgctactgcatgtgctctagcaatggcggcagataaacttgtgtgcattgtagatggtcaaatatttgacgagcatggacgagtcattcatttcatgtctattgaggaagctgatttgttgattagaaaacgtgctaagcaaagtgatattgctgcaaattatgttaaggttgtggatgaggagagtatcaattctcgacacaagggagtctatgaaccatcaatgggtgccagaactcatgtaaacggatatactgcttcttttcaaaacggtttgggttttaacaatggaaatggtatttattctggtgagcaaggatttgctattggtggtgaagagcggttaagtagatcaaatggctatctttctgagttggccgcagcagcatatgtgtgtcatgtaagtgtttcgcctttcacttcacattctttattaaattaaattctatgattctagctgaagattaatagttttctagagtgctttacatgtatatcatacgtaaataactaaatatgttatcc

SEQ ID NO: 49176 - protein, 182 aa, Panicum virgatum
  misc_feature: Ceres CLONE 2048124
  misc_feature: SWISSPROT Homolog: EC 2.3.1.1 Amino-acid N-acetyltransferase
DVSRIRERLDSDSIVVVSNMGYSSSGEVLNCNTYEVATACALAMAADKLVCIVDGQIFDEHGRVIHFMSIEEADLLIRKRAKQSDIAANYVKVVDEESINSRHKGVYEPSMGARTHVNGYTASFQNGLGFNNGNGIYSGEQGFAIGGEERLSRSNGYLSELAAAAYVCHVSVSPFTSHSLLN

SEQ ID NO: 49177 - DNA, 548 bp, Panicum virgatum
  misc_feature: Ceres CLONE 2048139
  misc_feature: Encodes the peptide sequence at SEQ ID NO. 49178
gtgttgactttattgatgaccttaaaccgattggagtccctgaatcgcgatatgaggggagactaactgaaaagggtacattaggaaagaaatcttatgtctgcacagatgatttctcattcaagaaagcgcattatacggttcttcaacaatcatccttggttgacccatatatcgaggaacacaagaaaattctgctctccaatttcccggaaatgtctgaggcatggattacacgtgagcacatgaatactttctgcagctggttgcggaagcatctaatgcataacatggatataagtgaacaactgttcttattggctaggggaccatcttggaatatcttaacataccaagggtacgagataaatggaaacatattttatacgatagcccaagataaaaagagtaccaaccaaaacagcggtgttcgtatggatgccacggacaataatggaaaaaaggacacatattacggcaacattgaagagatatgggagctggattacggtcccaatttcaaggtgcatctatttcgttgccaatgg

SEQ ID NO: 49178 - protein, 181 aa, Panicum virgatum
  misc_feature: Ceres CLONE 2048139
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
VDFIDDLKPIGVPESRYEGRLTEKGTLGKKSYVCTDDFSFKKAHYTVLQQSSLVDPYIEEHKKILLSNFPEMSEAWITREHMNTFCSWLRKHLMHNMDISEQLFLLARGPSWNILTYQGYEINGNIFYTIAQDKKSTNQNSGVRMDATDNNGKKDTYYGNIEEIWELDYGPNFKVHLFRCQ

SEQ ID NO: 49179 - DNA, 654 bp, Panicum virgatum
  misc_feature: Ceres CLONE 2048145
  misc_feature: Encodes the peptide sequence at SEQ ID NO. 49180
acccatctcaagctctcacaagtcagaagcaagcccgcacgctcccccaagtccaagtcctgaggcaggctagctagctgagctgtgcttctcccgtccgagtggccttgggggcaggaagctcgaggaggcctcgccgtcttggcgttgcacgagctcctgcagcgttggtgaggccggcgaagcagatgacgaaccaggacgtggtcgtgtcggagatgggcattgcggccggggcggcgctgccgggcccgagcccggcgctcctggcttgccggggcgcggccgccggcgccatgtccctgcggtacctcgacctggccgcggccgccgcgcgctccgccggttgcacctgggccgacgccatgcgcgcctcgtcccccacccgctcccgcgccgccgccgatgtcgacgagttcacggcctggatgaggaagcacccgtcggcgctcggcaagttcgaccagattgccagcgcggccaaggggaagaagatcgtcatgttcctggactacgacggcacgctctcccccatcgtcgccgaccccgacactgcctacatgagcgacgcgatgagggcggcggtgcgcgacgtcgcgaagcacttcccgacggcgatcgtgagcgggcgctgccgcgacaaggtgcgcaact

SEQ ID NO: 49180 - protein, 155 aa, Panicum virgatum
  misc_feature: Ceres CLONE 2048145
  misc_feature: Functional homolog of the protein sequence given in SEQ ID NO 50298
  misc_feature: Useful for making plants with modulated drought sensitivity
MTNQDVVVSEMGIAAGAALPGPSPALLACRGAAAGAMSLRYLDLAAAAARSAGCTWADAMRASSPTRSRAAADVDEFTAWMRKHPSALGKFDQIASAAKGKKIVMFLDYDGTLSPIVADPDTAYMSDAMRAAVRDVAKHFPTAIVSGRCRDKVRN

SEQ ID NO: 49181 - DNA, 600 bp, Panicum virgatum
  misc_feature: Ceres CLONE 2048168
  misc_feature: Encodes the peptide sequence at SEQ ID NO. 49182
aacactgacagagaacaagatggtgttccagtgtgcatcgattcgcggggttgattacagctctggtaaagatacagatggatactcagttgtagtgggtgatcagctgtggacaccaaaaatggcagttaaaactgaccctcagcttgtgaagctactgagggatagtggtaaatatgaggaagcaaagcttgttcttgaattcttccttgctcttgctgcctgtaataccatcgtgccacttgtgcttgacactagagattatacacaaaagttgattgactatcaaggtgagtcccctgatgagcaggcactagcatatgcggcagcatcttatggcattgtccttgttgagcgaacatctggttacatagtgattgacgtccttggtgacaggcagagatttgatatattaggacttcatgagtttgatagtgatcgtaagagaatgtctgtcatagttggctgcccaaataggactatcaagctgtatgtgaaaggtgcggacagttcaatatttggaattacaaacaaatcatcagatttggacattgttcgtgctacagaggcacatctccacaagtattcatcacttggcct

SEQ ID NO: 49182 - protein, 199 aa, Panicum virgatum
  misc_feature: Ceres CLONE 2048168
  misc_feature: SWISSPROT Homolog: EC 3.6.3.1 Phospholipid-translocating ATPase
TLTENKMVFQCASIRGVDYSSGKDTDGYSVVVGDQLWTPKMAVKTDPQLVKLLRDSGKYEEAKLVLEFFLALAACNTIVPLVLDTRDYTQKLIDYQGESPDEQALAYAAASYGIVLVERTSGYIVIDVLGDRQRFDILGLHEFDSDRKRMSVIVGCPNRTIKLYVKGADSSIFGITNKSSDLDIVRATEAHLHKYSSLG

SEQ ID NO: 49183 - DNA, 691 bp, Panicum virgatum
  misc_feature: Ceres CLONE 2048179
  misc_feature: Encodes the peptide sequence at SEQ ID NO. 49184
atgatctcagacttgacttaaaactccaatcaacgtcgagtgcggcacatagtgatatggggactgatgctcctgctaataagttccacgcatcatctccttcttcttcttccaagaatcacctgcaactcttgcatctgtgtgtgagagcgagtaattgctggccggccgactctttaggcatttctttatatataaatccgctagccgctaggtgaaagcgagcaagggcaaaactcgggtacgctgcaagcagctgggagacaaagcagagagaatcgagaagatggagatgggcacggttctgggtgcgacctgcttcagcttcctggccatggccgtgggattcgtggtggtggtgtacttgtacgagccgtactggaaggtgcggcacgtgccggggcccgtgccgctgccgctcgtcgggcacctccacctgctggccaagcacggcccgggcgtcttcgctgcgctggccaagaagcacggccctgtcttcaggtttcacgtgggaaggcagcccttgatcatcgtggccgatgcagagctttgcaaggaggtgggcatcaagaagttcaagagcatgcccaatcgaagcttgccttcgcccatcgctaattctccgatccatctgaagggcctcttcgctacaagggattcgaggtggtcggcgatgcggaacatcatcgtc

SEQ ID NO: 49184 - protein, 134 aa, Panicum virgatum
  misc_feature: Ceres CLONE 2048179
  misc_feature: SWISSPROT Homolog: EC 5.3.99.5 Thromboxane-A synthase
  misc_feature: Functional homolog of the protein sequence given in SEQ ID NO 50672
  misc_feature: Useful for biocontainment applications
  misc_feature: Useful for making plants with modulated biomass
MEMGTVLGATCFSFLAMAVGFVVVVYLYEPYWKVRHVPGPVPLPLVGHLHLLAKHGPGVFAALAKKHGPVFRFHVGRQPLIIVADAELCKEVGIKKFKSMPNRSLPSPIANSPIHLKGLFATRDSRWSAMRNII

SEQ ID NO: 49185 - DNA, 679 bp, Panicum virgatum
  misc_feature: Ceres CLONE 2048184
  misc_feature: Encodes the peptide sequence at SEQ ID NO. 49186
aaagcacaaagctttagcgcatacaagggcaaccaagcttaacacaatcctcaacacacacacacatacctctcgaaagctccagcagcggcacaagccagccagcctcgtcgtcatggctcccaacctcagcaaggccacgccggacctgctcggcgacgcggccgcccccgtcgagggcctcaaggcgccgtcgcgcttcacgctcaagggcaaggacctcgccgtcgacggccacccgttcttgctcgacgtgccggccaacatccgcctcatcccggcgtcggcactggtgcccgtcgccgcggcgggcggcagcttcctcggcttcgacgcgccggcggccaagagccgccacgaggtgcccgtcggcaggctccgcggcacccggttcatgagcatcttccgcttcaaggtgtggtggacgacccactgggtaggcgacagcggccgcgacgtggagaacgagacgcagctgatggtgctcgaccgctccggcgccggcgccggcggcggccgcccgtacgtgctgctgctccccatcgtcgagggcgccttccgcgcctgcctcgagtccggcaaggtggacgactacgtggacatggtggtcgagagcgggtcctcggcggtgcgcggcgccgtgttccggagctccctgtacctgcacgccggcgacgac

SEQ ID NO: 49186 - protein, 187 aa, Panicum virgatum
  misc_feature: Ceres CLONE 2048184
  misc_feature: SWISSPROT Homolog: EC 2.4.1.67 Galactinol--raffinose galactosyltransferase
MAPNLSKATPDLLGDAAAPVEGLKAPSRFTLKGKDLAVDGHPFLLDVPANIRLIPASALVPVAAAGGSFLGFDAPAAKSRHEVPVGRLRGTRFMSIFRFKVWWTTHWVGDSGRDVENETQLMVLDRSGAGAGGGRPYVLLLPIVEGAFRACLESGKVDDYVDMVVESGSSAVRGAVFRSSLYLHAGD

SEQ ID NO: 49187 - DNA, 693 bp, Panicum virgatum
  misc_feature: Ceres CLONE 2048211
  misc_feature: Encodes the peptide sequence at SEQ ID NO. 49188
attcaaagcagtcagtcaatcacggatacaagtggccatacccttctatatatgcaccatattcgcaaccatgagaaatcacaactcaaagtctcatccacacatctaccactactacaaaatgaggagttcctgaaggcttgctctaggatatggctcctctaggaactctgaggtcgtcagtgctcctggccactgtcctactcctgtcctttctcttgaacttcctggtccttgcctcatcacttgatactagaacaacacccaatagtgatctccagaccctcctttgcctcaaggctcatctctctgacactgccgggcagctagcctcgtggaagaatgattctattcagttttgcagttgggctggtgttagatgcagcgagacgcgcccatctcgcgttgttgccctggacctcgggtcgtttgagctcaatggccaaatacctgcttgtattgccaacctcacttacctcgcaagaatccacttcccaaataaccagcttagtggtccaatccctcgtgagcttggccaactaaataggctgcagtaccttaacctcagttccaaccatgtcggtggttcgattccggacacactgtcctcctgttctctcctccagatcatcgatcttggtggaaatttcctgcaaggagtgattcctccaaacctgagccaatgcttaaatc

SEQ ID NO: 49188 - protein, 180 aa, Panicum virgatum
  misc_feature: Ceres CLONE 2048211
  misc_feature (38)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MAPLGTLRSSVLLATVLLLSFLLNFLVLASSLDTRTTPNSDLQTLLCLKAHLSDTAGQLASWKNDSIQFCSWAGVRCSETRPSRVVALDLGSFELNGQIPACIANLTYLARIHFPNNQLSGPIPRELGQLNRLQYLNLSSNHVGGSIPDTLSSCSLLQIIDLGGNFLQGVIPPNLSQCLN

SEQ ID NO: 49189 - DNA, 605 bp, Panicum virgatum
  misc_feature: Ceres CLONE 2048234
  misc_feature: Encodes the peptide sequence at SEQ ID NO. 49190
acgaacattgaagctcaccacctgctcggcgaaatgcggaagcggagccgcgacaactgtgaggaaccggcggccacggcgagcaacgacgaccgcctcggttccctccccgacgacgccctcctacacgtgttgtccctgctgccctcggaggacgctgtgcggacctgcgtgctggcccggcgctggcgccatctctggcggttcacggccgcgctgcgcatcgcccgcgacgactgcaagcggtggagcgtccggtggctgcacaggttcgtcaccaacttcctgcgcctccgcgacagcctctcgccgctggacgtgtgcgacatattttgctgcccgttcgtgttgtaccggggtggccacgctgcgcaggcgttctgcttcaaggttgcggaggaatgggtccgccgcgtagtgtcagagcaccgagctcgggtgctgaaggtttggatctacactcccgagaatatgctggagcctgctgacgcgccactcgtctcgaagcacctgactagggtggaactaggccaagtggaattgccaagcggaattctagatctaccaggctgccgtgcactggagcatctagagctcttatcttg

SEQ ID NO: 49190 - protein, 190 aa, Panicum virgatum
  misc_feature: Ceres CLONE 2048234
  misc_feature (20)..(67): Pfam Name: F-box Pfam Description: F-box domain
MRKRSRDNCEEPAATASNDDRLGSLPDDALLHVLSLLPSEDAVRTCVLARRWRHLWRFTAALRIARDDCKRWSVRWLHRFVTNFLRLRDSLSPLDVCDIFCCPFVLYRGGHAAQAFCFKVAEEWVRRVVSEHRARVLKVWIYTPENMLEPADAPLVSKHLTRVELGQVELPSGILDLPGCRALEHLELLS

SEQ ID NO: 49191 - DNA, 538 bp, Panicum virgatum
  misc_feature: Ceres CLONE 2048236
  misc_feature: Encodes the peptide sequence at SEQ ID NO. 49192
aaaaacttcctctgcaattgcttgctgtgctagcggcggcgccagacgcccagacctggccaccccgattccccggaccacccaccctcccgctccctccaatcgcggcgtccccactccccccgcgcgggcctcctaaccctagtcctcgtcccgccccccatggcggcgtgagctgccgccgtacggatcgcgcgggagatgcagggcggtgtcgcggctgctgccgctgctgcggctgcggccgcggctacggtgaccacggcggtggcgcctccagtggccccggccccggccccggcccctgcggccgcgaccgcgcacgccgcggtgggcaacggcggggcgcccgccgcgccgccgccgcccttcctcatgaagacctacgagatggtcgacgacccggccacggacgacgtcgagtcctggggccccgggaacaacagcttcatggtctggagcacacccgagttcgccagggacctcctgcccaagaacgtaaagcacagcaacttctcctcgttcctcaggcagctca

SEQ ID NO: 49192 - protein, 112 aa, Panicum virgatum
  misc_feature: Ceres CLONE 2048236
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: Functional homolog of the protein sequence given in SEQ ID NO 51767
  misc_feature: Useful for making plants with modulated heat sensitivity
  misc_feature: The sequence is a functional homolog of SEQ ID NO 1686 in the 10/412,699 US patent application
MQGGVAAAAAAAAAAAATVTTAVAPPVAPAPAPAPAAATAHAAVGNGGAPAAPPPPFLMKTYEMVDDPATDDVESWGPGNNSFMVWSTPEFARDLLPKNVKHSNFSSFLRQL

SEQ ID NO: 49193 - DNA, 713 bp, Panicum virgatum
  misc_feature: Ceres CLONE 2048237
  misc_feature: Encodes the peptide sequence at SEQ ID NO. 49194
gctagtcagtcaatcgtgagttcgtgactgaaaatggcggaggtggaagcgacggcggggcagctgaggctgtactcgtactatcgcagctcgtgctcccaccgcgcccgcatcgccctcaatctcaaaggcgtggactacgagtacaaggcggtgaaccttctcaagggcgagcagtctgatccagaattcctgaagcttaatcctatgaagtttgtccctgcgctggttgatgacgatgcagtaattggtgactcttatgcaatagcattgtatttggaggacaagtaccccgaccctcctcttttgcctcaagaccctagaaagaaggctttgaatcaccaggtgataggttctccaccccttttctcatgattgcaggcgcatgttattcttaatcaattaatatagaagtgccatctgtgggagaattgcattttggcattatgcaaaattgttcggacaaaacagttaagcagactgttatgcaatcagttcactagttgcttttttgggcggcttcttggatgctcctatctaaacccatcaaatagttgcaccctgtcacccacagtttcatcttatgaggtaaaaccacaaaatcagtagcacaacagaagtgataccaaaggagtaactcattagcatagtacatatgcagatatgttttaaattctattcactgtgagcttacaggtgcccatgtggggctg

SEQ ID NO: 49194 - protein, 113 aa, Panicum virgatum
  misc_feature: Ceres CLONE 2048237
  misc_feature (9)..(84): Pfam Name: GST_N Pfam Description: Glutathione S-transferase, N-terminal domain
  misc_feature: SWISSPROT Homolog: EC 2.5.1.18 Glutathione transferase
  misc_feature: Functional homolog of the protein sequence given in SEQ ID NO 51434
  misc_feature: Useful for biocontainment applications
MAEVEATAGQLRLYSYYRSSCSHRARIALNLKGVDYEYKAVNLLKGEQSDPEFLKLNPMKFVPALVDDDAVIGDSYAIALYLEDKYPDPPLLPQDPRKKALNHQVIGSPPLFS

SEQ ID NO: 49195 - DNA, 672 bp, Panicum virgatum
  misc_feature: Ceres CLONE 2048246
  misc_feature: Encodes the peptide sequence at SEQ ID NO. 49196
gattggccgcgcccgccgccgcagtataaatccgcccgagcgagccctccgcgccgtccccaccccgctccgaccacaaccctagcggcgctcgccggcatgggctagggttcccccgcggccgcgatggagtgggacagcgactccggcggcggcggcggtgacgacgaggaggaagaggaggaggaggaggtccaggccgggcccgggcccccggggttctcgctggccatcgagggcgtgctgggcgcgtgcgggatcgtggtctccgacgcgctcgagcccgacttccccatcatctacgtcaaccgcgggttcgaggacgccaccgggtaccgcgccgaggaggtgctcgggaggaactgccggtttttgcaatgcagaggaccatttgctcagaggagacatccccttgttgatgctgcagtagttactgggattcggagatgtttagaggatgggaccgaattccagggtgatctgttgaattttagaaaagatggttctccatacatggcaaagctgcgactaacaccaatatatggagacgatgacgcaataacacactatatgggcattcagtttttcaatgattccaatgttgatttgggggcatcgcctggctctgtaacaaaggaacttgcgagatctacatggattgcaccagataac

SEQ ID NO: 49196 - protein, 181 aa, Panicum virgatum
  misc_feature: Ceres CLONE 2048246
  misc_feature: SWISSPROT Homolog: EC 2.7.11.1 Non-specific serine/threonine protein kinase
MEWDSDSGGGGGDDEEEEEEEEVQAGPGPPGFSLAIEGVLGACGIVVSDALEPDFPIIYVNRGFEDATGYRAEEVLGRNCRFLQCRGPFAQRRHPLVDAAVVTGIRRCLEDGTEFQGDLLNFRKDGSPYMAKLRLTPIYGDDDAITHYMGIQFFNDSNVDLGASPGSVTKELARSTWIAPD

SEQ ID NO: 49197 - DNA, 694 bp, Panicum virgatum
  misc_feature: Ceres CLONE 2048262
  misc_feature: Encodes the peptide sequence at SEQ ID NO. 49198
gcggaccttgaccgctccaatttcaatccccttccccggcgctttcttccgaccatccgccgccgccgacgccgccctcgtgccctcaccgtgccactcccgctcgcgccagcctcctctcctccatctctgccgcgcgtcgcatcgcgcagctgccgtcgccctggcggagcgcgggggcggctccggcccgatcagaggcggccggtgaggcggcgcggtgccgaccgttggggaggcgagcggcggcggggcggcccgtgtagaggatgatctacacggcgattgacaccttctacctgacggacgagcagctgcgggactcgccgtcgcggaaggatgggatcaacgaggccaccgagaccgcgctccgcgtctacggatgcgacctcatccaggagagcggcatcctcctcaggctaccacaagcagtgatggccacagcacaagtattgtttcatcgcttttactgcaagaaatcatttgttcgatttagtgcaaagagagttgctgctagctgtgtttggctggcagggaagttggaggaaagtcctagaagatcgaagcatattatatttgtatttcatagaatggaatgtaggagagaaaacttgccaattgaatacttagatatctgttcaaagaaatactcagaactgaggcatgatctgataaggacagaacggcatctgtt

SEQ ID NO: 49198 - protein, 141 aa, Panicum virgatum
  misc_feature: Ceres CLONE 2048262
  misc_feature (4)..(131): Pfam Name: Cyclin_N Pfam Description: Cyclin, N-terminal domain
MIYTAIDTFYLTDEQLRDSPSRKDGINEATETALRVYGCDLIQESGILLRLPQAVMATAQVLFHRFYCKKSFVRFSAKRVAASCVWLAGKLEESPRRSKHIIFVFHRMECRRENLPIEYLDICSKKYSELRHDLIRTERHL

SEQ ID NO: 49199 - DNA, 731 bp, Panicum virgatum
  misc_feature: Ceres CLONE 2048270
  misc_feature: Encodes the peptide sequence at SEQ ID NO. 49200
cccggactaactgcagccattgggaagctgtgtcaattatgtgagcgttactcaactgaggcattgctctacctcaaacaaaacgaaactcagacagagattcttagcattctacaccatgaatgtgcaagccttgctcctctgaaacagcagtgcatcacgttggtcgactactatgtaccccttttcttcttggaggtttcaatgattacccctgaaaagttttgtgaatcagttcacctctgcaagaatggaatgaagattagcctacccactcaggagggtacttgcggtttatgccaccatgttcttgttgaagctcttgtcatgcttaaagacccgaacacacagcttgaggtaattgacctactcctcaaaccatgcagcaaggcacagaactatgaacaacagtgcaagcatctggtcctcaagtatatcccgctgattctggtcaagggccagaagttcctcgagacgactgatgtctgcactgcaatacatgcatgcaaaacaggaacacaattatcaatggaaggcatgcctctatctgccactctgtaaagatctgaatcagaataaggtttatctatctaggacatcaaattggagagaaaagatgaaagtcagatgactattggagctcttctctattcggaacacggtgaaaattcatgtcgaaactttggtgtaaatttggagacttgtccactgatctgtaaatattgcacccg

SEQ ID NO: 49200 - protein, 186 aa, Panicum virgatum
  misc_feature: Ceres CLONE 2048270
  misc_feature (8)..(47): Pfam Name: SapB_1 Pfam Description: Saposin-like type B, region 1
  misc_feature (94)..(132): Pfam Name: SapB_1 Pfam Description: Saposin-like type B, region 1
  misc_feature (49)..(82): Pfam Name: SapB_2 Pfam Description: Saposin-like type B, region 2
  misc_feature (135)..(169): Pfam Name: SapB_2 Pfam Description: Saposin-like type B, region 2
PGLTAAIGKLCQLCERYSTEALLYLKQNETQTEILSILHHECASLAPLKQQCITLVDYYVPLFFLEVSMITPEKFCESVHLCKNGMKISLPTQEGTCGLCHHVLVEALVMLKDPNTQLEVIDLLLKPCSKAQNYEQQCKHLVLKYIPLILVKGQKFLETTDVCTAIHACKTGTQLSMEGMPLSATL

SEQ ID NO: 49201 - DNA, 632 bp, Panicum virgatum
  misc_feature: Ceres CLONE 2048290
  misc_feature: Encodes the peptide sequence at SEQ ID NO. 49202
aaaaaaaaattcaaatcaaagtctcccacacccagcgacgaaaacgctgcgacaattcaaatcgaatccacccgaatcgaatcgagccagcgcaaacccccccggccgatcccccctgtgctctcgccgctgcccgcccaccgattccgcagcgccttgctgcgaatctgggcgcgatttcggggcgctagggtttgggaggctccggatcgcggggccgcgcggagggcagggtttggattggagtcggggttgctgctgagggttgcggggcgtgctggatcgagctgctccgagccggcttgtgatggtggtgagaggaggcgggaggggagtaggcggcggcggcggtgagtagggtctgctgattgggtttggggccgagggcgcgcgccggccatggtgcggcttctcgggctgcggagcctgagcttcgggccggaggagtcgccgcgggagatcccctccgccgccccgcccgtcggcagcagcggctggctcgtgcgcttcttcgactccgccttcttctgcgagtggatcgccgtcagctacctctacaagcacgaccatgacggcgtgcgcgactacctctgcaaccgcatgtacacgctcccgctcccgggcctcgaggg

SEQ ID NO: 49202 - protein, 77 aa, Panicum virgatum
  misc_feature: Ceres CLONE 2048290
  misc_feature: SWISSPROT Homolog: EC 2.7.1.67 1-phosphatidylinositol 4-kinase
MVRLLGLRSLSFGPEESPREIPSAAPPVGSSGWLVRFFDSAFFCEWIAVSYLYKHDHDGVRDYLCNRMYTLPLPGLE

SEQ ID NO: 49203 - DNA, 499 bp, Panicum virgatum
  misc_feature: Ceres CLONE 2048302
  misc_feature: Encodes the peptide sequence at SEQ ID NO. 49204
aaccctgctgactcgcgggggttgaggcgtcgtccatctccgtgaggattgtggcttctctgtctttgatgccgcacttgctcattaagcctcctctcacgtgcttctccttaaagggcgttggtcgctatggcatactccaggtgtatgccgcgctcaagtaagatggagctaaattctcaaggaacaacgacctggaggccctgttccatgtcgatgactcctgtcctacggtcccaatcaggactggtaagttcttggatgggaatgatgctctggacgtggttcgattctacatccagttctgcgattggagggcgcggcaggatctcctcaccatcatggttttccacaactgcgcggtagaggttctcaatcctatagcaaaagaattcaagtctattgcaaccttgaagaaacaccttgacaaatttcatgacgaacttgcactagctcaccatcaggttcatttatcagaagcgagattatcatctgcgct

SEQ ID NO: 49204 - protein, 52 aa, Panicum virgatum
  misc_feature: Ceres CLONE 2048302
  misc_feature: SWISSPROT Homolog: EC 1.13.12.14 Chlorophyllide-a oxygenase
MVFHNCAVEVLNPIAKEFKSIATLKKHLDKFHDELALAHHQVHLSEARLSSA

SEQ ID NO: 49205 - DNA, 746 bp, Panicum virgatum
  misc_feature: Ceres CLONE 2048310
  misc_feature: Encodes the peptide sequence at SEQ ID NO. 49206
acaccacagaatcacagatcaaagcttccagcactagaagagctagctccgaccaagcaagcacttcagcaaatccacccgcggtctccaatccgcgctcagaaacccaaccgacggcaatgtcgctggtgaggctcagcaacgtgttcgaccccttcgccgacttctgggaccccttcgacgtcttccgctccgtcgtgcccgcggcatcgacgatccgcgacaccgccgccttcgccggcgcgcgcatcgactggagggagacccccgaggcgcacgtcttcaaggctgacctccccggcgtcaagaaggaggaggtcaaggtggaggtggaggacggcaacgtcctggtgatcagcggcgagcgcagcagggagaaggaggacaagaacgacaagtggcaccgcgtcgagcgcagcagcggcaagttcctccgccggttccgcctgccggagaacgccaagacggaggaggtgaaggccggcttggagaacggcgtgctcacggtcaccgtgcccaaagcagaggtcaagaagcccgaggtgaaggccatcgagatctctggctgagagttcaatctttacggtcgcgcaagctgctacgtcgtgctgtggtcgaagtatggtcgtcgtgttcctcaatcctgtgttggtcatgtcgtggtcaatgttgtgcttgccggctggccgcgtcgacccgggagcggtattggtatttgtgtgtttcccagtggagtcgtctttggg

SEQ ID NO: 49206 - protein, 149 aa, Panicum virgatum
  misc_feature: Ceres CLONE 2048310
  misc_feature (45)..(148): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRLSNVFDPFADFWDPFDVFRSVVPAASTIRDTAAFAGARIDWRETPEAHVFKADLPGVKKEEVKVEVEDGNVLVISGERSREKEDKNDKWHRVERSSGKFLRRFRLPENAKTEEVKAGLENGVLTVTVPKAEVKKPEVKAIEISG

SEQ ID NO: 49207 - DNA, 685 bp, Panicum virgatum
  misc_feature: Ceres CLONE 2048315
  misc_feature: Encodes the peptide sequence at SEQ ID NO. 49208
taccatcatggattctcaagatcccaatcacattccttgaggttggtgggtctgttttcataacgtactatgccattggatttgatccagatgtagtcaggcttttcaagcaatatctgcttttcttagcagctaaccatatggcagcttcgctcttccgtttcattgctggagcagcaagaaacatgatagttgcatatgtcttcggatcatttgcaattttagtcgttatgcttttgggtggatttgttatttctagagataacataaacaaatggtggatttggggatactggacctctccaatgatgtatgcacagaatgctgtgtcggtgaatgagttcttgggacaaagctggcagaaggtcttgccaggctcgactgagccccttggagtgcttatcctcaagtcccgtggaatatttccagaagccaagtggtactggattggctttggcgcattacttggattcacacttatcttcaactctctattcacgctctgtcttacatacctcaagtcatatgggccattgcatccatcagtatcagaagagacgctgaaggagaagaatgcaaatttgactggtgtggctgtagatgtatcattacataaagggacgggacttggaagtacttgccagtcatctgaaagtgcttgtcaggcaacaggcagctacaaatg

SEQ ID NO: 49208 - protein, 227 aa, Panicum virgatum
  misc_feature: Ceres CLONE 2048315
  misc_feature (119)..(183): Pfam Name: PDR_assoc Pfam Description: Plant PDR ABC transporter associated
PSWILKIPITFLEVGGSVFITYYAIGFDPDVVRLFKQYLLFLAANHMAASLFRFIAGAARNMIVAYVFGSFAILVVMLLGGFVISRDNINKWWIWGYWTSPMMYAQNAVSVNEFLGQSWQKVLPGSTEPLGVLILKSRGIFPEAKWYWIGFGALLGFTLIFNSLFTLCLTYLKSYGPLHPSVSEETLKEKNANLTGVAVDVSLHKGTGLGSTCQSSESACQATGSYK

SEQ ID NO: 49209 - DNA, 533 bp, Panicum virgatum
  misc_feature: Ceres CLONE 2048336
  misc_feature: Encodes the peptide sequence at SEQ ID NO. 49210
aagaagagctcccgagtcaccagctcttctttcaccaccgcgccaccacagcttgtcacatttcctcagccggcgatcgagatggcgagcaacaccgcgatcgtggagagcgacccgctgagctggggcaaggccgcggcggagatgacggggagccacctggacgaggtgaagcgcatggtggcgcagtcccgcgagccggtggtcaagatcgagggctccagcctgcgcgtcggccaggtggcggccgtggccgcggccaaggacgcgtcgggcgtcgccgtcgagctggacgaggaggcgcggccccgcgtcaaggccagcagcgagtggatcctcgactgcatcgcgcacggcggcgacatctacggcgtcaccaccgggttcggtggcacctcccaccgccgcaccaaggacgggcccgcgctccaggtcgagctgctcaggcatctcaacgccgggatcttcggcaatggctccgacgggcacacgctgccgtccgaggtgtcacgcgcggccatgctggtccgcat

SEQ ID NO: 49210 - protein, 150 aa, Panicum virgatum
  misc_feature: Ceres CLONE 2048336
  misc_feature: SWISSPROT Homolog: EC 4.3.1.5 Phenylalanine ammonia-lyase
  misc_feature: Functional homolog of the protein sequence given in SEQ ID NO 50787
  misc_feature: Useful for making plants with altered cell wall content and/or composition
  misc_feature: Useful for making plants with altered lignin content
MASNTAIVESDPLSWGKAAAEMTGSHLDEVKRMVAQSREPVVKIEGSSLRVGQVAAVAAAKDASGVAVELDEEARPRVKASSEWILDCIAHGGDIYGVTTGFGGTSHRRTKDGPALQVELLRHLNAGIFGNGSDGHTLPSEVSRAAMLVR

SEQ ID NO: 49211 - DNA, 683 bp, Panicum virgatum
  misc_feature: Ceres CLONE 2048345
  misc_feature: Encodes the peptide sequence at SEQ ID NO. 49212
aattactcagaagtccaaattccccacctcccagtcctggctgctcctccaagctcccatccatggctccctcctccttcttcttcctcctcctcctcctactcagccagatcctactctgcgcagccgtcgacaccatcaactcctccacgccgttgtccggtgcgcagcagattgtatccaagggaaacaagttcactttgggcttctacaccccgcctcaaggtaccacctccagccccagcaactactacatcgccatatggtacgccaacatacctcagaagacaaccgtgtggacggccaactccgacgcgcctgtgacggacccaactaccgcagccttgaccatcggcagcgacggcaaccttgtcctccttgatcaatccaagaaccggcagctgtggtcgaccaacatgagcatcggatccaactccaccatcgccgtcctccaggatgacggtagtctcgacctcattgatgccacaacttcatcaatagtttactggcgaagcatagatcatcccacaaacacatggcttccggggggcaagcttgggctgaacaagaccaaaggggtcagtcagcgtcttgttccatggaggaacacagccaacccatctcccggcttgttctcactggagctggacccgaacggctcaacacagtacttcatccagtgg

SEQ ID NO: 49212 - protein, 206 aa, Panicum virgatum
  misc_feature: Ceres CLONE 2048345
  misc_feature (74)..(187): Pfam Name: B_lectin Pfam Description: D-mannose binding lectin
MAPSSFFFLLLLLLSQILLCAAVDTINSSTPLSGAQQIVSKGNKFTLGFYTPPQGTTSSPSNYYIAIWYANIPQKTTVWTANSDAPVTDPTTAALTIGSDGNLVLLDQSKNRQLWSTNMSIGSNSTIAVLQDDGSLDLIDATTSSIVYWRSIDHPTNTWLPGGKLGLNKTKGVSQRLVPWRNTANPSPGLFSLELDPNGSTQYFIQ

SEQ ID NO: 49213 - DNA, 357 bp, Panicum virgatum
  misc_feature: Ceres CLONE 2048349
  misc_feature: Encodes the peptide sequence at SEQ ID NO. 49214
ggatgccaagatgttcccagagaaggctgggtacaacgagctgaaccagatggctgaagaggcgaagaggagggctgagattgcaagactgcgggagcttcacacactcaagggacatgtggagtctgttgtgaagctgaaggggcttgacatcgagaccatccagcagtcctacacggtttgatattgcctgtccagaagaaggggttcttttatctttctttttttctttttggccaccgaagtgtgaatttgatggtggctgtcctctctatgttttatttaactgactgaactggaatcatatcacccgaccagtacttggaatgagacggaatcgcttgatctctgtaatcg

SEQ ID NO: 49214 - protein, 60 aa, Panicum virgatum
  misc_feature: Ceres CLONE 2048349
  misc_feature: SWISSPROT Homolog: EC 3.6.3.6 Proton-exporting ATPase
DAKMFPEKAGYNELNQMAEEAKRRAEIARLRELHTLKGHVESVVKLKGLDIETIQQSYTV

SEQ ID NO: 49215 - DNA, 667 bp, Panicum virgatum
  misc_feature: Ceres CLONE 2048374
  misc_feature: Encodes the peptide sequence at SEQ ID NO. 49216
gttaccttagtccatagaaccaccgcgccgctaagataggagttgcaaggcactgtgacgatgaccaccttatcccagagacctgcagggcagtgcaatgggagctgcctgctcgcacctgccacagcacggcaaccacgtatttcttggtggcgtcggcagcagaggcaaaccacgctgcatcgccagcaaatgcaacagtgttcagtggcaacattacacaatgataaggttgacgatcgcttgggcaagaatccatgcaattttcatccttctatatggggagatttcttcctacactactacgacgcagcagcttcctccaaacagcagacgtggatggtagaacgagcagatgaagtgaagcaagacgtggcaaaaatagtagcaagttcagttgcttgggaccttcatcataggctacaacttatcgatgcgctggagcgtctgtgcttggatcatttgttcgaagatgacattaatgctgcactgactcaaattaggacagttaatcttactgactgtgatcttcacacggtagctatgtggttttatctgcttcgtaagcacggacacagagtttcgccaggtaataaagatatacatgtatggatcaagtttcaaataaataacactatagattttctagatcttttgtaggtatctg

SEQ ID NO: 49216 - protein, 155 aa, Panicum virgatum
  misc_feature: Ceres CLONE 2048374
  misc_feature (30)..(153): Pfam Name: Terpene_synth Pfam Description: Terpene synthase, N-terminal domain
  misc_feature: SWISSPROT Homolog: EC 4.2.3.13 (+)-delta-cadinene synthase
MQQCSVATLHNDKVDDRLGKNPCNFHPSIWGDFFLHYYDAAASSKQQTWMVERADEVKQDVAKIVASSVAWDLHHRLQLIDALERLCLDHLFEDDINAALTQIRTVNLTDCDLHTVAMWFYLLRKHGHRVSPGNKDIHVWIKFQINNTIDFLDLL

SEQ ID NO: 49217 - DNA, 625 bp, Panicum virgatum
  misc_feature: Ceres CLONE 2048375
  misc_feature: Encodes the peptide sequence at SEQ ID NO. 49218
agagtgctgacgggaagcttcgatccctgaccagagttcggaggaggaggaggagatgaacgtcgacttcggcgcgcccaaggagctcgcggggggcctgcagcagcgcagggccctctaccagccccgcctcccgccgtgcctccagggcccgacggtgcgggcggagtacggcgacgcgaccaccaccatcgaccccagctgcgctaacgtcgtcgcgcaggccttcccgaacaccttcggccagccgctcgtcagcttcgtcgcgccggccgacgccgccgccgcggaggagcgccctgcgatcagggtgggcgtggtgttctccgggaggcagtcgccgggagggcacaacgtcgtctggggtctgcatgacgctctcaaagcctacaatcctcagagcgtgctctatggatttgttggtggcacaggggggctgtttgcaaacaagacactggagatcactgacgatgttcttacttcctacaagaaccaaggtggtttcgatttgctcggcaggagtatcgatcagatccgcacaactaagcaagtcaaatctgcaatggcaacatgccgcagtctgaacttggatgggctggtcatcattggaggagtgacctccaat

SEQ ID NO: 49218 - protein, 189 aa, Panicum virgatum
  misc_feature: Ceres CLONE 2048375
  misc_feature: SWISSPROT Homolog: EC 2.7.1.90 Diphosphate--fructose-6-phosphate 1-phosphotransferase
MNVDFGAPKELAGGLQQRRALYQPRLPPCLQGPTVRAEYGDATTTIDPSCANVVAQAFPNTFGQPLVSFVAPADAAAAEERPAIRVGVVFSGRQSPGGHNVVWGLHDALKAYNPQSVLYGFVGGTGGLFANKTLEITDDVLTSYKNQGGFDLLGRSIDQIRTTKQVKSAMATCRSLNLDGLVIIGGVTS

SEQ ID NO: 49219 - DNA, 665 bp, Panicum virgatum
  misc_feature: Ceres CLONE 2048379
  misc_feature: Encodes the peptide sequence at SEQ ID NO. 49220
agcagccaagcgccacgctccaccagtccaccggaccaaccagccgcgcgcggtgatcagctagtgcggtggtgttgctttccgctccgtgggcgcggaccggcatccagcggggaggatgaagaaggtgtcggtggccgcggcggcgctgctgctgctgctgctggcggcggcagcggcggcggcggaggggagcgagctcaagctgggctactacgccaagacctgccgcgggtgggagaacgtggtcaagtaccacgtcgccaaggccatccgggccaaccgcgccagcggcgccgccctcgtccgcctcatcttccacgactgcttcgtcaggggttgcgacgcgtctgtgctgctcgacccgacgccggcgaacccgcacacggagaagacggcgccgatcaacatcgggctggcggcgttcgaggtgatcgacgacatcaaggcggcgctggaggagcggtgccccgacacggtgtcgtgctcggacatcgtggtgttcgcggcccgggacgcgtccagcatcctgagcaacgggcacgtgcacttcgacccgccggcggggcgcctcgacggcaaggtctcccgcgccgccgacgcgcagcgcgacctcccggactcgaccttcacgatcgccgagctgatccgcaacttccggcgca

SEQ ID NO: 49220 - protein, 182 aa, Panicum virgatum
  misc_feature: Ceres CLONE 2048379
  misc_feature (44)..(182): Pfam Name: peroxidase Pfam Description: Peroxidase
  misc_feature: SWISSPROT Homolog: EC 1.11.1.7 Peroxidase
  misc_feature: Functional homolog of the protein sequence given in SEQ ID NO 51054
  misc_feature: Useful for making plants with altered carbohydrate content
MKKVSVAAAALLLLLLAAAAAAAEGSELKLGYYAKTCRGWENVVKYHVAKAIRANRASGAALVRLIFHDCFVRGCDASVLLDPTPANPHTEKTAPINIGLAAFEVIDDIKAALEERCPDTVSCSDIVVFAARDASSILSNGHVHFDPPAGRLDGKVSRAADAQRDLPDSTFTIAELIRNFRR

SEQ ID NO: 49221 - DNA, 623 bp, Panicum virgatum
  misc_feature: Ceres CLONE 2048393
  misc_feature: Encodes the peptide sequence at SEQ ID NO. 49222
atctttcctcttcttcgccggcgccagcccccgcatcgccgaacctcccgcacgccggccggagaattcatccagacgtggcattgagcgaatccttttcctgctctgtcagctaattgcgggttcttctcctgcggtcttgcggaaggcatggcggggttcggatggagagtcggttccaaggtgcagagatggggtcggagcttcttccggggcttctcttctgcttcgattccgtctcagctggagaatgtaggattcattggactcgggaatatgggatcccatatggcaaggaacctgattacggctggatataaagtgactgttcatgatataaatgaaaattcgatgaagaaattctcagacgatggaatccccacaaagcagtctccacttgaagtttcagagtcgagtgatgtcgtgattaccatgcttccttcctcttcccatgtaagtcgattgcatgttactcccattcttgatttcactgcttgaatcatgctctcagatatagacagtaattgtccttttatgcaacaagtcctacatccaaccatctctacaaatacagcttattttgtttcctggaacatattttaccatgttcacagatgttcttc

SEQ ID NO: 49222 - protein, 115 aa, Panicum virgatum
  misc_feature: Ceres CLONE 2048393
  misc_feature (32)..(115): Pfam Name: NAD_binding_2 Pfam Description: NAD binding domain of 6-phosphogluconate dehydrogenase
  misc_feature: SWISSPROT Homolog: EC 1.1.1.31 3-hydroxyisobutyrate dehydrogenase
MAGFGWRVGSKVQRWGRSFFRGFSSASIPSQLENVGFIGLGNMGSHMARNLITAGYKVTVHDINENSMKKFSDDGIPTKQSPLEVSESSDVVITMLPSSSHVSRLHVTPILDFTA

SEQ ID NO: 49223 - DNA, 593 bp, Panicum virgatum
  misc_feature: Ceres CLONE 2048414
  misc_feature: Encodes the peptide sequence at SEQ ID NO. 49224
attcactcaccgccgctcgcccgccgcccccgacgacgtcagcggctgcgcctctcgcttcgtcgagcccgctcctcgccggcgtccggcgctcgctaccaatcgatggggggcggacggaagcggcggcgagacggctcggaagcgccttccatccacccgcggaaccggtacgccgccgccgcgccggacttcgccgcgctggcggagctctacccgtccttccgccctttcgtctccgtctccgagcgcggccgcgcgtccgtcgacttcaccgacttctccgccacgcgggagctcacgcgcgtgctcctcctccacgaccatggcgtcaactggtggattccagatggacagctttgccctactgttccaaacaggtccaactacattcactggatcgaggatcttctttcctcaaatctgataccaccagtatccagctcaagtgggagggtgaggggctttgacataggaactggtgccaattgcatctaccctctccttggtgcatctttactgggatggagctttgttgggtctgatgtgactgatgttgctcttgaatgggctaagaagaatgtggagaacaa

SEQ ID NO: 49224 - protein, 162 aa, Panicum virgatum
  misc_feature: Ceres CLONE 2048414
  misc_feature (11)..(162): Pfam Name: Methyltransf_10 Pfam Description: Protein of unknown function (DUF890)
MGGGRKRRRDGSEAPSIHPRNRYAAAAPDFAALAELYPSFRPFVSVSERGRASVDFTDFSATRELTRVLLLHDHGVNWWIPDGQLCPTVPNRSNYIHWIEDLLSSNLIPPVSSSSGRVRGFDIGTGANCIYPLLGASLLGWSFVGSDVTDVALEWAKKNVEN

SEQ ID NO: 49225 - DNA, 662 bp, Panicum virgatum
  misc_feature: Ceres CLONE 2048444
  misc_feature: Encodes the peptide sequence at SEQ ID NO. 49226
aattcctccaggtgttgaatttggccacatgattcatgattttgatttgtacggagatgaagatagcccatctgcagcctctgaggatccatctatttggtttgagataatgcgattcttcacaaatcctaggaaacctatgattctggctattgcccgtccatatgctgaaaagaatattacaacgcttgtgaaggcatttggtgaatgccatccattgagggagcttgctaaccttacattgataatgggtaaccgtgaggcgatttccaaaatgaataaagtcagtgcagctgttttgacatcggtgcttacattgattgatgaatacgatttatatggtcaagtggcgtacccaaagcatcacaagcagtctgaagttactgatatttatcgtttagcagcaagaacaaagggcgcttttgtaaatgttgcttactttgagcaatttggtgtcacattgatagaggctgccatgcatgggttgcctgtaattgcaacaaaaaatggggctcctgttgaaatccatcaggttctggacaatggtcttctcgttgatccccacgatcagcattcaatcgcagatgccctctataagatgctttctgaaaagcagttttggtcaagatgtcgagagaatggactgaaaaatatacaccaat

SEQ ID NO: 49226 - protein, 220 aa, Panicum virgatum
  misc_feature: Ceres CLONE 2048444
  misc_feature (34)..(217): Pfam Name: Glycos_transf_1 Pfam Description: Glycosyl transferases group 1
  misc_feature: SWISSPROT Homolog: EC 2.4.1.14 Sucrose-phosphate synthase
  misc_feature: Functional homolog of the protein sequence given in SEQ ID NO 50680
  misc_feature: Useful for making plants with altered cell wall content and/or composition
  misc_feature: Useful for making plants with modulated biomass
  misc_feature: Useful for making plants with modulated carbohydrate content
  misc_feature: Functional homolog of the protein sequence given in SEQ ID NO 50678
  misc_feature: Useful for making plants with altered carbohydrate content
IPPGVEFGHMIHDFDLYGDEDSPSAASEDPSIWFEIMRFFTNPRKPMILAIARPYAEKNITTLVKAFGECHPLRELANLTLIMGNREAISKMNKVSAAVLTSVLTLIDEYDLYGQVAYPKHHKQSEVTDIYRLAARTKGAFVNVAYFEQFGVTLIEAAMHGLPVIATKNGAPVEIHQVLDNGLLVDPHDQHSIADALYKMLSEKQFWSRCRENGLKNIHQ

SEQ ID NO: 49227 - DNA, 692 bp, Panicum virgatum
  misc_feature: Ceres CLONE 2048467
  misc_feature: Encodes the peptide sequence at SEQ ID NO. 49228
gtgctgcgccttggggagttctcatggagcagggtaagaaagcaaaggtactgtgcctgcatggcttccggacaagtgggaatttcttgaagaagcagatcagcaagtggcacccttctatattccagcagtttgacatggtattccctgatggcatcttcccagctggtggaaagtcggaaatagatggcatatttccaccaccgtactttgagtggttccagttcaataaggagttcacggaatacacaaatctagatgaatgcatttcatatctgtgtgattacatggtgaaaaatggaccttttgaaggcctacttggattctcccaggtaaaaatgaaacccaatgaagcaactattttggagcacctgagaattgtgtcctatgtttttgtggagtttgagtttatttagctcctgagattcgttaattgttaatgtatgataatacctgcatacaaactagaatataggttcaagcaaaggataaaatgcactgaactgacacttattgaactgctatgaagtttgggcaggagggaaggtggaaacccgttgatgtcttgcagttaattttttaatttcctgctacccaaggtgcatgtctgacaggattataacttacaagcacttcgacaggagcggagccagaaatggctttcaccagtgggcatgtgctggattggacga

SEQ ID NO: 49228 - protein, 130 aa, Panicum virgatum
  misc_feature: Ceres CLONE 2048467
  misc_feature: SWISSPROT Homolog: EC 1.5.1.3 Dihydrofolate reductase
MEQGKKAKVLCLHGFRTSGNFLKKQISKWHPSIFQQFDMVFPDGIFPAGGKSEIDGIFPPPYFEWFQFNKEFTEYTNLDECISYLCDYMVKNGPFEGLLGFSQVKMKPNEATILEHLRIVSYVFVEFEFI

SEQ ID NO: 49229 - DNA, 707 bp, Panicum virgatum
  misc_feature: Ceres CLONE 2048475
  misc_feature: Encodes the peptide sequence at SEQ ID NO. 49230
catcactcaccacaagctaagttttctagttttgagtagctagcgttcgttgttatacttgcttagctagtatacctagagctagctaacaacgatggccgccacacctgcacgcaccttctccatgccctccgtcgagcctcttctccgttcagcttcgccggcggcaaccagaaacggccgcccccgtggccgttccatcatcccttgggctgcggcggcgtccaacacgctgctgcccagcaattttgacagcctccagcaccagattctacagcagcgtcgggagagcggccgggagatgatggccaccatcgacaacctcaagcgcctctgcatcgaccactacttcgaggaggagatccagagcgccatgggcgcgtgcatgcatctcatccacagcgatgatctcttcgatgcaacccttgcattcaggcttatgagagaggccggccatgatgtttcagcagtcaatgtggcagatgacgttcttaggaggttcaccgacggcaacggtgagttcaccctagctctcaccaagaacgtcagggggctcctgagcctgcatgacatgtcacacctggacatgggagttgaaacatcactgcacaaggcaaaggagttctcaagcaagcacctggcatctgccatcaggcacctggagccaggccttgcaaggtacgtgaggcagtccctggaccatccat

SEQ ID NO: 49230 - protein, 204 aa, Panicum virgatum
  misc_feature: Ceres CLONE 2048475
  misc_feature (39)..(204): Pfam Name: Terpene_synth Pfam Description: Terpene synthase, N-terminal domain
  misc_feature: SWISSPROT Homolog: EC 4.2.3.13 (+)-delta-cadinene synthase
MAATPARTFSMPSVEPLLRSASPAATRNGRPRGRSIIPWAAAASNTLLPSNFDSLQHQILQQRRESGREMMATIDNLKRLCIDHYFEEEIQSAMGACMHLIHSDDLFDATLAFRLMREAGHDVSAVNVADDVLRRFTDGNGEFTLALTKNVRGLLSLHDMSHLDMGVETSLHKAKEFSSKHLASAIRHLEPGLARYVRQSLDHP

SEQ ID NO: 49231 - DNA, 695 bp, Panicum virgatum
  misc_feature: Ceres CLONE 2048476
  misc_feature: Encodes the peptide sequence at SEQ ID NO. 49232
ccagctgcaacccaccgaagaacacacaacaccaccagagagataacaaagccttcttcctacagcactcttgcaatcaacagagctagctcagttcgtccgagcacacagaagcatcagcaatgtcgctcgtcaggcgcggcaacgtgttcgaccccttctccatggacctctgggaccccttcgacagcatgttccgctccatcgtcccatcgtcctcctccgactccgacaccgccgccttcgccaacgcccgcatcgactggaaggagacccccgaggcgcacgtcttcaaggccgacctccccggcgtcaagaaggaggaggtcaaggtggaggtggaggacggcaatgtgctggtcatcagcggccagcgcagcaaggaggaggaggacaagaacgacaagtggcaccgcgtcgagcgcagcagcggccagttcatgaggcgcttccgcctgccggaggacgccaaggtggagcaggtgaaggccgggctggagaacggcgtgctcacggtcaccgtgcccaaggccgagggcaagaagccggaggtgaagagcatccagatctccggttaagcggccgtggagacggatggtgaggtgagcgtgtgcgggggaggggacacgggtagggatggaagtggactagcccgcgaacccacatatggggtaaatttttgcaggtaattgtgg

SEQ ID NO: 49232 - protein, 151 aa, Panicum virgatum
  misc_feature: Ceres CLONE 2048476
  misc_feature (47)..(150): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRGNVFDPFSMDLWDPFDSMFRSIVPSSSSDSDTAAFANARIDWKETPEAHVFKADLPGVKKEEVKVEVEDGNVLVISGQRSKEEEDKNDKWHRVERSSGQFMRRFRLPEDAKVEQVKAGLENGVLTVTVPKAEGKKPEVKSIQISG

SEQ ID NO: 49233 - DNA, 738 bp, Panicum virgatum
  misc_feature: Ceres CLONE 2048478
  misc_feature: Encodes the peptide sequence at SEQ ID NO. 49234
atccgaaagccaaagcgagtctcaccagtcaaagagcgagttctagtagctttgctgatctgttctgctgtttttagtttggaaagcacagaaaatcttttcattagagaggcaatggctactgaagtgttgattgggaaaaatgacagtgttgagggtgttcgcactttctttggcatggatttttatgcaccatctgttgtacttaccaccggaacatttatgagtggtaagatttgggttggtaggacatcaatgcctgctgggcgagctggagaatcagcttctcatggacttactgaaaacttgcagcatctgggttttgaaactgaccgcttaaaaactggtacaccaccacgaattgatcgcaggacagttgatttttctggattggaaccccagcatggtgatgaagaggtaggttggttcagttttgatcctgaatttcacgtcgagagagagcagatgtgctgctatttaacacgaaccacaaaagagacgcaccaaattgttagagataacttagatgaaacaccaacttacggtgggtgggttgaagcaaggggaccaagatactgcccagcaattgaagataagattgtaaggttcaaagataaagagtctcatcagatctttcttgaacctgagggtagaaatgttccggaactatatctgcagggcttttccactgggcttcctgagagattgcagttatcacttgtccgaactataccaagg

SEQ ID NO: 49234 - protein, 245 aa, Panicum virgatum
  misc_feature: Ceres CLONE 2048478
  misc_feature (1)..(245): Pfam Name: GIDA Pfam Description: Glucose inhibited division protein A
IRKPKRVSPVKERVLVALLICSAVFSLESTENLFIREAMATEVLIGKNDSVEGVRTFFGMDFYAPSVVLTTGTFMSGKIWVGRTSMPAGRAGESASHGLTENLQHLGFETDRLKTGTPPRIDRRTVDFSGLEPQHGDEEVGWFSFDPEFHVEREQMCCYLTRTTKETHQIVRDNLDETPTYGGWVEARGPRYCPAIEDKIVRFKDKESHQIFLEPEGRNVPELYLQGFSTGLPERLQLSLVRTIP

SEQ ID NO: 49235 - DNA, 735 bp, Panicum virgatum
  misc_feature: Ceres CLONE 2048479
  misc_feature: Encodes the peptide sequence at SEQ ID NO. 49236
attcacatctcctgcatctttgcctccttcctctcactagatctcacctttgcgacggcaaggtaggcgcttggagatcagagaaatgtcaacccagtttgcatccgagcatgtttgctatgtcaactgcaactattgcaacaccatcctggtggtgaatgtgccgaacacttgttcctacaacatcgtgactgttaaatgtgggcattgcacaatggcgctctcgatggatctcagtcctttccaccaggcacggattgttccagacaaccagaacagaggatttcatcaatacaataattttgggagctatgagccagcctccagaaatctacgaaatcagtccatgtaccagatgtcaaacaatcagccacaagtgcaaccaatgcgatccccagagaagagacagcgtgttccgtcagcatacaacagattcatcaaggaagaaatacaaaggataaagactagcaatccggagattagccacagggaggcattcagtgctgcagcaaagaattgggctcatcttcctcggctccatttcggcctgagtgtcgccgacggtggcggcggcagcagctagatcatcgctgatgctgtgcttgctacatatgtcaagaagatcgatcgagcgctgcgtacgcgtatgcgcacgctgacgatcgatggagaactcttcatcatcagcttatataaagttaaagctgtgctacatgtattctgctaccggggttt

SEQ ID NO: 49236 - protein, 165 aa, Panicum virgatum
  misc_feature: Ceres CLONE 2048479
  misc_feature (1)..(155): Pfam Name: YABBY Pfam Description: YABBY protein
  misc_feature: The sequence is a functional homolog of SEQ ID NO 414 in the 10/666,642 US patent application
  misc_feature: The sequence is a functional homolog of SEQ ID NO 888 in the 11/435,388 US patent application
  misc_feature: The sequence is a functional homolog of SEQ ID NO 1150 in the 10/666,642 US patent application
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSTQFASEHVCYVNCNYCNTILVVNVPNTCSYNIVTVKCGHCTMALSMDLSPFHQARIVPDNQNRGFHQYNNFGSYEPASRNLRNQSMYQMSNNQPQVQPMRSPEKRQRVPSAYNRFIKEEIQRIKTSNPEISHREAFSAAAKNWAHLPRLHFGLSVADGGGGSS

SEQ ID NO: 49237 - DNA, 691 bp, Panicum virgatum
  misc_feature: Ceres CLONE 2048480
  misc_feature: Encodes the peptide sequence at SEQ ID NO. 49238
aagaggagagcaacagagccacatcggagccacagccatcgccgtcgccgttggcgctccgttgatcgcgcgccgtccgtcgtcggcgccccactcgccgggatccgatcgcataagtaccacaccctagctgcggcggcaacgagcggcggcaccggaaaaaaaaaatcctccccccactatgccgtccccttcctctgcccactggctgagcttggtcgggagcgtctggctccagagcatcaacggccccaacgccgacttccccgtctactcgtcgcagctcaaggaggtcaagggcatctcccaggtgcggctcaacttcctcgccttcgcctccgacgccgggaagctcttcggctggctcgccggggtggccgcgctgcacctcccgctctgggtggtcgcgctcaccggcgctgccttcggcctcgtcggctacggcgtccagttcctcttcctcgagaggcccgggctcgcgtactggcacctcttcctgctcacctccctcgccggcaacggcatctgctggatcaacaccgtgtgctacctcctctgcatcaacaacttccccgccgacagccgcgtcgccgtcagcctcgcgacgagctacctcgggctcagcgccaagctctacaccaccgtggccgagaccctccccagggcggccagggccaggtactccaccacc

SEQ ID NO: 49238 - protein, 169 aa, Panicum virgatum
  misc_feature: Ceres CLONE 2048480
  misc_feature (8)..(168): Pfam Name: Nodulin-like Pfam Description: Nodulin-like
MPSPSSAHWLSLVGSVWLQSINGPNADFPVYSSQLKEVKGISQVRLNFLAFASDAGKLFGWLAGVAALHLPLWVVALTGAAFGLVGYGVQFLFLERPGLAYWHLFLLTSLAGNGICWINTVCYLLCINNFPADSRVAVSLATSYLGLSAKLYTTVAETLPRAARARYST

SEQ ID NO: 49239 - DNA, 546 bp, Panicum virgatum
  misc_feature: Ceres CLONE 2048481
  misc_feature: Encodes the peptide sequence at SEQ ID NO. 49240
acgcatcattaattccggaggggaaacgcacgcggtatccatccagtggctggctgggtagcgggggcgcagccgcgcaggtgcaggcgggcgagcgagctcggccatggcgagcgcgatgaacggcggcggcggcggcggggcgctgaagcggatgggcccgctgcgggtgcagtactacatcgtgatgggcgcggtggcggcggccgtggtgctggccacgctgcgctacatgccgggccccgccgccgccgccaccagcagcgtggtccggccgggcgcctcctccgcggcggcggcccccggcgccgaggcggaggcagaggcggatgagggggtggcggcggagagggagaagaggaagaatgagggggacggggtggtgctgttcaacttcggcgactccaacagcgacacgggcggcgtggcggcggtgatggggatccgcatcgcgccgccggaggggcgggtctacttccaccaccccacggggaggctctccgacggccgagtcatcctcgacttcatctgtgaacgctccgtgct

SEQ ID NO: 49240 - protein, 146 aa, Panicum virgatum
  misc_feature: Ceres CLONE 2048481
  misc_feature: SWISSPROT Homolog: EC 3.2.1.51 Alpha-L-fucosidase
MASAMNGGGGGGALKRMGPLRVQYYIVMGAVAAAVVLATLRYMPGPAAAATSSVVRPGASSAAAAPGAEAEAEADEGVAAEREKRKNEGDGVVLFNFGDSNSDTGGVAAVMGIRIAPPEGRVYFHHPTGRLSDGRVILDFICERSV

SEQ ID NO: 49241 - DNA, 622 bp, Panicum virgatum
  misc_feature: Ceres CLONE 2048482
  misc_feature: Encodes the peptide sequence at SEQ ID NO. 49242
acttgtctgggaagacggttaggtccacggcttcttggtaggggcaatgatggttccatgaggcttgtgagggatttgtattcaatacttgatgaaataaatgctgaggaagctcctgttgatttgaaggttccagaatcttttgatgaatttatctgggatatgaagaataatgattacgatttaaggtcatttgcttttaagctgaaggctacgatggagagcatggataaggaattgagatcatcaaggttatcagagcagctaaacaagcactatgctgcaattgctattcctaaaggcctttattgcctttcgttgcgtttaaccgatgaatactcctcaaatgcccttgcaaggaaacaactaccaccccctgagttggtgcctcgtctttcggacaactcctattaccattttgttttagcatcagataacatccttgcagcctcagttgtggttagatcgacagttcgatcatcactgaagcctgagaggatagtcttccatgttattactgacaaaaagacctaccctgccatgcattcatggtttgctttgaattctctctatcccgctattgttgaggtgaaaggtgtgcaccaatttgattggttaacaa

SEQ ID NO: 49242 - protein, 207 aa, Panicum virgatum
  misc_feature: Ceres CLONE 2048482
  misc_feature: Functional homolog of the protein sequence given in SEQ ID NO 51741
  misc_feature: Useful for making plants with altered carbohydrate content
  misc_feature: Functional homolog of the protein sequence given in SEQ ID NO 51768
  misc_feature: Useful for making plants with altered cell wall content and/or composition
TCLGRRLGPRLLGRGNDGSMRLVRDLYSILDEINAEEAPVDLKVPESFDEFIWDMKNNDYDLRSFAFKLKATMESMDKELRSSRLSEQLNKHYAAIAIPKGLYCLSLRLTDEYSSNALARKQLPPPELVPRLSDNSYYHFVLASDNILAASVVVRSTVRSSLKPERIVFHVITDKKTYPAMHSWFALNSLYPAIVEVKGVHQFDWLT

SEQ ID NO: 49243 - DNA, 655 bp, Panicum virgatum
  misc_feature: Ceres CLONE 2048498
  misc_feature: Encodes the peptide sequence at SEQ ID NO. 49244
atccggcttctgctgcccccggcgcccgcgtctgccccacccgtcggcgtgctggtcgccgtcgccgccggagcgctgactcgccgccgatcctggtgttcgacgcgatgcagccgcctatggggaacgagaggccgccgccgccaggccgccctgtctcagctttcgtgcccggcgccgccgtcccgcctccaccttttgccgccggtggcccgttcgtcccgccgccacggcagggagcgctgctgcctcagcctggtgctgcggcaccccctttcggggccgcgcaacccgcggcaatgggtggctacaggggtccaccgccgtcccaggttccctttgctgccgcgccaccgcctcagcggcctttcacctccgcaccgccgcctcagggccctttcacctccgcaccgccgcctcagggccctttcacctccgcgccgccatctcagggaccctttgcctctgctccaccgcctcagggcccctttacctcggctcgaccatctcagggccccttcacctcagctccaccgacacaggcccccttcgctgctggaccactgcctcagggcccctttgctgcctctgcacaggcaccttttcggcccccaccatcgtcgtcccttgggcagccccaatctccccccagagg

SEQ ID NO: 49244 - protein, 182 aa, Panicum virgatum
  misc_feature: Ceres CLONE 2048498
  misc_feature: SWISSPROT Homolog: EC 3.6.5.5 Dynamin GTPase
MQPPMGNERPPPPGRPVSAFVPGAAVPPPPFAAGGPFVPPPRQGALLPQPGAAAPPFGAAQPAAMGGYRGPPPSQVPFAAAPPPQRPFTSAPPPQGPFTSAPPPQGPFTSAPPSQGPFASAPPPQGPFTSARPSQGPFTSAPPTQAPFAAGPLPQGPFAASAQAPFRPPPSSSLGQPQSPPR

SEQ ID NO: 49245 - DNA, 648 bp, Panicum virgatum
  misc_feature: Ceres CLONE 2048509
  misc_feature: Encodes the peptide sequence at SEQ ID NO. 49246
gagcaaccacgaacagaaagtaggaatcagtctgcacctgctgctaaacctccagtgtcatctccaccaaaaccagttcctccgctactatcaaagccttctgtagcaccggcacctcgtcgtcttgtcaagtctgatacatcgaaggacaaaaaaggacctatcttaatagataaatttgcttccaagaggccaacgattgatccagttgttcctgaggagttgttagatccactaaagccagtacgaggcccgccaacaaaagtcagaattgatcgtcgcaaaaaaccagaaacacaagctggttcccgccgacgtatgcccaatgatgatgggttagttgatgaggatactgctgatgtgccaatttctggtgttccagtgcgcaagagtagaaggtggagcaaggcaaaacgtcgggctgcaaggcttgaggctatgcaggctgaagagccagtcagagttgagatccttgaagtaggtgaacaaggtatgctgattgaggacttggcatatgaattggcagttagtgaatcagaaattttgcgctttttatctgtgagaggagttatgcttgataacgttcagactctggataaagacttggttaagatggtttgcatggaatatgatgttgaagtactagaa

SEQ ID NO: 49246 - protein, 215 aa, Panicum virgatum
  misc_feature: Ceres CLONE 2048509
  misc_feature (162)..(213): Pfam Name: IF2_N Pfam Description: Translation initiation factor IF-2, N-terminal region
EQPRTESRNQSAPAAKPPVSSPPKPVPPLLSKPSVAPAPRRLVKSDTSKDKKGPILIDKFASKRPTIDPVVPEELLDPLKPVRGPPTKVRIDRRKKPETQAGSRRRMPNDDGLVDEDTADVPISGVPVRKSRRWSKAKRRAARLEAMQAEEPVRVEILEVGEQGMLIEDLAYELAVSESEILRFLSVRGVMLDNVQTLDKDLVKMVCMEYDVEVL

SEQ ID NO: 49247 - DNA, 352 bp, Panicum virgatum
  misc_feature: Ceres CLONE 2048523
  misc_feature: Encodes the peptide sequence at SEQ ID NO. 49248
ttacatagaagctcgatacaatggcgatgcggaacatgcacgtggcgacgcgttcgctggacgccgacatgacggtggacgagctcaaggagtggctgcggcggttcgactcggaccgctacgggcgcatcacccgcgacgagctgcggcgcgccatgcccgccatctcgcgcccggttctcggcgtgacggagcaggcagggcatgacctacgccgacgcgtacggcgacagctacatctaccacagcgaggtggacggcctcatcgagttcgcgcacacaaaccccgcgctccagatcgtcacctactgagctactcgacgctcgtggcggccggtcggctcgggaggcg

SEQ ID NO: 49248 - protein, 110 aa, Panicum virgatum
  misc_feature: Ceres CLONE 2048523
  misc_feature (21)..(49): Pfam Name: efhand Pfam Description: EF hand
MAMRNMHVATRSLDADMTVDELKEWLRRFDSDRYGRITRDELRRAMPAISRPVLGVTEQAGHDLRRRVRRQLHLPQRGGRPHRVRAHKPRAPDRHLLSYSTLVAAGRLGR

SEQ ID NO: 49249 - DNA, 738 bp, Panicum virgatum
  misc_feature: Ceres CLONE 2048525
  misc_feature: Encodes the peptide sequence at SEQ ID NO. 49250
ctctctctctctctctctctctgtcttcctcctgttcggcggccggcaggaatgggcatggggccttcctcccctcagccatggcagcatcaccgcttctgctgcgcccttctcgtcctcgttcttttcgtcttcctctggggtacttctcaggcaaatgaagaacttgccacgttgccaccaagaggttggaactcatatgactctttttcatggactgtggatgaaatttcatacctgcaaaatgcacagatcttggcagagaagttactcccacatggataccagtatgcagttattgatttcctctggtaccggaagtatgttgatggggcacacacagattcatatggatttgataacatcgatgaatggggacgaccatttccggaccttcaaaggtttccatcatctagagttgacagagggtttagtcagattgccagtaaggtccatgcaatgggcttgaaatttggcatccatttgatgaaaggtataagtgtgcaagctgttaatgcaaacacgccaatcttggacatcaagacgggaaaaccgtatatagaggacggccgtcaatggacagcacgtgacataggtctcactgacagaacttgtgcatggatgccgcatggatttatgagtgtttacacagatactggagctggacgggccttttcaagatctatttatcgacaatatgctgattggggtgttgattttgtgaaagttgattgtatc

SEQ ID NO: 49250 - protein, 228 aa, Panicum virgatum
  misc_feature: Ceres CLONE 2048525
  misc_feature: SWISSPROT Homolog: EC 3.2.1.22 Alpha-galactosidase
MGMGPSSPQPWQHHRFCCALLVLVLFVFLWGTSQANEELATLPPRGWNSYDSFSWTVDEISYLQNAQILAEKLLPHGYQYAVIDFLWYRKYVDGAHTDSYGFDNIDEWGRPFPDLQRFPSSRVDRGFSQIASKVHAMGLKFGIHLMKGISVQAVNANTPILDIKTGKPYIEDGRQWTARDIGLTDRTCAWMPHGFMSVYTDTGAGRAFSRSIYRQYADWGVDFVKVDC

SEQ ID NO: 49251 - DNA, 645 bp, Panicum virgatum
  misc_feature: Ceres CLONE 2048535
  misc_feature: Encodes the peptide sequence at SEQ ID NO. 49252
actccttcctcccgcctcgcctcgtatccgccgccgagcagcgaaactccccctccgccgccgccgcagccgccgcctgctacggcgggcgggatccggctcgccggctctcccctgcggtgaggtacaagatggagggagctggaagagatgccaaccctttgagcggctaccgaatcggcaaaaccctggggattggatcgttcggtaaggtgaagatcacggaacatatattgacaggccataaggtggccatcaagatcctcaatcgccggaagatcagaagcatggaaatggaagacaaagtgaagagagaaatcaagatactgagactatttatgcatcctcatatcatacgcctttatgaggtgatagatacacctgccgatatctatgttgttatggagtatgttaaatctggagagttgtttgattacattgttgagaagggaagactacacgaagaacaagctcgccgtttttttcagcagattatatcgggtgttgaatattgccatagaaacatggtagttcaccgtgatctaaagccagagaaccttcttttagattcaaaatggaatgttaagattgctgactttggcttaagtaatgttatgcgtgatggtcactttctaaagacgagtt

SEQ ID NO: 49252 - protein, 171 aa, Panicum virgatum
  misc_feature: Ceres CLONE 2048535
  misc_feature (14)..(167): Pfam Name: Pkinase Pfam Description: Protein kinase domain
  misc_feature: SWISSPROT Homolog: EC 2.7.11.1 Non-specific serine/threonine protein kinase
  misc_feature: Functional homolog of the protein sequence given in SEQ ID NO 50696
  misc_feature: Useful for making plants with modulated salt sensitivity
MEGAGRDANPLSGYRIGKTLGIGSFGKVKITEHILTGHKVAIKILNRRKIRSMEMEDKVKREIKILRLFMHPHIIRLYEVIDTPADIYVVMEYVKSGELFDYIVEKGRLHEEQARRFFQQIISGVEYCHRNMVVHRDLKPENLLLDSKWNVKIADFGLSNVMRDGHFLKTS

SEQ ID NO: 49253 - DNA, 628 bp, Panicum virgatum
  misc_feature: Ceres CLONE 2048549
  misc_feature: Encodes the peptide sequence at SEQ ID NO. 49254
actccaatccccaatctcagcttgaatccccacacccccgctcgaatccactcctccggggaatccaccacccgtccggtcgtcggcaagcatgtctgggcgcggcaagggcggcaaggggctcggcaagggcggcgcgaagcgccaccggaaggtgctgcgcgacaacatccaaggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgtaccctctacggcttcggcggctaggctgatgcgctcaccccttagctgtctcccttctgcagcttcgacgttatctgggcggtgctcccaggtcttgcgttcaagaaagtctcagactcgcttgtttagctcatctcttcctgtagtaggtttatctgttgatgttaccttctgaaattgggagccaatcttgtcgtgcttacttgtgatttttctatgcaaatggccggtgttctgtgctgtgtatct

SEQ ID NO: 49254 - protein, 103 aa, Panicum virgatum; identical to SEQ ID NO: 12044
  misc_feature: Ceres CLONE 2048549
  misc_feature (25)..(94): Pfam Name: Histone Pfam Description: Core histone H2A/H2B/H3/H4

SEQ ID NO: 49255 - DNA, 717 bp, Panicum virgatum
  misc_feature: Ceres CLONE 2048554
  misc_feature: Encodes the peptide sequence at SEQ ID NO. 49256
aaaaccgtgacgtaacagaggccgaacgccattctcctcctcgctgactcgctccgccgccgccgccctcgcgaagcacctaggcgccccttttgcgccgccgtccggaaggttttcgcctcagggcatgtggctctgttagtttacctactgcagctacaagaaccacccttgcagaagtatgaatccttattttgttggcttacttgtccctgttgcggtctccctgctgctccgcaagaggagaaaggctgaaatgaagaggggagtgcgagtcgaggttggtggagatcctggatatgcagtccgtaactatcgatttgaacagcctgttgagacacactgggaaggggtgtccacccttgccgagcttttcgagcaatcatgcaaggagtatgtctacatgcccctccttggcaccaggaagctcatttcgagggaaatcgaatccgcacctggtggcagatcatttgagaagcttcatctgggagagtatgagtggaagtgttacgctgaggtcttcaagagcgtctgtaacttttcatctggcctaattcgattaggtcaccagaagaatgagcgtgttgccatttttgccgagacgaaagctgaatggcagattgctttgcaggcatgcttcagacaaaatattacagttgtcaccatctatgcctcattgggagaggaagcattgtgccactcactaaatgaagctga

SEQ ID NO: 49256 - protein, 178 aa, Panicum virgatum
  misc_feature: Ceres CLONE 2048554
  misc_feature: SWISSPROT Homolog: EC 6.2.1.3 Long-chain-fatty-acid--CoA ligase
MNPYFVGLLVPVAVSLLLRKRRKAEMKRGVRVEVGGDPGYAVRNYRFEQPVETHWEGVSTLAELFEQSCKEYVYMPLLGTRKLISREIESAPGGRSFEKLHLGEYEWKCYAEVFKSVCNFSSGLIRLGHQKNERVAIFAETKAEWQIALQACFRQNITVVTIYASLGEEALCHSLNEA

SEQ ID NO: 49257 - DNA, 687 bp, Panicum virgatum
  misc_feature: Ceres CLONE 2048555
  misc_feature: Encodes the peptide sequence at SEQ ID NO. 49258
gtcgagctgacttttaccttcgacaccttctctgcccttggctctccccttagctaccttgcatccgcaccccccttcccccaattcgccgacccgccgctcctgaaatcccatccaaattcttccgcatcttttcaaaaagatcggattttgggaggtgcaccgcccccagatcggggaggaatccccgttccgtctggtgggtcggcctccgctgcccgtttcttggctattttccccttctcaagggcagctgttggatgggctgcctgccgtgcttcgggtcggctggtgagggggcggccaagaagggcggcgcgcgcaaggacggctcgtcggatcgccgcgtcacccgcgtcggatcagataaatcaaagccacagggtggatcggactctaagaaggatgcagttatcctaagggatgggaacaatcaacatattgcagcacacactttcacttttcgtgaacttgctgctgccactaagaacttcagacaagattgcttattgggtgaaggaggttttggccgtgtttataaaggacgtttggagaatgggcagattgttgcagtgaagcaacttgatcgcaatggccttcaaggaaatagggagtttcttgttgaagttctaatgctgagcctattgcaccatgacaacctggtcaacctaattggatattgtgccg

SEQ ID NO: 49258 - protein, 142 aa, Panicum virgatum
  misc_feature: Ceres CLONE 2048555
  misc_feature: SWISSPROT Homolog: EC 2.7.11.1 Non-specific serine/threonine protein kinase
MGCLPCFGSAGEGAAKKGGARKDGSSDRRVTRVGSDKSKPQGGSDSKKDAVILRDGNNQHIAAHTFTFRELAAATKNFRQDCLLGEGGFGRVYKGRLENGQIVAVKQLDRNGLQGNREFLVEVLMLSLLHHDNLVNLIGYCA

SEQ ID NO: 49259 - DNA, 636 bp, Panicum virgatum
  misc_feature: Ceres CLONE 2048574
  misc_feature: Encodes the peptide sequence at SEQ ID NO. 49260
acaattcccacgcccacaccccaccgtctccgcaggcaatcccctccccttcctccctcaaacccccaccaaatgctccacccctccgctccccgtcgccggcccgcaaaaccctagcgccgcccgcgccctcgccgatgtcgccgccggcggcgggcggtcccggggataccccggtgccggcgtggctccgcggcctcccgcgcgccccggaataccgccccacggagtcggagttcgccgaccccatcgccttcctctcccgcgtggagcgcgaggcggccgcctacggcatctgcaaggtcatcccgccctaccagcgcccctcccgccgcttcgtcttcgctcacctcaaccgctacctcacctcctccttcgacgccgccaatccagccgtccccggctcctcctccagcactgctccctcgcggccggaatccgcggctgtgttcactacccgccaccaggagctcggcaccccgcggcgtgggcgcccgccgccacaggtgctgaagcaggtgtggcagagcggcgagcagtacacgctcgaacagtttgaagccaagtcccgcgccttctccaaggtccacctcgccggacttcgcgagccaactccactggaggtggaatccctct

SEQ ID NO: 49260 - protein, 166 aa, Panicum virgatum
  misc_feature: Ceres CLONE 2048574
  misc_feature (25)..(68): Pfam Name: JmjN Pfam Description: jmjN domain
MSPPAAGGPGDTPVPAWLRGLPRAPEYRPTESEFADPIAFLSRVEREAAAYGICKVIPPYQRPSRRFVFAHLNRYLTSSFDAANPAVPGSSSSTAPSRPESAAVFTTRHQELGTPRRGRPPPQVLKQVWQSGEQYTLEQFEAKSRAFSKVHLAGLREPTPLEVESL

SEQ ID NO: 49261 - DNA, 602 bp, Panicum virgatum
  misc_feature: Ceres CLONE 2048584
  misc_feature: Encodes the peptide sequence at SEQ ID NO. 49262
agcagtgctgtgcagccgcatccgcccgcctcgcccgcagcgagcgcatcagggcggagccgcaggggcagggagccgaggctggcggcgctccaccaagtaaagcaaaggaggaatccccagcccatccattgtttgcgagcgaaaacctcagccgaaccaaccaccagagcaacaggatggccgacagcggcgggctcagcgccaacatcgccgccgccgccgcccacgacgacgacgacaccaacgccgcacctttccccggcaccgtccagatcggaggatccccggagtacaaggtcgacaggaagctgggcaaaggtggctttggccatgtctttcttggccgacgcctaactgtggcatgctcctcggcttccgctgcccaagaggttgctatcaaatttgagcacactaccagcaagggctgtagctacggccctccgtatgaatggcaagtctgcaccgctctaggcggaacgcatggcgtgcccaaggtgcattataaaggccgccagggtgactactatgtcatgattatggatatgctggggcctagcttgtgggattcttggaattcattaggccaatccatgtcatcg

SEQ ID NO: 49262 - protein, 140 aa, Panicum virgatum
  misc_feature: Ceres CLONE 2048584
  misc_feature: SWISSPROT Homolog: EC 2.7.11.1 Non-specific serine/threonine protein kinase
MADSGGLSANIAAAAAHDDDDTNAAPFPGTVQIGGSPEYKVDRKLGKGGFGHVFLGRRLTVACSSASAAQEVAIKFEHTTSKGCSYGPPYEWQVCTALGGTHGVPKVHYKGRQGDYYVMIMDMLGPSLWDSWNSLGQSMS

SEQ ID NO: 49263 - DNA, 681 bp, Panicum virgatum
  misc_feature: Ceres CLONE 2048595
  misc_feature: Encodes the peptide sequence at SEQ ID NO. 49264
aagcaacagcctctgcctactcttcttctctccttgggtagccagcagccgaaccaagcagctagctagcgagccatggctcccaccgtgatggcctcgtccgccaccaccgtcgctccattccaggggctcaagtccaccgccgggctccccatgagccgccgctccggcagcgccagcttcggcaaggtcagcaacggtggaaggatccggtgcatgcaggtgtggccggttgagaacaacaagaagttcgagacgctgtcgtacctgccgccgctgaccaccgaggacttcctgaagcaggtggagtacctcctccgctccaactggatcccttgcctcgagttcagcaacgtcggcttcgtgttccgcgagaactccaagtccccggggtactacgacggccgctactggaccatgtggaagctgcccatgttcggctgcaccgacgccacccaggtgctcaaggagctcgaggaggccaaggccgcctacccgggctccttcatccgcatcatctgcttcgacaacgtcaggcaggtgcagtgcatcagcttcatcgcctacaagccaccgggcagcgagtaactaagagcatcctcgctcgctggcggtgcgtgagcagcaaccgtactgaactgcctgcctctgttcggttttgcttggggtcaccagagtttc

SEQ ID NO: 49264 - protein, 170 aa, Panicum virgatum
  misc_feature: Ceres CLONE 2048595
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMASSATTVAPFQGLKSTAGLPMSRRSGSASFGKVSNGGRIRCMQVWPVENNKKFETLSYLPPLTTEDFLKQVEYLLRSNWIPCLEFSNVGFVFRENSKSPGYYDGRYWTMWKLPMFGCTDATQVLKELEEAKAAYPGSFIRIICFDNVRQVQCISFIAYKPPGSE

SEQ ID NO: 49265 - DNA, 647 bp, Panicum virgatum
  misc_feature: Ceres CLONE 2048616
  misc_feature: Encodes the peptide sequence at SEQ ID NO. 49266
accgcaccgcggccacctccgcttcgctcgccaccacctttccgcgcgcgcgcgcgccccacgcacgacacgaccgcgcgcaccgcgcaccgcgcacagcaaccgccacctccagctccgatgaccggcgccggcggcgccaggagagacggcggcgcagacggggacctccttctccggccgccggagccgccgcgtgacccgctggagttcctgtcccggtcctggagcgcgtccgcggccgacgtctcgcgcgcgctcgccgccgcgcccgcgccggcagtggccgccggggctggcgccgccatcgccgaggacgttgccggggagctcgactgcgccggcgccggcggcggagggcccgcctcggggagctccttctccttcgcgtccgcggccacctcgcagctcgtcatggaccggatcatggcgcaatcgctggaagtgtcgccgctgacctccggccggctctcccacagcagcgggcctctcaacggcggcggctcgctctccgacagcccgcccgtctcgccggagatcgacgacaccaagttctgtaggctgtcgagcacgccgaagccgcagccgtacgcccggggcggcagcaagacggtgggccggtggctcaaggaccggcgggagaagaa

SEQ ID NO: 49266 - protein, 175 aa, Panicum virgatum
  misc_feature: Ceres CLONE 2048616
  misc_feature: The sequence is a functional homolog of SEQ ID NO 430 in the 10/666,642 US patent application
  misc_feature: The sequence is a functional homolog of SEQ ID NO 224 in the 10/225,066 US patent application
  misc_feature: The sequence is a functional homolog of SEQ ID NO 2372 in the 10/374,780 US patent application
  misc_feature: The sequence is a functional homolog of SEQ ID NO 929 in the 11/479,226 US patent application
MTGAGGARRDGGADGDLLLRPPEPPRDPLEFLSRSWSASAADVSRALAAAPAPAVAAGAGAAIAEDVAGELDCAGAGGGGPASGSSFSFASAATSQLVMDRIMAQSLEVSPLTSGRLSHSSGPLNGGGSLSDSPPVSPEIDDTKFCRLSSTPKPQPYARGGSKTVGRWLKDRREK

SEQ ID NO: 49267 - DNA, 680 bp, Panicum virgatum
  misc_feature: Ceres CLONE 2048629
  misc_feature: Encodes the peptide sequence at SEQ ID NO. 49268
acagccctgctcatcctctccctccttggaatcgcaggcggagccgcaggggcagggggccgaggctggcggcgctccaccaagtaaagcaaaggaggaatccccagcccatccattgtttgtgagtttgttattgctttgctgccgctcaaacctagaactcaattattgtcgtagatcgatcgatcgatccatccatccatccatccatccatcgactagattgatatatagatagatgctccgccgcgattgcatggcgctgccgccgtgctcccgcatcccgccgtcctgaccccaaccacgtcccctgtgggaaggcgagcgaaaacctcagccgaaccaaccaccagagcaacaggatggccgacagcggcgggctcagcgccaacatcgccgccgccgccgcccacgacgacgacgacaccaacgccgcacctttccccggcaccgtccagatcggaggatccccggagtacaaggtcgacaggaagctgggcaaaggtggctttggccatgtctttcttggccgacgcctaactgcggcatgctcctcggcttccgctgcccaagaggttgctatcaaatttgagcacactaccagcaagggctgtagctacggccctccgtatgaatggcaagtctacaccgctctaggcggaacgcatggcgtgccccag

SEQ ID NO: 49268 - protein, 105 aa, Panicum virgatum
  misc_feature: Ceres CLONE 2048629
  misc_feature: SWISSPROT Homolog: EC 2.7.11.1 Non-specific serine/threonine protein kinase
MADSGGLSANIAAAAAHDDDDTNAAPFPGTVQIGGSPEYKVDRKLGKGGFGHVFLGRRLTAACSSASAAQEVAIKFEHTTSKGCSYGPPYEWQVYTALGGTHGVP

SEQ ID NO: 49269 - DNA, 395 bp, Panicum virgatum
  misc_feature: Ceres CLONE 2048640
  misc_feature: Encodes the peptide sequence at SEQ ID NO. 49270
gcatctcaaccgcatctagctagcacggcgtcccccgctcctgcggcagagccatccagctagcctcgctcgcttgcctgcccggccaccatggtgtccgccgagcgccaccactccatcgacccgcaggtacggcagctggcccccggtgaggtctccgatgatgacaagctctgcaagtactacgtcctcctcttggaccgcttcctcgacatcctccagaacctccacggccccgccatccgcgaattcggcctagactgctcccatctggtggcggactacgaaggcaagctctacgccgcgaagctcacggagctcgggtccagctctcgcggcgctggcccccaccgactccatccacgtcgcgggctccatccagcacatgctcaacc

SEQ ID NO: 49270 - protein, 101 aa, Panicum virgatum
  misc_feature: Ceres CLONE 2048640
  misc_feature: SWISSPROT Homolog: EC 4.1.1.31 Phosphoenolpyruvate carboxylase
MVSAERHHSIDPQVRQLAPGEVSDDDKLCKYYVLLLDRFLDILQNLHGPAIREFGLDCSHLVADYEGKLYAAKLTELGSSSRGAGPHRLHPRRGLHPAHAQ

SEQ ID NO: 49271 - DNA, 671 bp, Panicum virgatum
  misc_feature: Ceres CLONE 2048677
  misc_feature: Encodes the peptide sequence at SEQ ID NO. 49272
actcgtgtttgtccgctgctcgactcgcttgctgcgctgccgcccgccgcggccttcccaatctccgaccaccaccaccccgcctcctcctgctactcctccaatggccgcgccctcccacctccacctcctgggctgccccaaaaccctagccctagccccgccctcgtcgcggggcccctccgccgccgccgctccccgcctcggcttccgccgcctccgcctccgccccgccgccgcgctcggccccgccgacgccggcgagctgctcggccgcgtcgaggccttcctctacacagtcgcggacgccgccgtctccgcggccccggaggcgggcggcggcgccggggccaaggaggcggccggggactggctctccggcatcaccaactccatggagaccgtgctcaaggttctcaaagatggtctatcagctctccatgttccttattcatatggttttgcaatcattctcctcactgttcttgtcaaggctgctacatttcctcttacaaagaagcaggttgaatctgcacttgcaatgagatcactgcaacctcaagtgaaggccattcaagaacgatatgctggtgatcaggaaaggatacagcttgaaactgctcgtttatacaagttatctggtgttgacccacttgcaggatgcttgccta

SEQ ID NO: 49272 - protein, 189 aa, Panicum virgatum
  misc_feature: Ceres CLONE 2048677
  misc_feature (116)..(189): Pfam Name: 60KD_IMP Pfam Description: 60Kd inner membrane protein
MAAPSHLHLLGCPKTLALAPPSSRGPSAAAAPRLGFRRLRLRPAAALGPADAGELLGRVEAFLYTVADAAVSAAPEAGGGAGAKEAAGDWLSGITNSMETVLKVLKDGLSALHVPYSYGFAIILLTVLVKAATFPLTKKQVESALAMRSLQPQVKAIQERYAGDQERIQLETARLYKLSGVDPLAGCLP

SEQ ID NO: 49273 - DNA, 668 bp, Panicum virgatum
  misc_feature: Ceres CLONE 2048719
  misc_feature: Encodes the peptide sequence at SEQ ID NO. 49274
atttagaaacaccaagggcaagctcgtgctaactgttaaaagccacatctttaaatccatcgccgccatgtttcctggtgtggatgtgaaagagcaagaggtgttcaatcagtgtaactggaggcacaatgacatagctggtgatacaatgacctggcttgagtggatcctgtcgcagtcacttctgcgaattgcagagtccaacccacaaggcatggatgagttctggctgcagcagggcaccgcactgctgcttagactattgaagagttcgcaggaggatgtgcaggagcgcgcagctactgcccttgctacatttgtagttatggatgatgagagtgcgaatgtggatcctgcaaggtcggaggcagtgatgctgaatggaggcatccgaatattactggacctggcaaggtgctcaagggagagtgcacagtcagaagcagcgaaggctattgccaacttgtcagttaataccaaggttgccaaggcagttgcagatgaaggcggtataacaatactcactagtttggctaagtcgaagaataggcttgttgccgaagaagctgctggtggcctttggaatctctctgtgggtgaagaccacaaggcggctatcgctgtatctggcggtatcaaggccctggtcgatctaatatatcgttggc

SEQ ID NO: 49274 - protein, 222 aa, Panicum virgatum
  misc_feature: Ceres CLONE 2048719
  misc_feature (158)..(198): Pfam Name: Arm Pfam Description: Armadillo/beta-catenin-like repeat
  misc_feature (117)..(157): Pfam Name: Arm Pfam Description: Armadillo/beta-catenin-like repeat
FRNTKGKLVLTVKSHIFKSIAAMFPGVDVKEQEVFNQCNWRHNDIAGDTMTWLEWILSQSLLRIAESNPQGMDEFWLQQGTALLLRLLKSSQEDVQERAATALATFVVMDDESANVDPARSEAVMLNGGIRILLDLARCSRESAQSEAAKAIANLSVNTKVAKAVADEGGITILTSLAKSKNRLVAEEAAGGLWNLSVGEDHKAAIAVSGGIKALVDLIYRW

SEQ ID NO: 49275 - DNA, 683 bp, Panicum virgatum
  misc_feature: Ceres CLONE 2048724
  misc_feature: Encodes the peptide sequence at SEQ ID NO. 49276
agcatttgccggccacttttttcgtcgtcctcgtcttcgtcgtcttctagtagtcgtaagtgcggggaggattggccggccggcgacgaggctcctcctcctcctcatctttctctgcatacaatacatacggatatacgtatatgcttgttctccgccgcctccgtctcccgctgccacgcccacttctcgtctcctcctccacctggtggtcgtcgacaagccaacggagacccgccatggcgtcctcctcttccgccgcggtcgttgccgagggctcggcggcccgccgcttctggatcgccgcctccacgcgggaggccgccttcgccgcatacacacccttcctcctctccctcgccgccggcaacctgcgcctcgacgccttccgccattacatcgcgcaggacgcgcacttcctccacgccttcgcgcgcgcctacgagatggccgaggattgcgccgacgacgacgacgacagggccaccatcgccgccctcaggaaggccatcctccaagagctcagcctccacgcctccgtcctcgaggagtggggagttgatcctaccaaggagatccctccaagtgcagctacagccaagtacactgaattcctacttgcaactgcagctggaaaagttgatggtgcaaaaagttctgacaaaatggtcacaccattcgag

SEQ ID NO: 49276 - protein, 179 aa, Panicum virgatum
  misc_feature: Ceres CLONE 2048724
  misc_feature: SWISSPROT Homolog: EC 3.5.99.2 Thiaminase
MLVLRRLRLPLPRPLLVSSSTWWSSTSQRRPAMASSSSAAVVAEGSAARRFWIAASTREAAFAAYTPFLLSLAAGNLRLDAFRHYIAQDAHFLHAFARAYEMAEDCADDDDDRATIAALRKAILQELSLHASVLEEWGVDPTKEIPPSAATAKYTEFLLATAAGKVDGAKSSDKMVTPF

SEQ ID NO: 49277 - DNA, 695 bp, Panicum virgatum
  misc_feature: Ceres CLONE 2048726
  misc_feature: Encodes the peptide sequence at SEQ ID NO. 49278
gtgcagcggcaatccggctccagcagtaggccggagccagccgttccggtgccgcccaggtcctggggattgggtgtagggatcggggaccggaatggcgaagcggctcctcgccgccgtgctcctcgtcgcggctctcgcctgcggcggcgcccacgccaagttcaacaggcacagcttccccaagggcttcgtcttcggcaccggctccgcggcgtaccagtacgagggcgcctacaaggaaggaggcaaagggctcagtatatgggacaacttcactcacatcccaggaaaaatcatgaacaacgataatggcgacgtggcagaggacatgtaccatcgatacaaggaggatgtgcaactcctcaaggacatgaacttggacgccttccgcttctccatcgcctggaccaggatcctgccaaatggttccctgagtggaggagtgaacaaagaaggtgtggccttctacaacaacctcatcaacgaggtcctagccaaagggctgaggccatttgtcaccatcttccactgggacacgcccctggccctggaggagaagtacggaggcttcctcagtgaaaacatcatcaaggactacgtggacttcgccgacgtgtgcttccgcgagttcggcgaccgcgtcaaggactggacgacgttcaacgagccctggacgtacgcccagcgcgggt

SEQ ID NO: 49278 - protein, 200 aa, Panicum virgatum
  misc_feature: Ceres CLONE 2048726
  misc_feature (25)..(200): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 50295
  misc_feature: Useful for making plants with altered carbohydrate content
  misc_feature: Functional homolog of the protein sequence given in SEQ ID NO 50359
  misc_feature: Useful for making plants with altered cell wall content and/or composition
  misc_feature: Functional homolog of the protein sequence given in SEQ ID NO 50360
  misc_feature: Useful for making plants with modulated biomass
  misc_feature: Useful for making plants with modulated flowering time
MAKRLLAAVLLVAALACGGAHAKFNRHSFPKGFVFGTGSAAYQYEGAYKEGGKGLSIWDNFTHIPGKIMNNDNGDVAEDMYHRYKEDVQLLKDMNLDAFRFSIAWTRILPNGSLSGGVNKEGVAFYNNLINEVLAKGLRPFVTIFHWDTPLALEEKYGGFLSENIIKDYVDFADVCFREFGDRVKDWTTFNEPWTYAQRG

SEQ ID NO: 49279 - DNA, 627 bp, Panicum virgatum
  misc_feature: Ceres CLONE 2048749
  misc_feature: Encodes the peptide sequence at SEQ ID NO. 49280
agacaccccatccaaggcatcagccatggcgccgctctcggtgtccacctcccacctcctcgtcaccgcctccctcccaaagcccaagccttcctccctccgcccgccgcgcctccctctcgccaagcccctccccgcgacgctcctcgctcacgccgcggcgcccgcccttgccgctgatgtgccggagcctccccaggccccggcccccgcgcccgcgcccgagctccaggccgaggcccccaccccgaccgccaaccccttcgccaattccctcctcacggcccccaagccctccgcctccgccgacctccccgagggcgcgcagtggcgctacagcgagttcctctccgccgtcaagcgcggcaaggtcgagcgcgtccgcttctccaaggacggcgggctgctccagctcaccgccgtcgacggccgccgcgccaccgtcgtcgtccccaacgaccccgacctcatcgacctcatctccgtctccgagggcgaggccgccgggcccggggggttcctcgccttcgtcggcaacctcctattccccttcatcgccatcgcggggctcttcttccgctttccgccgcgcgcagggcgggccgggcgcgggccccggcgggcttc

SEQ ID NO: 49280 - protein, 200 aa, Panicum virgatum
  misc_feature: Ceres CLONE 2048749
  misc_feature (100)..(196): Pfam Name: FtsH_ext Pfam Description: FtsH Extracellular
MAPLSVSTSHLLVTASLPKPKPSSLRPPRLPLAKPLPATLLAHAAAPALAADVPEPPQAPAPAPAPELQAEAPTPTANPFANSLLTAPKPSASADLPEGAQWRYSEFLSAVKRGKVERVRFSKDGGLLQLTAVDGRRATVVVPNDPDLIDLISVSEGEAAGPGGFLAFVGNLLFPFIAIAGLFFRFPPRAGRAGRGPRRA

SEQ ID NO: 49281 - DNA, 730 bp, Panicum virgatum
  misc_feature: Ceres CLONE 2048760
  misc_feature: Encodes the peptide sequence at SEQ ID NO. 49282
cccatctcgaaggcgaccaagaaagaactccagcagcagcagctctgtagcgtcagactcccctccttttccccgcgtctcctctgagctccggcgaaagcccgccgccgccgccgtggccggacttccgatggcaactcctcggaagccgatcaagctcaccctgccgtcccacgagaccgccataggcaaattcctgacgcaaagcgggacgttcagggacggggatctgctcgtcaacaaggatggcctccgtatcgtttcgcagaacgagggaggcgaggtaagccacctggactgaggattaaaagttgcgtctttgcatcatccgtctgaaaatcttaggattggaatcgtcaaattggctattgtaatgaggtttctcttgatgatgagataaacatagtaagcaattgatgtgattgcttttggcaggtagagatagtcagataggaatcacattttagtaaattgtcgttgagctctgtttgttcgtggaatcgcacgcctatctccgagaatcagcgtcttgctcggtgataattccatctcgtttcttatatttcttcacggtaacataaggttgttggcaaacatgtagatattttgggcaaagttctgcaataatagcatttttacttccaaaagttctccaatagcactccatatattgttgtttctatcccctgattatctaataaagatattgattagggaaaacgatatgtag

SEQ ID NO: 49282 - protein, 56 aa, Panicum virgatum
  misc_feature: Ceres CLONE 2048760
  misc_feature: SWISSPROT Homolog: EC 2.7.12.2 Mitogen-activated protein kinase kinase
MATPRKPIKLTLPSHETAIGKFLTQSGTFRDGDLLVNKDGLRIVSQNEGGEVSHLD

SEQ ID NO: 49283 - DNA, 692 bp, Panicum virgatum
  misc_feature: Ceres CLONE 2048766
  misc_feature: Encodes the peptide sequence at SEQ ID NO. 49284
aagcacctaactccgatcctcacaaattcaaacaagtttaaccgagaggtgtgtttgccattttatagcaaaagtagcagcaccgcagttgttgttcatggctgccatggcggcccccatcctctgcatggcccttgtcatcgccctcgccgccacggtggctcccgtcggcgaggcggcggtcgtcaagcacagctttgttgtgcacgagatgaacgtgacgcacctttgcaacacgaccaagatctacgtggtgaacgggcagttcccgggcccgacgctcgacgtcaccgacggcgacacggtggtcgtccgcgtcgtcaaccggctggaccacggcctgaccatccactggcacggcgtgcggcagctccggagctgctgggccgacggcgccggcttcgtcaccgagtgccccatccctcccggcggcaaccacacctaccgcttcaacctcactggccaggtcggcacgctctggtggcacgcccacgtcacctgcctccgcgccaccatcaacggcgccatcgtcgtgcgccccaaggacggccggtacccgttcccgacccccgccggggacgtgcccgtgctcatcggcgagtggtggcagctcgacctcgtcgagctcgaccgccggatggccgacggcaacttcgacgacaacccgctgtcggccaccatcaacggcaagc

SEQ ID NO: 49284 - protein, 195 aa, Panicum virgatum
  misc_feature: Ceres CLONE 2048766
  misc_feature (32)..(148): Pfam Name: Cu-oxidase_3 Pfam Description: Multicopper oxidase
  misc_feature: SWISSPROT Homolog: EC 1.10.3.2 Laccase
  misc_feature: Functional homolog of the protein sequence given in SEQ ID NO 50535
  misc_feature: Useful for making plants with altered carbohydrate content
  misc_feature: Functional homolog of the protein sequence given in SEQ ID NO 51188
  misc_feature: Useful for making plants with altered cell wall content and/or composition
MAAPILCMALVIALAATVAPVGEAAVVKHSFVVHEMNVTHLCNTTKIYVVNGQFPGPTLDVTDGDTVVVRVVNRLDHGLTIHWHGVRQLRSCWADGAGFVTECPIPPGGNHTYRFNLTGQVGTLWWHAHVTCLRATINGAIVVRPKDGRYPFPTPAGDVPVLIGEWWQLDLVELDRRMADGNFDDNPLSATINGK

SEQ ID NO: 49285 - DNA, 668 bp, Panicum virgatum
  misc_feature: Ceres CLONE 2048787
  misc_feature: Encodes the peptide sequence at SEQ ID NO. 49286
aacgcccagaaaaaaatcgaaacgagagcgaaaatagttagcaataataattacagaaaagcacctacactctctcccctctctctgccctccgccttcgtcttcctgctgccctcatcctccaattccctccccacccaaaccctagagcaagctgaatggcccccgcctggagctcgcgagggactccgcgccgccgccggtgactgctgatccgcccgcccccaccgcggccgccggcgcccaggcccgtgccacggaggaggcgaccagatggcgtcgaggcagcacaatgcgcagttccacaaatccaagacgctcgacaacaaatacatgcttggagatgagatagggaagggagcgtacggccgagtgtacaagggacttgacctggagaatggcgacttcgtggccatcaagcaggtctcgctggagaacatcccgcaggaggatctcaacataataatgcaagaaattgatctactgaaaaatctcaatcacaaaaacattgttaagtatcttggatcactgaagacaaagagccacctccatattattctagagtatgtggagaatggctcacttgccaatattatcaagccaaacaaatttggaccttttcctgaatcattggtggctgtctacattgcccaggtgttggaaggtct

SEQ ID NO: 49286 - protein, 131 aa, Panicum virgatum
  misc_feature: Ceres CLONE 2048787
  misc_feature: SWISSPROT Homolog: EC 2.7.11.1 Non-specific serine/threonine protein kinase
MASRQHNAQFHKSKTLDNKYMLGDEIGKGAYGRVYKGLDLENGDFVAIKQVSLENIPQEDLNIIMQEIDLLKNLNHKNIVKYLGSLKTKSHLHIILEYVENGSLANIIKPNKFGPFPESLVAVYIAQVLEG

SEQ ID NO: 49287 - DNA, 670 bp, Panicum virgatum
  misc_feature: Ceres CLONE 2048794
  misc_feature: Encodes the peptide sequence at SEQ ID NO. 49288
atccagctcattcatagttccagttcaaacacccactaccaagcccaagcaaaaccaagcagattggaaaggctgccggacagcagaggtgacaattgatatgttccttatgtgtcactcgatgttgctggcaaaacttgccctgcttatcgtattgccttttttgctgctctgttatggagttggcaacgcccactgctcgactgttcatgacaacagaaacgatcggcgctcactgctcgacttcaagcagaggatcagcgacccatctggagtcttgaactggacaaccagcacccatttctgccagtggaacggtgttgtctgcagttccacgccaccatatcgcgtcaccgaactgaacctccccggcaaaaacttagatggcaatatttcttccgctcttggaaatctgacctcccttcgcacgatcgatctatctgataatagattccgtggccccatacctattcttggcaaactccagcacctgaacaccctttctctgggaggcaaccttttgcagggtgttattcctgaagcactcacaaactgttccaacctagccgttctgaatctctctttgaacacctcaacggtgtcattcctcataaaatacggtctcttagcaatctagagactatcatccttgatggtaattatctgactg

SEQ ID NO: 49288 - protein, 178 aa, Panicum virgatum
  misc_feature: Ceres CLONE 2048794
  misc_feature (39)..(77): Pfam Name: LRRNT_2 Pfam Description: Leucine rich repeat N-terminal domain
  misc_feature: SWISSPROT Homolog: EC 2.7.11.1 Non-specific serine/threonine protein kinase
MFLMCHSMLLAKLALLIVLPFLLLCYGVGNAHCSTVHDNRNDRRSLLDFKQRISDPSGVLNWTTSTHFCQWNGVVCSSTPPYRVTELNLPGKNLDGNISSALGNLTSLRTIDLSDNRFRGPIPILGKLQHLNTLSLGGNLLQGVIPEALTNCSNLAVLNLSLNTSTVSFLIKYGLLAI

SEQ ID NO: 49289 - DNA, 625 bp, Panicum virgatum
  misc_feature: Ceres CLONE 2048857
  misc_feature: Encodes the peptide sequence at SEQ ID NO. 49290
ttggaaggttgcaatttcttaaccgcggcggtttccactcctgccaatagtttagcacactctttgttgctactatggggcccggaagcacagggggattttactcgttggtgtcaattaggtggtctgtggacttttgtcgctctccatggggcttttgcactaataggtttcatgttacgtcaatttgaacttgctcggtctgttcaattgcggccttataatgcaatttcattctctggtccaatcgcagtttttgtttccgtattccttatttatccactgggacaatctggttggttctttgcgccgagttttggcgtagcagctatatttcgatttatccttttcttccaaggatttcataattggacgttgaacccatttcatatgatgggagttgccggagtattaggcgcagctttgctatgcgctatccatggggctaccgtagaaaacactctattcgaagatggtgatggtgcaaataccttccgcgcttttaacccaactcaagctgaagaaacgtattcaatggtcactgctaaccgcttttggtcccaaatctttggtgttgctttttccaataaacgttggttacatttctttatgctatttgtacccg

SEQ ID NO: 49290 - protein, 208 aa, Panicum virgatum
  misc_feature: Ceres CLONE 2048857
  misc_feature (1)..(208): Pfam Name: Photo_RC Pfam Description: Photosynthetic reaction centre protein
LEGCNFLTAAVSTPANSLAHSLLLLWGPEAQGDFTRWCQLGGLWTFVALHGAFALIGFMLRQFELARSVQLRPYNAISFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRWLHFFMLFVP

SEQ ID NO: 49291 - DNA, 716 bp, Panicum virgatum
  misc_feature: Ceres CLONE 2048864
  misc_feature: Encodes the peptide sequence at SEQ ID NO. 49292
aaccatactcaagcagctcaaaaccgctagccagctaccaagaaatggctcttcttgcttctgccctgacgagtcacagtgcacatcctggcctaagaagccccataggacccaatggtggcaatttgtcatggcacctgtcttcatcaaagaagagtaaaagaaggtgtgaccttagatcacgagcagaaacgatgagcagcgagcttgcacaagagcatctgatgccctgggaaatcccaaggaaggagtggttcccccacgggttcatctttggcgccgccacttcagcgtaccaaattgaaggtgcttggaatgagcatggcaaggggccaagcatatgggaccacttctgccataatcatcctgagaggatagctgattggagcaatggggatgttgcagtgaactcctaccatctgtatgaagaggatgtcaagttgctgaaggaaatgggcatggacgcctataggttctccatctcttggtccagaatactgccaaaggggacgctggaaggtgggataaactataaaggcctgcagtactacgaaaacctgatcaacacgttgaaagagaatggggaaaacattgtttgactataagagctaacgattttttttcttgattctttcaataacttattgaggaagaatggtattaatacaactctcaaaagttaatgcaactcaatagttatctgttgcaactcaggg

SEQ ID NO: 49292 - protein, 184 aa, Panicum virgatum
  misc_feature: Ceres CLONE 2048864
  misc_feature (67)..(184): Pfam Name: Glyco_hydro_1 Pfam Description: Glycosyl hydrolase family 1
  misc_feature: SWISSPROT Homolog: EC 3.2.1.21 Beta-glucosidase
  misc_feature: Functional homolog of the protein sequence given in SEQ ID NO 51342
  misc_feature: Useful for making plants with altered cell wall content and/or composition
MALLASALTSHSAHPGLRSPIGPNGGNLSWHLSSSKKSKRRCDLRSRAETMSSELAQEHLMPWEIPRKEWFPHGFIFGAATSAYQIEGAWNEHGKGPSIWDHFCHNHPERIADWSNGDVAVNSYHLYEEDVKLLKEMGMDAYRFSISWSRILPKGTLEGGINYKGLQYYENLINTLKENGENIV

SEQ ID NO: 49293 - DNA, 702 bp, Panicum virgatum
  misc_feature: Ceres CLONE 2048865
  misc_feature: Encodes the peptide sequence at SEQ ID NO. 49294
attcggcgccgccgcctcatcaaaccactcacgcaaaccccagtcagagagaggttggcggcggcggcggcgccatggactcaccctacgcgctccacctcgccgtcgcggccctcgtcggcgcctccttcgccgcggcctctgcctactacatgcaccgcaagaccctcgagcagctcctccgcttcgcccgcgaccaacgccgccgcacccgcctcccccccgatggaggagcccacgactacgacctggatgatgccgaagaggaccaagaccacaccccgacgcacagggatcacgatcgccgcaccatgcccatcccgccgggcctcccgccgctccacaccggccgagagggtaggccagtaatctctccaggttcaactaaaagagttggagctattgttagacccactacaccaaaatcccctgtccctgttgtcagtgcgtttgagagaattgaagattcagatgatgaggaggatcttgttccagatgccaagaatgatgctgcttacttgaccacaaatggcgctattgaatcagagctccttccagataaaacaagccagaacggggagttaaaatcagtaccatcaacacagatgattagatcccatagtgcaactggcagtctgcatgcgccccagcttacccaatagcagctgatatactccgaaaggagcctgagcatgaaacctt

SEQ ID NO: 49294 - protein, 195 aa, Panicum virgatum
  misc_feature: Ceres CLONE 2048865
  misc_feature: SWISSPROT Homolog: EC 3.5.4.6 AMP deaminase
MDSPYALHLAVAALVGASFAAASAYYMHRKTLEQLLRFARDQRRRTRLPPDGGAHDYDLDDAEEDQDHTPTHRDHDRRTMPIPPGLPPLHTGREGRPVISPGSTKRVGAIVRPTTPKSPVPVVSAFERIEDSDDEEDLVPDAKNDAAYLTTNGAIESELLPDKTSQNGELKSVPSTQMIRSHSATGSLHAPQLTQ

SEQ ID NO: 49295 - DNA, 690 bp, Panicum virgatum
  misc_feature: Ceres CLONE 2048875
  misc_feature: Encodes the peptide sequence at SEQ ID NO. 49296
actcactcaagttcttcctccgagcttcttcatccaccagcaatggagagtcaacgcagcggcagcggtagagaagaaaccctcaacggtagtcctcacctcaaagccccactcaacacgctccatgtcgaccgctgcacccccgcgcaccgcgtgcacgcgctcctctacgccggcgccatcctcggcctggtgtgccaccggctgacctccattctagcctcctcctcgctcgccgagggatggatgctgctggcagagctcgtcctggccttcatgtggggctgctcgcgggcgttcaagtggcggccggtgcgtcgccgcgagttccccgacagactgccggagggtggcgcctggccgaagctcgacgtgttcgtgtgcacggctgatccgaggaaggagcccccggtcggggttgtgagcacagccctctcgaccatggccttcgagtaccccgcgggcaagctgtcggtgtatgtttccgacgacggcggcgcggatgtgacgctgttcgcgttcatggagggcgccaggttcgcgcggcactggctgccgttttgcagggagaatggcgtgcaggtgcggtcgccggaggtgttctttgcttcttcttcttcttcttctggatgttctgccggtggcggcgatgcggataagctgaaggtgatgtaccaaaacatggtacag

SEQ ID NO: 49296 - protein, 215 aa, Panicum virgatum
  misc_feature: Ceres CLONE 2048875
  misc_feature: SWISSPROT Homolog: EC 2.4.1.12 Cellulose synthase (UDP-forming)
MESQRSGSGREETLNGSPHLKAPLNTLHVDRCTPAHRVHALLYAGAILGLVCHRLTSILASSSLAEGWMLLAELVLAFMWGCSRAFKWRPVRRREFPDRLPEGGAWPKLDVFVCTADPRKEPPVGVVSTALSTMAFEYPAGKLSVYVSDDGGADVTLFAFMEGARFARHWLPFCRENGVQVRSPEVFFASSSSSSGCSAGGGDADKLKVMYQNMV

SEQ ID NO: 49297 - DNA, 681 bp, Panicum virgatum
  misc_feature: Ceres CLONE 2048877
  misc_feature: Encodes the peptide sequence at SEQ ID NO. 49298
gtccggcatcgaatccaacaaggtgagatagagagattgagatctcctccccccacccccacccccacccccaccccgaccgagtagaccctcacccccgcccgatccgatccctgcaggttcccgcccgccctggatctgacgcgcctccccttcccacccccagccctcgcggccgccgccgtactcgggctcctcgccggcctcctactctatatgcttccccggaagcggggggtcgacgccggcgaggtccaggacttgcacaacaaggccccccgacccgccgcccccgcacccgcccaggacgaccccatggccgccagggcgcccgagatcgatgaggacctccacagccgccagctcgccgtctacggacgcgagaccatgaagcgactcttcggctccaacgtcctcgtctctggactacagggactcggcgctgagattgcaaagaaccttgtccttgcgggtgtcaagtccgtaaccttgcacgatgatggcaaagttgacctatgggacttatcaagcaacttcttcgtctccgagaaggatgttggtcaaaaccgtgctcaagcatgtgttccaaagcttcaagagcttaacaatgctgttatcatctctaccataactggtgatttgaccaaggagcagctttctaactttcaggctgtggttttt

SEQ ID NO: 49298 - protein, 121 aa, Panicum virgatum
  misc_feature: Ceres CLONE 2048877
  misc_feature (29)..(121): Pfam Name: ThiF Pfam Description: ThiF family
MAARAPEIDEDLHSRQLAVYGRETMKRLFGSNVLVSGLQGLGAEIAKNLVLAGVKSVTLHDDGKVDLWDLSSNFFVSEKDVGQNRAQACVPKLQELNNAVIISTITGDLTKEQLSNFQAVV

SEQ ID NO: 49299 - DNA, 542 bp, Panicum virgatum
  misc_feature: Ceres CLONE 2048880
  misc_feature: Encodes the peptide sequence at SEQ ID NO. 49300
tcgacagattgtggtctcctcgagttttttttttttttttttttccacgaacacaaactgagttccccttttattagaccatcaaaattacaaaagttgccacaaatatacaaggcagggcgcgaagaaggacatgtcgccgccgctggagtggtacggcgtccccgagggcacgcggtcgctggcgctggtggtgcaggacatcgacgcggaccccgtcgtgccgtggacgcactgggtggtggccaacatcccgcccgacaccaagggcctccccgaggggttctccggcaaggagggcgcggcggggcgcgagttcggcggcttgcaggagggcatcaacgactggaagcagcccgggtggcgcgggcccgtgccgccgtcccgcggccaccgcatccagttcaagctctacgcgctcgacgacgaggtgcacctcggcaacaaggtgaccaaggataagctcatggaggccatcgaggggcacgtgctgggagaggccgagctgaccgccgtcgccgtgttctaaggagccgtcgtca

SEQ ID NO: 49300 - protein, 131 aa, Panicum virgatum
  misc_feature: Ceres CLONE 2048880
  misc_feature (1)..(130): Pfam Name: PBP Pfam Description: Phosphatidylethanolamine-binding protein
MSPPLEWYGVPEGTRSLALVVQDIDADPVVPWTHWVVANIPPDTKGLPEGFSGKEGAAGREFGGLQEGINDWKQPGWRGPVPPSRGHRIQFKLYALDDEVHLGNKVTKDKLMEAIEGHVLGEAELTAVAVF

SEQ ID NO: 49301 - DNA, 691 bp, Panicum virgatum
  misc_feature: Ceres CLONE 2048893
  misc_feature: Encodes the peptide sequence at SEQ ID NO. 49302
aatttcccgaggactgaccacgcaacagtactcagtaggggcgtgaagtttcgatcgcaggagcagcgccctgaagctttgatctcacgaggagcacggtggcgtgtaggcagctgccgatgtcgccgacgacggccgtgtcgctgaccacgacgagccgcctgcccatctgccgggcgcatcaggacgcgtccagcaagcagcaggggctctgcaggaggagggtgctgcagtccgcggggctgggcctcgggctcggcctcgccgcggcgagaccggccgggcgggcgcgggccgagacggcggcgccgcccgcgccggcgccggaggacgcgacgtcgaaccggatgtcctactcgcggttcctggactacctcgacgccggcgcggtgcggaaggtggacctgttcgagaacggcacggtggccgtcctcgagctggacgaccccgcgctggcgtccaggacgcgccgcgtgcgggtgcagctcccgggcctccccgcggagctgctgcggaagctgcgggacaggggagtcgacctcgccgcgcaccccgtggagcccaaccccgggctcgtgttcctcgacctcctcctcaacttcggcttccggctcctcttcatcgccacgctgatttggaggtcggtcaccatgaacaaccccggcgccggccccagcctgccgttcgggct

SEQ ID NO: 49302 - protein, 190 aa, Panicum virgatum
  misc_feature: Ceres CLONE 2048893
  misc_feature (75)..(187): Pfam Name: FtsH_ext Pfam Description: FtsH Extracellular
MSPTTAVSLTTTSRLPICRAHQDASSKQQGLCRRRVLQSAGLGLGLGLAAARPAGRARAETAAPPAPAPEDATSNRMSYSRFLDYLDAGAVRKVDLFENGTVAVLELDDPALASRTRRVRVQLPGLPAELLRKLRDRGVDLAAHPVEPNPGLVFLDLLLNFGFRLLFIATLIWRSVTMNNPGAGPSLPFG

SEQ ID NO: 49303 - DNA, 658 bp, Panicum virgatum
  misc_feature: Ceres CLONE 2048925
  misc_feature: Encodes the peptide sequence at SEQ ID NO. 49304
gtgctcgccgcccaaatgccgccgcgggccgcctagggttccggcggccgccgtccccctcgctggcgcgatggggaacacctgcgtcggccccagcgcctcctcggaccgccacagcttcctcacctccgtctccctcgccgtgctctggcgccccgccgacgcccgcgccgagccctccccgacccccgaccccaccccctccactcctcccccaacctcctccaggccccccgaccccgtcaccatctccgactccgagcactcgccccgcaacccgaacggcaagcccaagcccaagcccaagcccaaggtgaagcgcgtgcagagcgccggcctcctcgtcggctccgtcctgaggcgggactccgagcggctcaaggacatctacaccctgggcaagaagctcgggcaggggcagttcggcaccacctaccagtgcgtcgagaaggcgacggggaagcagttcgcctgcaagtccatcgccaagcggaagctcatcaccgacgaggacgtcgaggatgtgcgccgcgagatacagatcatgcaccacctcgccggccaccccaacgtcatctccatcgtgggggcatacgaggacgcggtcgccgtgcacctcgtcatggagctctgcgcgggaggggagctgttcgacagg

SEQ ID NO: 49304 - protein, 195 aa, Panicum virgatum
  misc_feature: Ceres CLONE 2048925
  misc_feature: SWISSPROT Homolog: EC 2.7.11.1 Non-specific serine/threonine protein kinase
MGNTCVGPSASSDRHSFLTSVSLAVLWRPADARAEPSPTPDPTPSTPPPTSSRPPDPVTISDSEHSPRNPNGKPKPKPKPKVKRVQSAGLLVGSVLRRDSERLKDIYTLGKKLGQGQFGTTYQCVEKATGKQFACKSIAKRKLITDEDVEDVRREIQIMHHLAGHPNVISIVGAYEDAVAVHLVMELCAGGELFD

SEQ ID NO: 49305 - DNA, 578 bp, Panicum virgatum
  misc_feature: Ceres CLONE 2048938
  misc_feature: Encodes the peptide sequence at SEQ ID NO. 49306
ggaactagtagagcagggcagcgcaggcagccgtcggcggcggcccgggtgtgttcgggtggagcccggagccggccagtgggcggcgagggtagtcgcacgcggcggcgtccggacgtccgtggaggcgcgggagcgcgtaaggggtgcagctagcagcttccagaagcgaggtgacccccgaattccccattgtttgcccatgattccatgaatctcctttcacaaattggtagcgctgcagtggtttgaatcataatcgtgcccgatattccttcgaccctgatatttcaccgtcgttttttccttttttggattttgaaaggaaattccacgttcggtttgaccttcgacatcccccagttcccacccccaccgccggcgatggcggcgaaggtgcggttcggcctcctggtggcgatgttccaggccatgtcgggcgacaagaggtcggcgaagaagcgcacccgcctccgcgctttcctcgaccgggcctacgtctccagcggcggtagggacgactacttcagcgcgctgcgcctcgtccttccggggctcgaccgcgagcgcggcaccta

SEQ ID NO: 49306 - protein, 64 aa, Panicum virgatum
  misc_feature: Ceres CLONE 2048938
  misc_feature: SWISSPROT Homolog: EC 6.5.1.1 DNA ligase (ATP)
MAAKVRFGLLVAMFQAMSGDKRSAKKRTRLRAFLDRAYVSSGGRDDYFSALRLVLPGLDRERGT

SEQ ID NO: 49307 - DNA, 663 bp, Panicum virgatum
  misc_feature: Ceres CLONE 2048948
  misc_feature: Encodes the peptide sequence at SEQ ID NO. 49308
cgagatggatggcccatactagacctcaatgcacatcctcctgatgatgagcagcaagcagttggagaggccatacctgacctcaatgtgcaggctacttatgatgaccaccaaccagatggagaagccataccggacctcaatgtgcagcctgctaattttgatcagcaaccagatgtagatattgcctttgatgttattgatgaacaagatgattttgatctcaatttactagtccctgcccaacacgaagaaatgcaacagattgctgcggcctctgatggtgtgaaggcgtgggacatactgcaggaaaaatcattcaacatagaccttgttttaactgaagttgatttgcctttgatgtctggtttcctcctgttatccacaatcatggagcatgatgcgtccaagaacatccccgttataatgatgtcctcgcacgattcagtaagcatggttttcaaatgcatgctcaagggtgcagcagatttccttgtcaagccgataagaaagaatgagttaaggaacttatggcagcacgtttggagaaaacaactggcaaacggtgggcctgatgtgcagcatatacagaacgaagagaatcttgcagaaagaattgaacagaagattgctgtgacaaaagttgataatttgaacaaagat

SEQ ID NO: 49308 - protein, 220 aa, Panicum virgatum
  misc_feature: Ceres CLONE 2048948
  misc_feature (62)..(179): Pfam Name: Response_reg Pfam Description: Response regulator receiver domain
  misc_feature: SWISSPROT Homolog: EC 3.1.4.17 3',5'-cyclic-nucleotide phosphodiesterase
RDGWPILDLNAHPPDDEQQAVGEAIPDLNVQATYDDHQPDGEAIPDLNVQPANFDQQPDVDIAFDVIDEQDDFDLNLLVPAQHEEMQQIAAASDGVKAWDILQEKSFNIDLVLTEVDLPLMSGFLLLSTIMEHDASKNIPVIMMSSHDSVSMVFKCMLKGAADFLVKPIRKNELRNLWQHVWRKQLANGGPDVQHIQNEENLAERIEQKIAVTKVDNLNK

SEQ ID NO: 49309 - DNA, 703 bp, Panicum virgatum
  misc_feature: Ceres CLONE 2048949
  misc_feature: Encodes the peptide sequence at SEQ ID NO. 49310
gtgttgcgctgcgagcagctgctcctggtttcgcttcaggtctcttccaccaggaagaaaaattgcagtcgttctcttcagcaatattttgtaacttatataaatgagtgaccaacaagcaagtgaagttgaagacctcgagtgcgtatttgctgacgtgagcaaggacaccatccagatatcatatggagtattgaaatccatcacaaaaaatttcgctcaagtgattggtagtggtgcattcggcgttgtttacctgggagctcttaaaaatgggatggttgctgtgaagaagctttcccagtccacgcaggatctttctgacacacaatttttggaggaggttaaatgtcttaagagagtaaagcaccaaaatattgtaagatttctggggtattgtgcagaatcacatggggaagtgatggaaatagatggaaaacttaggattgttgaggtaccacaaaggttactctgctttgagtatgcaccgaatggaagccttcacgattatcttcaagagaaaccttatggatttgaatggaatattcgctatcaaatacttaagggaatttgtgcgggtttgcattatcttcatcaaggacgtatttatcatttggatctcaaacctggaaatgtgctgctgggtactcacatggagccaaaaattacagattttggtttgtcaaggtgcattgatgaaaat

SEQ ID NO: 49310 - protein, 199 aa, Panicum virgatum
  misc_feature: Ceres CLONE 2048949
  misc_feature (34)..(198): Pfam Name: Pkinase_Tyr Pfam Description: Protein tyrosine kinase
  misc_feature: SWISSPROT Homolog: EC 2.7.11.1 Non-specific serine/threonine protein kinase
MSDQQASEVEDLECVFADVSKDTIQISYGVLKSITKNFAQVIGSGAFGVVYLGALKNGMVAVKKLSQSTQDLSDTQFLEEVKCLKRVKHQNIVRFLGYCAESHGEVMEIDGKLRIVEVPQRLLCFEYAPNGSLHDYLQEKPYGFEWNIRYQILKGICAGLHYLHQGRIYHLDLKPGNVLLGTHMEPKITDFGLSRCIDE

SEQ ID NO: 49311 - DNA, 683 bp, Panicum virgatum
  misc_feature: Ceres CLONE 2048953
  misc_feature: Encodes the peptide sequence at SEQ ID NO. 49312
tattgggccataaagaggtttagggttcgttccccgagcgaacgcttcgcctcgtcgcctccttcctcccgccggcggacgtcatcggagcggcgacgaccccacgtggcgagcgcaaaccggacgacgcggcacgaaggggtgaggtgatgggcacggcgaacgaaggcggtggcgggagcaacggcaagtcggcctcagtgtggcgggcggaggaggccgtcgcgggcaaccgcggggcgctccaggccctccgggagctcgtgatgtatccgttcctctacgcccgcgagtcccgcaagctcggcctcaagtggccgagaggtttgctgctccacggcccccctggcaccgggaagacaagcctggttcgagctgttgttcgagaatgcaatgcgcaccagataatgatcaatacatattctgtacacaaagccaatgtgggggagggagaaaaattcctgcgtgaagccttttctgaagcatattctcaggcttcacggggtaaaccagctgtgatattcattgatgaacttgatgccatatgtccatgccgcaataataggagagagaatgaggcccgcattgttggtcagcttcttactctgatggatggaaacaagaaatcatcaaagatgcttcctcacatagttgttgttgggtcgactaacagggtgaacgct

SEQ ID NO: 49312 - protein, 177 aa, Panicum virgatum
  misc_feature: Ceres CLONE 2048953
  misc_feature (59)..(177): Pfam Name: AAA Pfam Description: ATPase family associated with various cellular activities (AAA)
  misc_feature: SWISSPROT Homolog: EC 3.6.4.3 Microtubule-severing ATPase
MGTANEGGGGSNGKSASVWRAEEAVAGNRGALQALRELVMYPFLYARESRKLGLKWPRGLLLHGPPGTGKTSLVRAVVRECNAHQIMINTYSVHKANVGEGEKFLREAFSEAYSQASRGKPAVIFIDELDAICPCRNNRRENEARIVGQLLTLMDGNKKSSKMLPHIVVVGSTNRVN

SEQ ID NO: 49313 - DNA, 603 bp, Panicum virgatum
  misc_feature: Ceres CLONE 2048967
  misc_feature: Encodes the peptide sequence at SEQ ID NO. 49314
ttgacggctgttaagtcctaaaatcagccatcaactcctgcagcttttcatgttcaataatcaccaaacttagttatagtacttatgactaatcgaatttcacgagttttggtgaattatcatttgcaggcacccacatctgtaaaatgaggaaaacaaaagtgaacacggaagaaatgcacagaatatcttacacctgtgtttcacttacaagaagggccctcaaactagaccaaatgggcacgacaagcaagatgcaaccaaggatcaagactatggcccacctatcagctgtccagaggaaggcaggcccaggggagtgccatttggggtcgctggcccccgccgaccccctcctcgtcgcgggctccatccagcacatgctcaacctcgccaacctcgccgaggagttgcagatcgccaaccgccgccggaacaagctcaagagcggggacttctccgacgagggctccgccaccaccgagtccaacatcgacgagaccatcaagcgcctcgtcgacctcggcaagtccaaggaggaggtgttcgaggcgctcaagaaccagtccgtctaccttcgtcctcaccgcgcaccccacgcag

SEQ ID NO: 49314 - protein, 152 aa, Panicum virgatum
  misc_feature: Ceres CLONE 2048967
  misc_feature: SWISSPROT Homolog: EC 4.1.1.31 Phosphoenolpyruvate carboxylase
MRKTKVNTEEMHRISYTCVSLTRRALKLDQMGTTSKMQPRIKTMAHLSAVQRKAGPGECHLGSLAPADPLLVAGSIQHMLNLANLAEELQIANRRRNKLKSGDFSDEGSATTESNIDETIKRLVDLGKSKEEVFEALKNQSVYLRPHRAPHA

SEQ ID NO: 49315 - DNA, 573 bp, Panicum virgatum
  misc_feature: Ceres CLONE 2048981
  misc_feature: Encodes the peptide sequence at SEQ ID NO. 49316
ttaatcagttactttcaggcggactacaggattttgatgttgacgatctgcggaacaacaccaagtatactggtggttatactgagtcaagtcgaactgttaaactcttctgggaggtcatcaaaggattgaagccaacagagcgttgtttgctcctaaagtttgtgacgagttgttcacgagctccattacttggattcaagtatctgcagccttctttcacaatacataaggttccatgtgatgtaacactttgggcttcaattggaggccaagacgtggaccgccttccatctgcttccacatgctacaatactctcaagcttccaacatacaagcggtcaagcaccctaaggagcaagctgctgtacgccatcagctcaaatactgggtttgaactctcttagaggtatatatgctatgaattggtggtgttgtaaccgtgtcaaggattgctgtgaatagaggtatagcaaaatttgattagatgcatcaagtgccgccaatgcatcatatttattcggaatgattgcccattttaaggtagcgcttatttctatttgtcggtacagc

SEQ ID NO: 49316 - protein, 134 aa, Panicum virgatum
  misc_feature: Ceres CLONE 2048981
  misc_feature (1)..(134): Pfam Name: HECT Pfam Description: HECT-domain (ubiquitin-transferase)
NQLLSGGLQDFDVDDLRNNTKYTGGYTESSRTVKLFWEVIKGLKPTERCLLLKFVTSCSRAPLLGFKYLQPSFTIHKVPCDVTLWASIGGQDVDRLPSASTCYNTLKLPTYKRSSTLRSKLLYAISSNTGFELS

SEQ ID NO: 49317 - DNA, 614 bp, Panicum virgatum
  misc_feature: Ceres CLONE 2048996
  misc_feature: Encodes the peptide sequence at SEQ ID NO. 49318
atccaactcaaagcaacctcacacgaccaccatccggcagtaccctgcgccgttccagcagagcagcggcggtggttacaagtgtctcaggtgtttcttccaagcaactggagaaactcgtcatgcttatactactcccattgctcctgctgtgttacggagttggaaacgtccattgcgttcacgaaaacagcacggatctgcactcactgcttgattttaagcagggcgtcacaagcgatccttatggagtcttgaactcttggaacacaaaatttcattactgtagatggaacggtgtcatgtgcacgctgaggccgccaaggcgtgtctcacggcttaacctcacaggccaaagtttagctggcaatatcacctcctctcttgcgaacctgacatttcttagtgtgctcgacttatcctttaatagcttctttggccagttaccttctcttaataatctccagcagttagaaaccctttatctaaatggcaactcactagaggggaatattcccgatggtctcacaaattgttccaaattaacgcttctagacctacatagcaaccaactatcgggtacaattcctcctaaagttggctctctttacaat

SEQ ID NO: 49318 - protein, 163 aa, Panicum virgatum
  misc_feature: Ceres CLONE 2048996
  misc_feature (23)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MLILLPLLLLCYGVGNVHCVHENSTDLHSLLDFKQGVTSDPYGVLNSWNTKFHYCRWNGVMCTLRPPRRVSRLNLTGQSLAGNITSSLANLTFLSVLDLSFNSFFGQLPSLNNLQQLETLYLNGNSLEGNIPDGLTNCSKLTLLDLHSNQLSGTIPPKVGSLY

SEQ ID NO: 49319 - DNA, 711 bp, Panicum virgatum
  misc_feature: Ceres CLONE 2049016
  misc_feature: Encodes the peptide sequence at SEQ ID NO. 49320
ccactgagatgaacccctcgcgccgcgccctcgagatcccgcaccgaatgccacgtcggcagctttggtctcctcggccgtacggcaccagggaaaatatttcttgagatggatgctggttgggagctgcgatgaatgcgggaggtcggtgaggtgcttgggggagtgggagcgcggcttcttgctccgttgctcgtgtgtgatttggaggagtagggaagaggaggatgatgggagctctgcaggtgcagagcaatggcggcgacggtggtggtgggggtctcttcgctgaggacccggggtacgtggaggttgatcccacggggaggtatggcaggtacaacgagattctcggcaagggatcctccaagaccgtgtaccgggccttcgacgagcagcggggcatggaggtggcgtggaaccgggtgcaggtgcacgacttccttcggagccccggcgagctggagcgcctctacggcgagatccacctgctccggtcgctccgccaccgcgccgtcatgcgcctccacgcgtcctgggtcgacgccccgcgccgcgccgtcaacttcgtcaccgagctcttcacctccggcacgctccgccagtaccggcggcgccaccgccgcgcgcgccccgccgccgtccgccgctggtgcggccagctcctcgacggcctcgcctacctccacgcccgcggcgtcatccaccgcg

SEQ ID NO: 49320 - protein, 161 aa, Panicum virgatum
  misc_feature: Ceres CLONE 2049016
  misc_feature: SWISSPROT Homolog: EC 2.7.11.1 Non-specific serine/threonine protein kinase
MMGALQVQSNGGDGGGGGLFAEDPGYVEVDPTGRYGRYNEILGKGSSKTVYRAFDEQRGMEVAWNRVQVHDFLRSPGELERLYGEIHLLRSLRHRAVMRLHASWVDAPRRAVNFVTELFTSGTLRQYRRRHRRARPAAVRRWCGQLLDGLAYLHARGVIHR

SEQ ID NO: 49321 - DNA, 656 bp, Panicum virgatum
  misc_feature: Ceres CLONE 2049039
  misc_feature: Encodes the peptide sequence at SEQ ID NO. 49322
aattctccgcacccccgcttctgctccgcccgccacggccgcgtctcgcctagttcgcctctcatcttcttctgctcctccgtcttccacctcccgcacgtatcggttcaagcggatctgacaacagtttattaataaccgattcgatatggatactggttgcctgtcatctatgaacattactggagctagtcaggcaagagcttttgcaggacatcttcctgctcagagatgcatctcgagtagtcagcatatgagatttgctgtgaaatctcttgtcttgaggaacaaaggaaaaagactacaccgcaagcttggtgctttacaggttgtctgccaggattttccaagacctccactagaaaacacgataaattatttggaagctggacagctatcttcatttttccggagcagtgaacgccccagtaaaccattacaggtcgtgattgctggtgcaggtttggctggtctatcaacagcaaagtatcttgcagatgccggccataaaccaatattgcttgaggcaagggatgttttgggtggaaagatagctgcatggaaggacaaagatggagattggtacgagacgggccttcatattttttttggagcttatcccaacatacagaatttgtttggagagcttggtattg

SEQ ID NO: 49322 - protein, 169 aa, Panicum virgatum
  misc_feature: Ceres CLONE 2049039
  misc_feature: SWISSPROT Homolog: EC 1.14.99.30 Carotene 7,8-desaturase
MDTGCLSSMNITGASQARAFAGHLPAQRCISSSQHMRFAVKSLVLRNKGKRLHRKLGALQVVCQDFPRPPLENTINYLEAGQLSSFFRSSERPSKPLQVVIAGAGLAGLSTAKYLADAGHKPILLEARDVLGGKIAAWKDKDGDWYETGLHIFFGAYPNIQNLFGELGI

SEQ ID NO: 49323 - DNA, 649 bp, Panicum virgatum
  misc_feature: Ceres CLONE 2049045
  misc_feature: Encodes the peptide sequence at SEQ ID NO. 49324
agttcagacaatagctaggccagttccttctagcccccgtcttctactaagttgtgccgtgggcaagcagctatgagctgctatcccttcaggatttccagggtggacttcaaaacaggatggttgctgtgaagaatcttttccattcgaaggatctttctgataagcaatttttggatgaagttatctgtctaaagaaggtaaaccaccataatattgtaagatttctaggctattgtgcagatacagaaggtgaaatcatggaaatagaaggaaaacataggatagttgaggtgcagaagagattgctctgctttgagtacgtgcctaatggaaaccttcatcattacattaaagagaaaactcatggatatgaatggaatgtgcgttataaaataattcagggaatctgccagggtttgcactatattcatcaagaacgcataaatcatttggatctcaaacctgctaatgtgctgctgggtgccaacatggagccaaaaatcacagattttggtgtgtcaaggtgcatcagtgaagagcagggcacgatggtcactaaaattttttttggaacactgggatacattgcgccagaattcattgataagcaacaaatatcattcaagtctgatatattcagtttggg

SEQ ID NO: 49324 - protein, 176 aa, Panicum virgatum
  misc_feature: Ceres CLONE 2049045
  misc_feature (2)..(176): Pfam Name: Pkinase Pfam Description: Protein kinase domain
  misc_feature: SWISSPROT Homolog: EC 2.7.11.1 Non-specific serine/threonine protein kinase
MVAVKNLFHSKDLSDKQFLDEVICLKKVNHHNIVRFLGYCADTEGEIMEIEGKHRIVEVQKRLLCFEYVPNGNLHHYIKEKTHGYEWNVRYKIIQGICQGLHYIHQERINHLDLKPANVLLGANMEPKITDFGVSRCISEEQGTMVTKIFFGTLGYIAPEFIDKQQISFKSDIFSL

SEQ ID NO: 49325 - DNA, 626 bp, Panicum virgatum
  misc_feature: Ceres CLONE 2049047
  misc_feature: Encodes the peptide sequence at SEQ ID NO. 49326
cttgttgcccgcctaccgccgccattctgcgctgcgcctccaccgctccacgctctcccgctgctctcaccaccgtctcgcgcgaagctgctgagctcaagctagagaagatgtatacggcaaggaggaagatccagaaggacaagggtgtggagccaactgagtttgaggacacagttgcccaggcgttctttgacctcgagaatgggaatcaggagcttaagagtgacttgaaggacctttacatcaatggagcagtgcagatggacgtgcctggcaacaggaaggctgttatcatccatgttccatacaggctacaaaagtcttacaagaagattcatgtgaggcttattcgggagcttgagaagaagttcagtgggaaggtccatacccctccacgtgagcaagtatcgatgacatggcgtgctgactgggcatctttatctttcatgcatctctccttcctctctccaccccttcctctctttctcccacccatcctctctccttgcgccgacggctcccaccctccctctctccctgcgctggcgccgctcgtcccgcgcccccgcaccagctcgccgctgtgctccgccttctccctcgccgccgctgcgctccgcctt

SEQ ID NO: 49326 - protein, 171 aa, Panicum virgatum
  misc_feature: Ceres CLONE 2049047
  misc_feature (6)..(139): Pfam Name: Ribosomal_S7e Pfam Description: Ribosomal protein S7e
MYTARRKIQKDKGVEPTEFEDTVAQAFFDLENGNQELKSDLKDLYINGAVQMDVPGNRKAVIIHVPYRLQKSYKKIHVRLIRELEKKFSGKVHTPPREQVSMTWRADWASLSFMHLSFLSPPLPLFLPPILSPCADGSHPPSLPALAPLVPRPRTSSPLCSAFSLAAAALR

SEQ ID NO: 49327 - DNA, 656 bp, Panicum virgatum
  misc_feature: Ceres CLONE 2049051
  misc_feature: Encodes the peptide sequence at SEQ ID NO. 49328
gaaaaaggccggcccgccgcgccgccgtcctccagcctcctcccatctccgagctgtaccgcaccccccccccccccctcccccctctatcgtttcccgacggccggacctctctgctcccgactgtccacctcccgccgcggcgccgtcggcaccgtctgtcaagccccgttgtctcgctcttatcatccgctgccgtagctaactctgggcagtgatacagaaaaaggagagaagatgtcgtcgaagaagaactactacaaggagaagatgatgcggcggaaagaggagaaaaaggaagaaccagagacacccaggtatcgcgaccgtgctaaggaacgtcgtgaagatcaaaacccagattatgagcctacagagcttggttcgtttcatgctgtggcacctcctgggacagatttgaggctggcagatgcgcacaagatttcaattgagaaaagcaaatatctaggaggtgatttggagcatacacatttggtcaaaggcttggactatgctctacttcacaaagtacggagtgaaattgaaaagaaacctgaagcagaggatgggaaggatgcaaaatcaaggtcaacaaaagaagatcaggcagtctccttccgcactgcaactgcaaagtctgtctaccaatggatcat

SEQ ID NO: 49328 - protein, 139 aa, Panicum virgatum
  misc_feature: Ceres CLONE 2049051
  misc_feature (5)..(139): Pfam Name: RED_N Pfam Description: RED-like protein N-terminal region
MSSKKNYYKEKMMRRKEEKKEEPETPRYRDRAKERREDQNPDYEPTELGSFHAVAPPGTDLRLADAHKISIEKSKYLGGDLEHTHLVKGLDYALLHKVRSEIEKKPEAEDGKDAKSRSTKEDQAVSFRTATAKSVYQWI

SEQ ID NO: 49329 - DNA, 701 bp, Panicum virgatum
  misc_feature: Ceres CLONE 2049053
  misc_feature: Encodes the peptide sequence at SEQ ID NO. 49330
acacaacaccaccagagagataacaaagccttcttcctacagcactcttgcaatccacagagctagctcagttcatccaagcacacagaagcatcagcaatgtcgctcgtcaggcgcggcaacgtgttcgaccccttctccatggacctctgggaccccttcgacagcatgttccgctccatcgtcccatcgtcctcctccgactccgacaccgccgccttcaccaacgcccgcatcgactggaaggagacccccgaggcgcacgtcttcaaggccgacttccccggcgtcaagaaggaggaggtcaaggtggaggtggaggacggcaatgtgctggtcatcagcggccagcgcagcaaggagaaggaggacaagaacgacaagtggcaccgcgtcgagcgcagcagcggccagttcatgaggcgcttccgcctgccggaggacgccaaggtggagcaggtgaaggccgggctggagaacggcgtgctcacggtcaccgtgcccaaggccgagggcaagaagccggaggtgaagagcatccagatctccggttaagcggccgtggagacggatggtgaggtgagcgtgtgcggcggaggggacaggggaggaccaccggttcgcgctactacagtctgtcgttgctctgctttggtgggtttggtgtgtactgttgttcagcctgccatggtagtgcctgc

SEQ ID NO: 49330 - protein, 151 aa, Panicum virgatum
  misc_feature: Ceres CLONE 2049053
  misc_feature (47)..(150): Pfam Name: HSP20 Pfam Description: Hsp20/alpha crystallin family
  misc_feature: Functional homolog of the protein sequence given in SEQ ID NO 51227
  misc_feature: Useful for making plants with modulated heat sensitivity
MSLVRRGNVFDPFSMDLWDPFDSMFRSIVPSSSSDSDTAAFTNARIDWKETPEAHVFKADFPGVKKEEVKVEVEDGNVLVISGQRSKEKEDKNDKWHRVERSSGQFMRRFRLPEDAKVEQVKAGLENGVLTVTVPKAEGKKPEVKSIQISG

SEQ ID NO: 49331 - DNA, 611 bp, Panicum virgatum
  misc_feature: Ceres CLONE 2049062
  misc_feature: Encodes the peptide sequence at SEQ ID NO. 49332
aacattctcgggtttgtggtgcgtgccaggtggagcaggcggaggacgcgggcgcccaggcggcggccgctgcggcggcggcgcggagggacgtcagcccggacaccgtggcgtccatcatcctcggcggcggcgccggcacgcgcctcttcccgctcacgcagaccagggccaagcccgcggtgcccgttggggggtgctacaggctgatcgatatcccgatgagcaactgcataaacagcaagataaacaagatctacgtcctcacccagttcaactcccagtccctcaaccgccacatcgcgcggacatacaactttggcgagggggttgggttcagtggtgggtccgtggaggtgctggcagctacccagacagctggggaatccggaaagaaatggttccagggaacagctgatgctgtcaggcagttcctctggctttttgaggatgcaaggctgaaatgtatagaaaacatactgattctgtctggtgatcacctctacaggatggattacatggactttgtgcagaagcatgtcgactctggtgctgacatttcagttgcttgtgttcctatggatgagagtcgagcttctgatttgggattg

SEQ ID NO: 49332 - protein, 202 aa, Panicum virgatum
  misc_feature: Ceres CLONE 2049062
  misc_feature (37)..(202): Pfam Name: NTP_transferase Pfam Description: Nucleotidyl transferase
  misc_feature: SWISSPROT Homolog: EC 2.7.7.27 Glucose-1-phosphate adenylyltransferase
  misc_feature: The sequence is a functional homolog of SEQ ID NO 37 in US patent 7312378
  misc_feature: The sequence is a functional homolog of SEQ ID NO 38 in US patent 7312378
  misc_feature: The sequence is a functional homolog of SEQ ID NO 39 in US patent 7312378
HSRVCGACQVEQAEDAGAQAAAAAAAARRDVSPDTVASIILGGGAGTRLFPLTQTRAKPAVPVGGCYRLIDIPMSNCINSKINKIYVLTQFNSQSLNRHIARTYNFGEGVGFSGGSVEVLAATQTAGESGKKWFQGTADAVRQFLWLFEDARLKCIENILILSGDHLYRMDYMDFVQKHVDSGADISVACVPMDESRASDLG

SEQ ID NO: 49333 - DNA, 666 bp, Panicum virgatum
  misc_feature: Ceres CLONE 2049067
  misc_feature: Encodes the peptide sequence at SEQ ID NO. 49334
acacgaaacgcaatcttgcaaaccagccccccgagacaaagcctaatcacaactcgatctcaccgaggaagaagggaagagagaagaatggcggccgaggagggtgccgtgatcgcgtgccacacccccgacgagttcaaatcccagatgaacaaggccaaggcggccaacaagctggtgatcattgacttcaccgcttcctggtgcggtccttgccgcttcattgctccagtcttcgctgaattagccaagaagttccctggcgctgtcttcctgaaggttgatgttgatgagctgaaggacgttgctgcgaaatacaatatcgaggcgatgccaaccttcctcttcatcaagggcgaagaaaaggtcgactctgttgttggagccaggaaggacgagctcgcggccaaggttgagaagcaccatggccctgtcgccaccgcatccgcctgagaggacagcaaagggttacctccaaataagagccagtgtctagtggttgttcggttggttattaggatgtcgttgaacttgggcggattgaggtctagagtttgtatatgcctctggcatttgtcctaaataccttgtaccgctgtagatgcttgtaattgtgatgtttgcgcctgagtgtttgtgacaatgaaatacttgatgctggcactc

SEQ ID NO: 49334 - protein, 121 aa, Panicum virgatum
  misc_feature: Ceres CLONE 2049067
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature: Functional homolog of the protein sequence given in SEQ ID NO 50138
  misc_feature: Useful for making plants with modulated nitrogen use efficiency
MAAEEGAVIACHTPDEFKSQMNKAKAANKLVIIDFTASWCGPCRFIAPVFAELAKKFPGAVFLKVDVDELKDVAAKYNIEAMPTFLFIKGEEKVDSVVGARKDELAAKVEKHHGPVATASA

SEQ ID NO: 49335 - DNA, 663 bp, Panicum virgatum
  misc_feature: Ceres CLONE 2049086
  misc_feature: Encodes the peptide sequence at SEQ ID NO. 49336
agcgcctcttccctccccagcgttccgcctaaacaaacgccttcgggcctaggccttgcccactcgccccggttcacgctacgccgccttgcatctctcttcctccccaacctcgccgtagtccgcccggttctgaatgcagcagcgcggccgctcctacaaccgccgcgaccggagcttctcccgatcccgcctcgccgtcgaggggtattaacctcacaacgcccccgcgccacactaatctgaacttgattccgacgaacgatcgcgcgggctcgcccttgatggacgccgccgccgccgctgctgcgaatggtactggctttactcccttcatatgaagggaaatctgtgctggaactgggagctggaataggtcgctttacaggtgaactggctaaaacagctgggcatgttcttgcactggatttcattgaaagtgtgattaagaagaatgaaagcataaatggtcactacaagaacacatcctttatgtgtgctgatgttacatgcccagacctcatgatcgaagcgaactccattgatctgatattttcaaactggttgctgatgtatatttcagacgaggaggtaattagggagccatacattagaattcgaggttcatagttaaaaaaaaggaacaaaaactccactgcattt

SEQ ID NO: 49336 - protein, 105 aa, Panicum virgatum
  misc_feature: Ceres CLONE 2049086
  misc_feature (15)..(102): Pfam Name: Methyltransf_11 Pfam Description: Methyltransferase domain
  misc_feature: SWISSPROT Homolog: EC 2.1.1.103 Phosphoethanolamine N-methyltransferase
  misc_feature: The sequence is a functional homolog of SEQ ID NO 40 in US patent 7151202
MVLALLPSYEGKSVLELGAGIGRFTGELAKTAGHVLALDFIESVIKKNESINGHYKNTSFMCADVTCPDLMIEANSIDLIFSNWLLMYISDEEVIREPYIRIRGS

SEQ ID NO: 49337 - DNA, 317 bp, Panicum virgatum
  misc_feature: Ceres CLONE 2049118
  misc_feature: Encodes the peptide sequence at SEQ ID NO. 49338
atatatagttcgttgatagaattcaaacttcttgatgcaagccgtccatccaagcaccttgcagcgacagtagtgcgattattatgctactaggaaattgaacgccaaatccaagtcctgcccgttctgccgcgcctgcctggaggaggtgaagccgggcagcctgtggatgtacaccgacgacagcgacgttgtggatatggataccttgacaagggagaacattaggcggctcttcatgtacataaataagctgccccttgtagtcctacatgtagttgacctcgacatttaccagtaccgtatcaagtaaattt

SEQ ID NO: 49338 - protein, 47 aa, Panicum virgatum
  misc_feature: Ceres CLONE 2049118
  misc_feature: Functional homolog of the protein sequence given in SEQ ID NO 50356
  misc_feature: Useful for making plants with altered lignin content
MYTDDSDVVDMDTLTRENIRRLFMYINKLPLVVLHVVDLDIYQYRIK

SEQ ID NO: 49339 - DNA, 693 bp, Panicum virgatum
  misc_feature: Ceres CLONE 2049121
  misc_feature: Encodes the peptide sequence at SEQ ID NO. 49340
aaaccaatcagcacttcagcaccctgctgccgctcttctctattcatcacctgaatctcgtgtttctgggtggtcaaaggtaggtagtttggcagatttggggcttcgagctatttccccacgcttcccgaatcgtctggtgatgtgcacatgctctgttactgccctcaacacgctgtttaccagcatgaattcaccagggcagctacagggctggaaggcaagcggcggtgacccctgcaacgaatcatggaagggaatcacctgctctggatcctcagtcactgcgattaaattaccgggattggggctctctggaactctggcctacaacatgaacaccatggattcactagtggagctagatatgagccaaaataatcttggtgctggtcaacagattccatacaatcttccaaataagaagcttgaaagactcaatctggcaggaaaccagttctctggaggtataccatactcaatttcgacaatgcctaaacttcaatacctaaatcttaatcataaccaactatcaggagatatcactgacatattttccaacctcccaagtttaaccacagtagacctttcctccaattctcttactggtaatctaccgcaaagtttcagttctttgccaagcctgaaaacactgtatttgcagaacaatcaacttactggctcaatcaatgt

SEQ ID NO: 49340 - protein, 230 aa, Panicum virgatum
  misc_feature: Ceres CLONE 2049121
  misc_feature (49)..(90): Pfam Name: LRRNT_2 Pfam Description: Leucine rich repeat N-terminal domain
  misc_feature: SWISSPROT Homolog: EC 2.7.11.1 Non-specific serine/threonine protein kinase
NQSALQHPAAALLYSSPESRVSGWSKVGSLADLGLRAISPRFPNRLVMCTCSVTALNTLFTSMNSPGQLQGWKASGGDPCNESWKGITCSGSSVTAIKLPGLGLSGTLAYNMNTMDSLVELDMSQNNLGAGQQIPYNLPNKKLERLNLAGNQFSGGIPYSISTMPKLQYLNLNHNQLSGDITDIFSNLPSLTTVDLSSNSLTGNLPQSFSSLPSLKTLYLQNNQLTGSIN

SEQ ID NO: 49341 - DNA, 661 bp, Panicum virgatum
  misc_feature: Ceres CLONE 2049126
  misc_feature: Encodes the peptide sequence at SEQ ID NO. 49342
gactgacccacttgaaagttgaaaccatgtgcaaccgctgccatggcatcgcctacgcagtcgctggactgctcatcgccttcaccccgctcgccgccggcgtgccgtggggtttatgcagcaacaccaccggcaactacacgggcaacagcacttacagtgccaacctgcgacgggctgccgcggctctgcccagcaacgtatcgacgtcccctgccctcttcgccaacttcacaaccggcacggcgccgaacacggtgcacgccgtcgggcaatgcaacggcggccaggacgccacggcctgccgcagctgcatcgcagccagcttcgagaacgcgcagctcctgtgcccccacaacaggggtgttgccatcttctacgacgtctgcctcatcggcttctccgaccaagacttcctcgccacccacgccaacttggaggaccaggagatccatctgtcaaaccctgggagtgttccttccgacgtcgcaggcaggttcgacgcgtccgcctacgagctcctcaacgccatggccgactaccttgccaccacaaactcgaccatcaagttcgtgactggagccatcggctttgacgcaacctaccccaatgtcttcgccacggcgtcgtgcacacccgacctgacgccagcgcagtgccg

SEQ ID NO: 49342 - protein, 211 aa, Panicum virgatum
  misc_feature: Ceres CLONE 2049126
  misc_feature: Functional homolog of the protein sequence given in SEQ ID NO 50654
  misc_feature: Useful for making plants with altered carbohydrate content
MCNRCHGIAYAVAGLLIAFTPLAAGVPWGLCSNTTGNYTGNSTYSANLRRAAAALPSNVSTSPALFANFTTGTAPNTVHAVGQCNGGQDATACRSCIAASFENAQLLCPHNRGVAIFYDVCLIGFSDQDFLATHANLEDQEIHLSNPGSVPSDVAGRFDASAYELLNAMADYLATTNSTIKFVTGAIGFDATYPNVFATASCTPDLTPAQC

SEQ ID NO: 49343 - DNA, 630 bp, Panicum virgatum
  misc_feature: Ceres CLONE 2049151
  misc_feature: Encodes the peptide sequence at SEQ ID NO. 49344
cacgtcaacatggacgaatttccaggcctcctggacaaaatatcgaaatgaagcgaggtgactggatttgcacaagatgcagcttcatgaactttgcaagaaatgctaggtgccttgagtgcaatgagttgcggccaaagaagttgctaactggcggggagtgggaatgccctcagtgtgatttctgcaattatggaaggaatatgtcgtgcgtaaaatgtgattgcaaaagaccagcaacaatcccacaaaatccttcatctgctggtgctggtttaggtggcgtggcacagcttcttaatgtaaccaatgttggtaaatctgaaattgagagaaaacttgctgaaaatgatgaaaaggctgaaagatggttgagcaaagtgtctcaactcaatgattctgctgatttaagtagtctagctgaagatgaggattttcctgagattatgcctatgcgcaagggggtgaataaatatgtggttagcacccgcaaaacaccactcgagagaaggttggcaaatgcacagtacagtaacaatggccctcaagctgcatcatctgactcaaagatcagtcaaactttggacaggatacttgggcgttcaaattctactgcagcctcaaacaatc

SEQ ID NO: 49344 - protein, 209 aa, Panicum virgatum
  misc_feature: Ceres CLONE 2049151
  misc_feature (17)..(46): Pfam Name: zf-RanBP Pfam Description: Zn-finger in Ran binding protein and others
RQHGRISRPPGQNIEMKRGDWICTRCSFMNFARNARCLECNELRPKKLLTGGEWECPQCDFCNYGRNMSCVKCDCKRPATIPQNPSSAGAGLGGVAQLLNVTNVGKSEIERKLAENDEKAERWLSKVSQLNDSADLSSLAEDEDFPEIMPMRKGVNKYVVSTRKTPLERRLANAQYSNNGPQAASSDSKISQTLDRILGRSNSTAASNN

SEQ ID NO: 49345 - DNA, 603 bp, Panicum virgatum
  misc_feature: Ceres CLONE 2049155
  misc_feature: Encodes the peptide sequence at SEQ ID NO. 49346
agagaccattgctgtagccctgtaggggagggcctgagggagagggagagaggcgaggcggtgcagctatggcgagagcggcctgggccgcatggttgctcgtcctcctgtgctgcggcgcttggaccccgcggcgaatcttggtctccgcggccaccgacgcgaatcatggcagggaatcacctgctctggatcctcagtcactgcgattaaactgccaggattggggctctctggaactctggcctacaacctgaacaccatggattcactagtggagctagatatgagccaaaatagtctcggtggtggtcaacagattccgtacaatcttccaaataagaagcttgaaagactcaatctggcagggaaccagttctctggaggtataccatactcaatttcgacaatgcctaaacttcaatacctaaaccttaatcataaccaactatcaggagatatcactgacatattttccaacctcccaagtttgaccacagtagacctttcctccaattctcttactggtaatctgccgcaaagtttcagttctttgccaagcctgaaaacactgtatttgcagaacaatcaacttactggctc

SEQ ID NO: 49346 - protein, 170 aa, Panicum virgatum
  misc_feature: Ceres CLONE 2049155
  misc_feature: SWISSPROT Homolog: EC 2.7.11.1 Non-specific serine/threonine protein kinase
MVARPPVLRRLDPAANLGLRGHRRESWQGITCSGSSVTAIKLPGLGLSGTLAYNLNTMDSLVELDMSQNSLGGGQQIPYNLPNKKLERLNLAGNQFSGGIPYSISTMPKLQYLNLNHNQLSGDITDIFSNLPSLTTVDLSSNSLTGNLPQSFSSLPSLKTLYLQNNQLTG

SEQ ID NO: 49347 - DNA, 694 bp, Panicum virgatum
  misc_feature: Ceres CLONE 2049179
  misc_feature: Encodes the peptide sequence at SEQ ID NO. 49348
agttgccgcctcgctccgccgccgcttccgccccagcccccaggtgacttccaccgctcccgcgccgccccgaccgccgaggaagcgcccccctcccgatccggctcgcggcgcgcggccccgcccgcccgcccggatctgacgaggtcgctcgctgccgcgggcggtcgctccggccgcttgggtagggctcgcggccgcgcgcggggaggtgcggagccttcgtcaggggtccgggatggcggcgccaccggcgagggcccgggccgactacgactacctcatcaagctgctactcatcggcgacagcggtgttgggaaaagttgtctccttttacggttctcagatggctccttcaccactagctttatcaccaccattgggatcgacttcaaaataagaacaattgaacttgatggtaagcgcataaagttgcagatctgggatactgctggccaagaacgtttccggactattacaactgcctactacaggggagcaatgggcattttgctcgtctatgatgttactgacgagtcgtcgttcaacaatataagaaattggattaggaatattgagcaacatgcttccgacaatgtgaataaaattttgataggcaacaaagccgacatggatgaaagcaaacgggctgtaccaacatctgaagggcaggctcttgctgacgagtacggc

SEQ ID NO: 49348 - protein, 151 aa, Panicum virgatum; identical to SEQ ID NO: 43689
  misc_feature: Ceres CLONE 2049179
  misc_feature (17)..(151): Pfam Name: Ras Pfam Description: Ras family
  misc_feature (17)..(131): Pfam Name: Miro Pfam Description: Miro-like protein
  misc_feature: SWISSPROT Homolog: EC 2.7.11.1 Non-specific serine/threonine protein kinase
  misc_feature: Functional homolog of the protein sequence given in SEQ ID NO 51218
  misc_feature: Useful for making plants with altered lignin content
  misc_feature: Functional homolog of the protein sequence given in SEQ ID NO 50522
  misc_feature: Useful for making plants with modulated oxidative stress sensitivity
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50163
  misc_feature: Useful for making plants with altered alkaloid content

SEQ ID NO: 49349 - DNA, 753 bp, Panicum virgatum
  misc_feature: Ceres CLONE 2049185
  misc_feature: Encodes the peptide sequence at SEQ ID NO. 49350
acccgcaccgcaagcagcacatcatcatcctctcctgctcgctctcgccgcccacgcctcactcgaaccgcgtcgcgtcccaaaccctagcgcagccgcggggggaggcgcgccgctccaatccaaccccaatagcttcggccccgattctcctgccacccccctctcaaaccccggcctcccttctccgcctccgccgtcctctgtaatttttcgaattctgtattgggaatatttgcttttttggttgtttgtttcaggagcgcgtgtcctcggaggattcgcggcggctggtgcgtggaatcgatttttcgcattcgcgcgttttgcgatgttttggtaggttttgttggaggctcggtttcgatctgatggttgcgtgtttctagggctagggttttggcgcctcggtcaagggtggtgcgtcatctgctccgtgggatctcccggcatcaggattgctgtcagtcaccatgtcatcatatcctgtgctaaacaaccgaccaatcgatcagtggagagttactgatctgaaggatgaactccgtaaaagaaggcttcctgtcaagggtttgaaagaggaacttgtgaggcgactctttgaatccattcagagtgaaaacacagctgatgaagctgatgaagatgtgggagccaatgcagatgatcagttgcctgatgccaatgctagtgaacaaactacagttaccatcacagaagttcagcacgaaacagtggttcatgtcactcagc

SEQ ID NO: 49350 - protein, 93 aa, Panicum virgatum
  misc_feature: Ceres CLONE 2049185
  misc_feature (12)..(46): Pfam Name: SAP Pfam Description: SAP domain
MSSYPVLNNRPIDQWRVTDLKDELRKRRLPVKGLKEELVRRLFESIQSENTADEADEDVGANADDQLPDANASEQTTVTITEVQHETVVHVTQ

SEQ ID NO: 49351 - DNA, 479 bp, Panicum virgatum
  misc_feature: Ceres CLONE 2049189
  misc_feature: Encodes the peptide sequence at SEQ ID NO. 49352
ttctgctcactcgcgactggcctgccttcctcctctcctgcctcccaactgccgctctcccttcttaatccactccaatcgctggatgcgtcgaggaagatggctcatctctcatagattcgaggcttggatcgacctcctctgtgacctcgagctccacacaaacaggtcaggcgaagagtggtcttatcgattcaaggggaagcagggagactgtatatcgctcgtgttacaaattgataatccataaggaatcttgtgtgggctgttatctacaattcggtccagtataaacgtgcactaagcattttcagaagtatggtgcaataaccgattccgttatcatgaaggacaagcatacgaagatgcctcgtggatttggatttgtcacattttccgatccatctgtgattgatagggttctagaggatgaacatgtcatagatggaagaacggttgaagttaaaaggactgttcca

SEQ ID NO: 49352 - protein, 44 aa, Panicum virgatum
  misc_feature: Ceres CLONE 2049189
  misc_feature: Functional homolog of the protein sequence given in SEQ ID NO 50747
  misc_feature: Useful for making plants with altered alkaloid content
MKDKHTKMPRGFGFVTFSDPSVIDRVLEDEHVIDGRTVEVKRTV

SEQ ID NO: 49353 - DNA, 659 bp, Panicum virgatum
  misc_feature: Ceres CLONE 2049196
  misc_feature: Encodes the peptide sequence at SEQ ID NO. 49354
acaaccaagcgcgcgcgcgcgccacgccaccgcaccccatcttttcttcgctcaccttccccgctcctgcccgtcttcccttcccgatctccagtcttctcccctcaaaatcagcgccagccccagccgcagctgcagtcgggatcagttcgccgcccctagctagataacctcgctcgcctgcctcgccgaggacgacggcgcgcggccgcggcgtcacgagactcggaaagccgcgcggcgcgaacatctttttttttctaggagaggtggttttgcgagaggaagaggatggcgcgcggcagctcctggcggctcgcggtggccggcgtcctcgtcgccgtctgcgcggcggccgccctcgcgccgcccgccgccgcgctcgacatcggcatccagtccgccggcgacggcgcgcaggcgtgcagccgcacgtgcgagtcggaccactgcacgactaagagcgttcgacggctgatctgcgcagcgccgccgttcctgcgctacggcaagtactgcggcatcctctacagcggctgccccggcgaggcaccgtgcgacgcgctggacgcctgctgcatgcaccacgacaactgcgtccaggcgaggaaggactacctgagcacggggtgcaacgaggcgctgctggactgcctggc

SEQ ID NO: 49354 - protein, 122 aa, Panicum virgatum
  misc_feature: Ceres CLONE 2049196
  misc_feature: SWISSPROT Homolog: EC 3.1.1.4 Phospholipase A(2)
MARGSSWRLAVAGVLVAVCAAAALAPPAAALDIGIQSAGDGAQACSRTCESDHCTTKSVRRLICAAPPFLRYGKYCGILYSGCPGEAPCDALDACCMHHDNCVQARKDYLSTGCNEALLDCL

SEQ ID NO: 49355 - DNA, 652 bp, Panicum virgatum
  misc_feature: Ceres CLONE 2049216
  misc_feature: Encodes the peptide sequence at SEQ ID NO. 49356
atcacaccactcgaattatcgcgcccagattccccatttttcgctcctccgaaactctcccgaagcgctgcagcagcaaccatggacgccagcggagccaccgggaaggtgaagaagggggcggccgggcgcaaggccggcggtcccaggaagaaggcagtgtcgcggtccgtgaaggccgggctccagttccccgtcagccgcatcgggcgctacctcaagaagggccggtacgcgcagcgcgtcggcaccggcggccccatctacctcgccgccgtcctcgagtacctcgccgccgaggtgctggagctcgccgggaacgcggcgagggacaacaagaagacgcgcatcatcccgcgccacgtgctcctggcgatccggaacgacgaagagctcgggaagctgctggccggtgtcactatcgcccacgggggcatcctccccaacatcaacccggtgctgctgcccaagaaggtggcggagaaggcggccagcggcggcgccgaggaggccaagtcgcccaagaagggcgccaagtcccccaagaaagcctagacagtagagactccattagcaccgtgctgtaataacatgttcgcgtttagatttgtggttgggttgtgaccgttcgtcagatgttactatgtactgt

SEQ ID NO: 49356 - protein, 157 aa, Panicum virgatum
  misc_feature: Ceres CLONE 2049216
  misc_feature (29)..(102): Pfam Name: Histone Pfam Description: Core histone H2A/H2B/H3/H4
MDASGATGKVKKGAAGRKAGGPRKKAVSRSVKAGLQFPVSRIGRYLKKGRYAQRVGTGGPIYLAAVLEYLAAEVLELAGNAARDNKKTRIIPRHVLLAIRNDEELGKLLAGVTIAHGGILPNINPVLLPKKVAEKAASGGAEEAKSPKKGAKSPKKA

SEQ ID NO: 49357 - DNA, 527 bp, Panicum virgatum
  misc_feature: Ceres CLONE 2049235
  misc_feature: Encodes the peptide sequence at SEQ ID NO. 49358
ggacagggagaggagcgaggcagaggagaagcgttcgcgacgggagctggctggtggaggcggggagccgccgccgccgcggcgccgggggacggcgcgtccccgcccaagttcctgggcgtcgagaccaagacgctgaagaagatcgtgcccctggggctcatgttcttctgcatcctcttcaactacaccatcctgcgggacaccaaggacgtgctcgtcgtcaccgccaagggcagcagcgccgagattatccccttcctcaagacttgggtcaacctgcccatggccgtcggcttcatgctcctctacaccaagctcgccgacgtcctctccaaggaggcgctcttctacgccgtcatcttccccttcatcgccttcttcggggccttcgcctacgtgctctaccccatgcgcgacgccatccaccccaccgcgctcgccgaccgcctcctcgccgcgctcggacccatcttcctcgggcccgtcgccatcctccgggtctggagcttctgcctcttctacgt

SEQ ID NO: 49358 - protein, 175 aa, Panicum virgatum
  misc_feature: Ceres CLONE 2049235
  misc_feature (2)..(175): Pfam Name: TLC Pfam Description: TLC ATP/ADP transporter
  misc_feature: Functional homolog of the protein sequence given in SEQ ID NO 51659
  misc_feature: Useful for making plants with atered amino acid content
GQGEERGRGEAFATGAGWWRRGAAAAAAPGDGASPPKFLGVETKTLKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLAALGPIFLGPVAILRVWSFCLFY

SEQ ID NO: 49359 - DNA, 687 bp, Panicum virgatum
  misc_feature: Ceres CLONE 2049254
  misc_feature: Encodes the peptide sequence at SEQ ID NO. 49360
acctggtgctctcccgccgccgccacctcgttctacacgtcgtctcgcctctgccgtcgccatggggagaagacccgctagatgctaccgccagatcaagaacaagccatacccgaagtcaaggtactgtcgaggtgtccctgaccccaagatcaggatctatgatgttgggatgaagaaaaagggagtggatgagttccccttctgtgtccacctggttagctgggagaaggagaatgtttccagtgaggctcttgaggctgcccgcattgcttgcaacaagtacatgaccaagagtgctggaaaggatgccttccacctgagggtcagggttcatccattccatgtccttcgtatcaacaagatgctttcatgtgccggggctgataggctccagactggaatgaggggtgcttttggcaagccccagggtacctgtgctcgtgtggacattggtcaggtcctcctctctgtgcgctgcaaggaaagcaatgctaatcacgctgaagaagccctccgccgtgccaagttcaagttccctggccgccaaaagatcatccgcagcaggaagtggggtttcaccaagttcacccgtgccgagtacctcaagtataagagtgagggtagaatcgcgcctgatggtgtcaatgctaagctgcttggcgtccatggtccactgtctaagcg

SEQ ID NO: 49360 - protein, 208 aa, Panicum virgatum
  misc_feature: Ceres CLONE 2049254
  misc_feature (5)..(167): Pfam Name: Ribosomal_L16 Pfam Description: Ribosomal protein L16
MGRRPARCYRQIKNKPYPKSRYCRGVPDPKIRIYDVGMKKKGVDEFPFCVHLVSWEKENVSSEALEAARIACNKYMTKSAGKDAFHLRVRVHPFHVLRINKMLSCAGADRLQTGMRGAFGKPQGTCARVDIGQVLLSVRCKESNANHAEEALRRAKFKFPGRQKIIRSRKWGFTKFTRAEYLKYKSEGRIAPDGVNAKLLGVHGPLSK

SEQ ID NO: 49361 - DNA, 300 bp, Panicum virgatum
  misc_feature: Ceres CLONE 2049275
  misc_feature: Encodes the peptide sequence at SEQ ID NO. 49362
agatcaaggcgtccatggagaacggcgtgctcaccgtcaccgtgcccaaggaggagggtaagaggcccgacgtcaagcccgtccagatcaccggctaggacgggaggagcacgcgtggtctgtggagctccaagtaaccgttctggaaacgaatgcgttctgtttttgtgcggtggtgtcagtttagtctgtgtggttcttctgtaagcctgcttgtttgcgtgatcgtcgaggctcaagtacctgagtccattgtgtctttgttccactaataatttcataaataaacgagtgatacag

SEQ ID NO: 49362 - protein, 31 aa, Panicum virgatum
  misc_feature: Ceres CLONE 2049275
  misc_feature: Functional homolog of the protein sequence given in SEQ ID NO 51227
  misc_feature: Useful for making plants with modulated heat sensitivity
IKASMENGVLTVTVPKEEGKRPDVKPVQITG

SEQ ID NO: 49363 - DNA, 683 bp, Panicum virgatum
  misc_feature: Ceres CLONE 2049280
  misc_feature: Encodes the peptide sequence at SEQ ID NO. 49364
ataggcggcgccgccgccgcagcaccccccccccccccccccctccgactccgatactcctctcgctcattctccatcccaaacctagccgccacgccaacgccaagcacctcaccgatcccttccttcccccctctactccgccgaggtcaaggggattcctctccatgcttccttccaagaggtccgcgggtgctgacggcggccagcccaagaggcccgaggtgggggaatcaccgcccgcagccgccgccagtaacggcactcggaatggggcgccgccggcgatcgacgaggacctgcacagcaggcagctcgccgtctacggcagggagacaatgcgccgcctcttcgcctccgacgtcctcgtctctggactcaatggcctcggtgctgagattgcaaagaatctagctcttgctggagtcagatctgtcactgtacatgatgtcaaagatgtggacatgtgggacctgtctggcaatttctttttgtccgagcaagatattggaaagaacagggcccttgcctgtatctccaagttgcaggagctgaacaatgctgtcctggtatctgctctaacagaggaattgacaaaagagcacttatctaagttccaggctgttattttcaccgatataagcttagacaaggcttatgaatttgatgactattgccacagc

SEQ ID NO: 49364 - protein, 171 aa, Panicum virgatum
  misc_feature: Ceres CLONE 2049280
  misc_feature (62)..(169): Pfam Name: ThiF Pfam Description: ThiF family
MLPSKRSAGADGGQPKRPEVGESPPAAAASNGTRNGAPPAIDEDLHSRQLAVYGRETMRRLFASDVLVSGLNGLGAEIAKNLALAGVRSVTVHDVKDVDMWDLSGNFFLSEQDIGKNRALACISKLQELNNAVLVSALTEELTKEHLSKFQAVIFTDISLDKAYEFDDYCH

SEQ ID NO: 49365 - DNA, 663 bp, Panicum virgatum
  misc_feature: Ceres CLONE 2049297
  misc_feature: Encodes the peptide sequence at SEQ ID NO. 49366
catttcgtttcctgcctgccccgcctccagcctcctcgtctcctctcctctccacccctgcctccgccccccgcccccctgcgagatcggcagctcttgtacgggtgttctggtgccggtggtttggccttggcgcacgctcccgcctcctgctgttgcttccctggtgcacagccggtgagccgagtttccgtcagattcggtggttccgctggtttggaaatccggagatggctcgttttcaggcgatgaacgaccaaaggcctgctgctgatcgcgtcggccatgcagacttcatggaccatctgaagagaactctcgattcgccagaaggagcgcgagctcctaaggcacgcaagccatacacgatatccaagcagagggagaaatggacggaggacgagcacaagctcttcttggaagcccttcagcaacatggccgtgcctggcgtcgtatacaagagcacataggcagcaagactgccgtgcaaatcaggagccacgctcagaagttcttctccaaggtcatccgagaatcatctggggatagcaacagcatagctgctccaccacaaattcatattcctccaccacggccaaagaggaagccggcgcacccatacccgcgcaagctgggtaattcactctgcaaggatgcctcta

SEQ ID NO: 49366 - protein, 144 aa, Panicum virgatum
  misc_feature: Ceres CLONE 2049297
  misc_feature (51)..(96): Pfam Name: Myb_DNA-binding Pfam Description: Myb-like DNA-binding domain
MARFQAMNDQRPAADRVGHADFMDHLKRTLDSPEGARAPKARKPYTISKQREKWTEDEHKLFLEALQQHGRAWRRIQEHIGSKTAVQIRSHAQKFFSKVIRESSGDSNSIAAPPQIHIPPPRPKRKPAHPYPRKLGNSLCKDAS

SEQ ID NO: 49367 - DNA, 652 bp, Panicum virgatum
  misc_feature: Ceres CLONE 2049301
  misc_feature: Encodes the peptide sequence at SEQ ID NO. 49368
atctatcatctccccactcacacatgccatcccatctctgcctttctgctctttcccctccacccctgctccccacatcgactccattgctgccttcccaccaaatcccatcccccccaccccaccgaattccctagtctcccgccggattcgcccagttcgtcagcttcggagctcgattcgtccccgaagctgcggcctgggctgccaatttgctcgatttcaccttcttcaagaatttgatgaagggaagcgaagttgccggcgacgtttagcaggccacaatagacggaggaggaaaacccgccctgatatcgcaattggtgggactgcttcaattgaggacaaagttagcaattatctattgttgagtcttattgggatttgtgctaatttgaactctgacagtgttcagcattcaaacagccaggagctgctatccactcttttaaagaacctagggtctgttgccaaatcactggagccaaaagaactctgtaaactcctggaggcatatcaaagcctgcaaaatggatcaaatgctggaacctctggaacaactaatgctgcagaagaggctgcagggccatctaactctaagttgcctttcgggaatggtagtcatcgtggacaggcatcatcatctgtttgt

SEQ ID NO: 49368 - protein, 216 aa, Panicum virgatum
  misc_feature: Ceres CLONE 2049301
  misc_feature (43)..(104): Pfam Name: SBP Pfam Description: SBP domain
SIISPLTHAIPSLPFCSFPSTPAPHIDSIAAFPPNPIPPTPPNSLVSRRIRPVRQLRSSIRPRSCGLGCQFARFHLLQEFDEGKRSCRRRLAGHNRRRRKTRPDIAIGGTASIEDKVSNYLLLSLIGICANLNSDSVQHSNSQELLSTLLKNLGSVAKSLEPKELCKLLEAYQSLQNGSNAGTSGTTNAAEEAAGPSNSKLPFGNGSHRGQASSSV

SEQ ID NO: 49369 - DNA, 667 bp, Panicum virgatum
  misc_feature: Ceres CLONE 2049303
  misc_feature: Encodes the peptide sequence at SEQ ID NO. 49370
agagagagagagaggagacagcaacaccggctgcttaatctcttcttttcctcggcttatctccaagggcgcatctccagaagcggaagggaggaacggagcggcgaattcttgttttcgcgcaagatgtcttccccaagcaagcgccgggagatggacctcatgaagctgtgaggacaggggggcgattcagtgattttcctttgggatttcgatggggatttccttgatctgtgtttctgttacctgtcgatgcctgcaggatgatgagcgactacaaggtggagatggtgaacgatgggatgcaggagttctttgttgacttccgtgggcctaacgaagattttcactcaggaggccaatttgattccgtttcttgcgccgatgattctgtagcttctgatttctgatctagatagactgactgaagaacgagtattcaggaagttgagagtttttgttgatcattgtagcctttagcttccaaaattgatgtagcttgagaacagatatgatcagatccccaatttaacctgttgctgagctgctttttctttctgtgttgtcatcagtatctgaatgatgtacttgaagcttcagtcttgttagtactgatttatgatgaccagctgcactttctgaaggatgctttgctgaatttaatagg

SEQ ID NO: 49370 - protein, 48 aa, Panicum virgatum
  misc_feature: Ceres CLONE 2049303
  misc_feature: SWISSPROT Homolog: EC 6.3.2.19 Ubiquitin--protein ligase
MMSDYKVEMVNDGMQEFFVDFRGPNEDFHSGGQFDSVSCADDSVASDF

SEQ ID NO: 49371 - DNA, 655 bp, Panicum virgatum
  misc_feature: Ceres CLONE 2049306
  misc_feature: Encodes the peptide sequence at SEQ ID NO. 49372
aaagggcggagctagagagagagagagaaagggaggcgggggattgggggaggatggctctgctgcagtgccagagcctgcccggcattggctgcagcggcatcgccccggcacgagcgagggtgcagcaatgtctggcagcggcgtcacacgcgccccttccgcctcccctcctgcgcgccaatggcggcacgacgggccgctcccctgcctccattaaggctggcagtgcgataggcttcggccggcggggacggagggacctgcgcgtcgtcgcggaggcggcggcggccaaggtcacgccggtgtcgcctggcggcgtcagcgtcagcgacgtgctctggccttccgccggagcattcttggccatggcagtactggggaaactggaccaggtggtggcgtacaagggagtctccttgacaattgcgccccttggagcggtctgctgcgtgcttttcagcgctccagactcacctgcagccaagaaatacaatatgttcatcgcacagattggttgtgccgcattaggtgtattggccctttcgttgtttggaccaggctggttagcaagaggtgcagctctttctgcctgcatagcattcatgaccatcacaggtgcttcacatcctccagctgcaagcttgcccctctt

SEQ ID NO: 49372 - protein, 200 aa, Panicum virgatum
  misc_feature: Ceres CLONE 2049306
  misc_feature (109)..(200): Pfam Name: HPP Pfam Description: HPP family
MALLQCQSLPGIGCSGIAPARARVQQCLAAASHAPLPPPLLRANGGTTGRSPASIKAGSAIGFGRRGRRDLRVVAEAAAAKVTPVSPGGVSVSDVLWPSAGAFLAMAVLGKLDQVVAYKGVSLTIAPLGAVCCVLFSAPDSPAAKKYNMFIAQIGCAALGVLALSLFGPGWLARGAALSACIAFMTITGASHPPAASLPL

SEQ ID NO: 49373 - DNA, 669 bp, Panicum virgatum
  misc_feature: Ceres CLONE 2049319
  misc_feature: Encodes the peptide sequence at SEQ ID NO. 49374
atctcgcgagccctctccctctccctcctcttcttgccctaatccccctcccgcatccccccggctcggcggcggccggctcaccagcggtaccagcagcaatggggaggtacagcccttcgtaccatagcccgccaaggagaggacatggcggcaggggaaggagcccgccgcctaggagaggctatggtggtggtggtggtggtggcggccgtggagggcgaggtgaccaaggttctgttagcctcctggtacgcaacattccgctgagatgcaagcctgaggagcttcgagtccctttcgaaaggtttggtcctgtgagggatgtttacctcccaagagattatcacactgggtaagtgttaacagagccaccaggctgttatggttggttagttacttgccatccttctatcagttgcacttgcatgtgatgattggatatatcttacatgtcgaaacgcttgggggtaaaagcacttgcaagtttacaacattacttgccatcgtttttcctcctttagctattatacagctaggataagacttccttgctgctgctgctgcttttgattagacctaagccttttgggttgtttatacagaaattcgattgttaatgtctgcgtgaattgtgcagattcataggctcaaaacgagtgtttcatg

SEQ ID NO: 49374 - protein, 85 aa, Panicum virgatum
  misc_feature: Ceres CLONE 2049319
  misc_feature: Functional homolog of the protein sequence given in SEQ ID NO 50855
  misc_feature: Useful for making plants with altered terpenoid content
MGRYSPSYHSPPRRGHGGRGRSPPPRRGYGGGGGGGGRGGRGDQGSVSLLVRNIPLRCKPEELRVPFERFGPVRDVYLPRDYHTG

SEQ ID NO: 49375 - DNA, 587 bp, Panicum virgatum
  misc_feature: Ceres CLONE 2049357
  misc_feature: Encodes the peptide sequence at SEQ ID NO. 49376
aacaagtgcccggaccgactcgactcctcccttcttctcttcttctacggctcgccgctcacgtccgccgcctcccctccggccatctcccaccgcgtccgcctgcggttgcctcctccagacggggcaacgacgcgtctcctccggtactcctccatctgcaggttattctgaagaaaccccagaagcataggacgccgcgctatcccgttctccgcctcgtcttccccaaataccgtctccccgccgttcgacagccgagggcggaggcggataagtttcggagatgtcggtgctcatcgtgaccagcgtgggcgacatcgaggtggatctccacaccgacaagtgccccctcaccaccaagaactttctcaagctctgcaaaatgaagtattacaatgggtgtctgttccacaaggtggagaaggacttcttggcacaaactggcgatccgactggaactggcactggcggtgattctgtgtacaaatttctctatggtgatcaagctcgattttttgatgatgagatccgtccagagttgaggcattcaaaaactggaacagttgctatggcaagcgctggtg

SEQ ID NO: 49376 - protein, 100 aa, Panicum virgatum
  misc_feature: Ceres CLONE 2049357
  misc_feature (2)..(100): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MSVLIVTSVGDIEVDLHTDKCPLTTKNFLKLCKMKYYNGCLFHKVEKDFLAQTGDPTGTGTGGDSVYKFLYGDQARFFDDEIRPELRHSKTGTVAMASAG

SEQ ID NO: 49377 - DNA, 602 bp, Panicum virgatum
  misc_feature: Ceres CLONE 2049366
  misc_feature: Encodes the peptide sequence at SEQ ID NO. 49378
aacggactaaccaccaccacacgaagtcacgaactgctcctcacctcacacaccgaaggccgcagagcctaaaacccccctctgacccccactgccacttgccaccactcggcgccttccgccgcctccccgatcgttccggaacctttgagattgtagggggaggtcgtccgcggcgtcggcgagggcgatggaggtcagggggctggggcagctcctggcggcgctggccgcggcgctcttcgtccgcgccatcgccgggcctgggcccaccctcctcccgccggcggaggacacggaggacgacgagaccgacgcggcggccggcggcggcgtcgtgcggcccgtgaccatccggtgggcccgcatcacgtgcgcgctgaagaacaagcgcggggaagtggcaaggttcctgctgtcgaatgtgtctggggaggcgaaaccagggaggctgctagcgctcatggggccatccgggtctggcaaaacaactctgctcaatgtgctggcagggcagctcacagcatcgccttccctgcatctttcggggtatctgtatgtcaatggtcggcctatctcgaagagcggatataagattgctt

SEQ ID NO: 49378 - protein, 137 aa, Panicum virgatum
  misc_feature: Ceres CLONE 2049366
  misc_feature: SWISSPROT Homolog: EC 3.6.3.27 Phosphate-transporting ATPase
MEVRGLGQLLAALAAALFVRAIAGPGPTLLPPAEDTEDDETDAAAGGGVVRPVTIRWARITCALKNKRGEVARFLLSNVSGEAKPGRLLALMGPSGSGKTTLLNVLAGQLTASPSLHLSGYLYVNGRPISKSGYKIA

SEQ ID NO: 49379 - DNA, 629 bp, Panicum virgatum
  misc_feature: Ceres CLONE 2049387
  misc_feature: Encodes the peptide sequence at SEQ ID NO. 49380
gcaaaaccctatcccgttgttccgcctctccgcctccgcctccgcctccgcctctgcctctactctcgcaacggcggcagcagcagcagtcatggcaaaggcctggggtggcgtcggcgcgtgggcgctggacgccgagcgcgccgaggaggaggagcatgagcgcgtcccggcgcccgagcccgccggcggcgccgccagcttccccagcctcgcggaggcggccgccgcgggcggcgggggcaagtccaagaagaagagcaagggcaccaccctgtcgctctccgagttcactacctacggcgcggcagcggcgcagcgccgcgccgctcccgtggagcccaggggcctcacccctaacgagatgatgatgctgcccacggggccccgggagcgctccgacgaggagctcgaccgctcccgcggcttccgctcctacggcggcctcgggggaggcgagcgccgcggcttcgacgacgagggccgccgcgggagcaggagctcggatctcgacatgccctcacgcgccgacgaggtggacgactggggggccactaagaagttcaccccggctgccaacgactccggccgccgcgacaggttcggcgggtcgtccccgctcggccgcg

SEQ ID NO: 49380 - protein, 179 aa, Panicum virgatum
  misc_feature: Ceres CLONE 2049387
  misc_feature (1)..(179): Pfam Name: eIF-4B Pfam Description: Plant specific eukaryotic initiation factor 4B
MAKAWGGVGAWALDAERAEEEEHERVPAPEPAGGAASFPSLAEAAAAGGGGKSKKKSKGTTLSLSEFTTYGAAAAQRRAAPVEPRGLTPNEMMMLPTGPRERSDEELDRSRGFRSYGGLGGGERRGFDDEGRRGSRSSDLDMPSRADEVDDWGATKKFTPAANDSGRRDRFGGSSPLGR

SEQ ID NO: 49381 - DNA, 671 bp, Panicum virgatum
  misc_feature: Ceres CLONE 2049388
  misc_feature: Encodes the peptide sequence at SEQ ID NO. 49382
agagaacctcggggaccccgctcgcccgccgatctagtactagcgacgcgagcaagaaccaatcgagatggccaaggcgaggtcgtcgtccaagcagccgcagcagcagaacgccggccacgcgctgccctccaagctcgccaggtacctcgacccggaggcctccttggacaaggaccaactgctcgacgcgctgcactggatccgccaggcgctggggctcatctgcggcctgctctggggggcccttcccctcgtcggcgccgtctggatcgcgctatttctggctatttctactggggttatttattggtactacacttacctgttgaagattgacgaggaagaatatggaggccatggggcactacttcaggagggactgtttgcttctttcacccttttcctgctttcctggactctgttatacagtttggcccacttttgataagctcctcttttgaacatactgtggaacatttgctcaacatgctggccagtagagagaacagcgtagattaagttaagttgcctttcagatcgagcattgtatcaaaatccttcaggtcttaatgtcatttctcaaccctgatgtaactttgatgtacgggtctagataaccgagtgtaaattgtactgtaactttgttttgtcaaacagtattcactttc

SEQ ID NO: 49382 - protein, 126 aa, Panicum virgatum
  misc_feature: Ceres CLONE 2049388
  misc_feature (14)..(126): Pfam Name: Rab5ip Pfam Description: Rab5-interacting protein (Rab5ip)
MAKARSSSKQPQQQNAGHALPSKLARYLDPEASLDKDQLLDALHWIRQALGLICGLLWGALPLVGAVWIALFLAISTGVIYWYYTYLLKIDEEEYGGHGALLQEGLFASFTLFLLSWTLLYSLAHF

SEQ ID NO: 49383 - DNA, 681 bp, Panicum virgatum
  misc_feature: Ceres CLONE 2049421
  misc_feature: Encodes the peptide sequence at SEQ ID NO. 49384
agaaataaacatggtcaagatggttaccccaagctacattgctacattcaactctactaaaacaactgtaaattcaaagctagagaaatatcctaccaacacgtcgataacttccaatggctcgaccaaatctgtaaagaacctatttggattactaaaaaattgaatataataaactgaattatttattgtaaaatcgccacccgccttcccctccctctacacgcacctctcgggctcggctccgaagagggaggaggacgccagctgccacggcacccgcacccgctcccgcgctacccgccgccaccatgctgtccgcggagaccgagaaggagctgcaggagcagcagcagcaggagaaggaggtggcggcggccggcggcggggtcgaggacccctacggcgaggacagggccaccgaggagctgcccgtcacgccctgggcctactccgtcgcgagcggttacacccttttgagggatccacatcacaacaagggtctttccttcactgagaaggagcgggatgcacactacttgcgtggccttctgcctccggcggttgtgtctcaggaactccaaattaagaagatcatgcacaacctgcggcagtaccagctccctttgcagcgctatatggccatgatggaccttcaggagagaaatgaaaggcttttct

SEQ ID NO: 49384 - protein, 123 aa, Panicum virgatum
  misc_feature: Ceres CLONE 2049421
  misc_feature: SWISSPROT Homolog: EC 1.1.1.40 Malate dehydrogenase (oxaloacetate-decarboxylating) (NADP(+))
MLSAETEKELQEQQQQEKEVAAAGGGVEDPYGEDRATEELPVTPWAYSVASGYTLLRDPHHNKGLSFTEKERDAHYLRGLLPPAVVSQELQIKKIMHNLRQYQLPLQRYMAMMDLQERNERLF

SEQ ID NO: 49385 - DNA, 693 bp, Panicum virgatum
  misc_feature: Ceres CLONE 2049431
  misc_feature: Encodes the peptide sequence at SEQ ID NO. 49386
gaaccccgcgaagccgccaggccacgagcgcacggctcccccctcgacctcccatccccgcctcgctccctccgccgcctagggttttccaccgggcgccgccgcagcggcggcccgggatgcgggcgggcccgcgcaggtagccctcggacccaccaccgccgcgccgcgcgcccgccatgtcgctcctgcggcggcggaagcagccgccgccgccctcggatggcaacgggtccgaccacgacgacgacgacaaggggaagaggccgtcctcctccgcgccggcgtccaaggaggcgaccaggcggaccaaggccaggtggtcgtgcgtggacagctgctgctggctggtcgggtgcgtgtgctccgcctggtggctcctgctcttcctctacaacgcgatgccggcgtcgttcccgcagtacgtcacggaggccatcacgggcccgctcccggacccgccaggggtcaagctgcacaaggaggggctccgcgtcaagcaccccgtcgtcttcgtccccggcatcgtcaccggcgggctcgagctctgggagggccaccactgcgccgaggggctcttccgcaagcggctatggggcggcacatttggcgacgtatacaagagacctttatgctgggttgaacatatgtcattggacaatgaaactggattagacaagccagggaataagg

SEQ ID NO: 49386 - protein, 171 aa, Panicum virgatum
  misc_feature: Ceres CLONE 2049431
  misc_feature: SWISSPROT Homolog: EC 2.3.1.158 Phospholipid:diacylglycerol acyltransferase
MSLLRRRKQPPPPSDGNGSDHDDDDKGKRPSSSAPASKEATRRTKARWSCVDSCCWLVGCVCSAWWLLLFLYNAMPASFPQYVTEAITGPLPDPPGVKLHKEGLRVKHPVVFVPGIVTGGLELWEGHHCAEGLFRKRLWGGTFGDVYKRPLCWVEHMSLDNETGLDKPGNK

SEQ ID NO: 49387 - DNA, 683 bp, Panicum virgatum
  misc_feature: Ceres CLONE 2049433
  misc_feature: Encodes the peptide sequence at SEQ ID NO. 49388
ttcctgcttctcgatcggattgggttgggggttctgggtaggtgtggtgtgcacgggagttggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgccggtagtttcggttctgcatgccccatcctcttgttctactaccgctctacttttttgaaatttccatcatgggagatcggttcttccctgctcaaggacgtgtgtgcgatgccggtcgtcgtgcttagtttccagatctgtgtgtagatccacatggaagcctgtcgttggcgcacgaataatttcaaatagggagaattccaaattagaccctccattgcagaagttcgattttgataacataggccatctaattgttgaaatcagacaaatttggagtggtttctacggtggttttgtattatttaaaataataataaattctaattagtcttaaaaaatcaaaactaattcattttgaatcagaaaaatacgaaactagtaccaatttttttttgaaaatttaaccaatatattctctatttgaatagaatcttagttatataaaaacaattgacataaatacaagcaactaaat

SEQ ID NO: 49388 - protein, 71 aa, Panicum virgatum
  misc_feature: Ceres CLONE 2049433
  misc_feature: SWISSPROT Homolog: EC 6.3.2.19 Ubiquitin--protein ligase
MASKRILKELKDLQKDPPTSCSAGSFGSACPILLFYYRSTFLKFPSWEIGSSLLKDVCAMPVVVLSFQICV

SEQ ID NO: 49389 - DNA, 694 bp, Panicum virgatum
  misc_feature: Ceres CLONE 2049486
  misc_feature: Encodes the peptide sequence at SEQ ID NO. 49390
gcttctcgatcggattgggttgggggttctgggtaggtgtggtgtgctcgggagttggggcttcttcgttgctttgcttcgctcgtgcgcaagggagagagaagagggaggagaagtaggcggggaggcagatggcatcgaagcggatcctcaaggagctcaaggacctgcagaaggatcctcccacctcctgcagcgcaggtagtttcggttctgcatgccccatcctcttgttctactaccgctctacttttttgaaatttccatcatgggagatcggttcttccctgctcaaggacgtgtgtgcgatgccagtcgtcgtgcttagtttccagatctgtgtgtagatccacatggaagcctgtcgttggcgcacgaataatttcaaatagggagaattccaaattagaccctccaactattgccgaagttcgattttcaaccactataaaaatcggataacataggccatctaattgttgaaatcagacaaatttggagtggtttctacggtggttttgtattattttaaaataataataaattctaattagtcttaaaaaatcaaaactaattcattttgaatcagaaaaatatgaaactagtaccattttttttttttgaaaatgtaaccaatatattctctatttgaatagaatcttagttatataaaaaaattgacataaatactagc

SEQ ID NO: 49390 - protein, 71 aa, Panicum virgatum; identical to SEQ ID NO: 49388
  misc_feature: Ceres CLONE 2049486
  misc_feature: SWISSPROT Homolog: EC 6.3.2.19 Ubiquitin--protein ligase

SEQ ID NO: 49391 - DNA, 724 bp, Panicum virgatum
  misc_feature: Ceres CLONE 2049519
  misc_feature: Encodes the peptide sequence at SEQ ID NO. 49392
gctgggattgtccttttctatctcttaaggttgcctccttttagcacagaaaatcagaaattgcagggtggacaatttgaccatgcagatcgtttattcaacagtgtgaaagatacatgggtaagcgctgctggcaaaagcaacacatcagatgtgaaagaactgatccctgagttctattatttgcctgaatttttggaaaaccagtttaatctggacctgggcgagaagcaatcaggagagaaggttggcgatgttgttctgccaccttgggctaaaggcagtgtcagagaattcattaggaaacatcgggaagcattggagtcagattatgtatctgagaatctacatcactggattgaccttatttttggatataagcagagaggaaaggcagctgaagatgctgtcaatgtcttctatcactacacatatgaagggagtgtcgacatagatgcagtatcggatcctaccatgaaggcttcaatactggcacaaatcaaccattttggtcagaccccaaaacagttattccaaaaaccacatccacagagacggactgacaggaaagtccctcctcatcctctacggtacagctcctatcttacgcaacaagagattcgcaagacagcatcttcagtgtcccaaattgtctccctacacgataagatcctaattgctgcagctaatagcttgctcaagccagtaacttacagtgaataca

SEQ ID NO: 49392 - protein, 241 aa, Panicum virgatum
  misc_feature: Ceres CLONE 2049519
  misc_feature (1)..(185): Pfam Name: Beach Pfam Description: Beige/BEACH domain
AGIVLFYLLRLPPFSTENQKLQGGQFDHADRLFNSVKDTWVSAAGKSNTSDVKELIPEFYYLPEFLENQFNLDLGEKQSGEKVGDVVLPPWAKGSVREFIRKHREALESDYVSENLHHWIDLIFGYKQRGKAAEDAVNVFYHYTYEGSVDIDAVSDPTMKASILAQINHFGQTPKQLFQKPHPQRRTDRKVPPHPLRYSSYLTQQEIRKTASSVSQIVSLHDKILIAAANSLLKPVTYSEY

SEQ ID NO: 49393 - DNA, 699 bp, Panicum virgatum
  misc_feature: Ceres CLONE 2049524
  misc_feature: Encodes the peptide sequence at SEQ ID NO. 49394
gctgaacctgtgactgctgccacatcaaaagttgacctagtttctgacagagataacagattgagttcgaaaatgaaagccaacatagcatctccttgttgctcaaaaccgcctggagttgatttggataaagatgcccctcttccttctaaatccccacgaatcaatagagctgcttcagctccccaaaaactgcctgccgctgataaagcgactccagttcctcccaaatctccacccgtaaacaaagtaccagcagttcaccccaaatctccagtagttgacaaaactccagttcgtgcaaaatctccagcagcagacagagtagctccagttcgtccccagtctccagcagttgacaaagcaacacccgttcgccccaaatcgccagcagttgacaaagcacctccagctggccccaaatcttcagccagtgaaaaagcaactacacttcttcccaaatctacaccagttgacaaagcttctccagctctgctgaaatcaccaacagggggtaaagatgcttacgttccttcaagatcagtgcatgataaatctattcctgctcccccaagactaccgcaagttgacaaagctgccccgccatcctcagaattgcgacaaacttctccaggcactaattctgaaactcaagaagcagctatttccaggaaggtcacagccaccttagtttccgag

SEQ ID NO: 49394 - protein, 232 aa, Panicum virgatum
  misc_feature: Ceres CLONE 2049524
  misc_feature: SWISSPROT Homolog: EC 2.7.7.6 DNA-directed RNA polymerase
AEPVTAATSKVDLVSDRDNRLSSKMKANIASPCCSKPPGVDLDKDAPLPSKSPRINRAASAPQKLPAADKATPVPPKSPPVNKVPAVHPKSPVVDKTPVRAKSPAADRVAPVRPQSPAVDKATPVRPKSPAVDKAPPAGPKSSASEKATTLLPKSTPVDKASPALLKSPTGGKDAYVPSRSVHDKSIPAPPRLPQVDKAAPPSSELRQTSPGTNSETQEAAISRKVTATLVS

SEQ ID NO: 49395 - DNA, 731 bp, Panicum virgatum
  misc_feature: Ceres CLONE 2049526
  misc_feature: Encodes the peptide sequence at SEQ ID NO. 49396
tcgtgctctctcagaggtgggttggcttctcctccccctccggttcggttcggttcgggttcgtgaggttcttggggttccgttcgggggcgagaggaagagatggaggcgtcggatgttgagtaccgctgcttcgtcggcggccttgcctgggccaccgacgacaactcgctccacaacgccttcagcccctacggcgaggtcctcgagtccaagatcatcctcgatcgtgagacccagaggtcccgcggcttcggcttcgtcaccttctcgagcgagcaggcgatgcgcgacgccatcgaggggatgaacggcaaggagctggacggccgcagcatcaccgtcaacgaggcccagtcccgcggcggcccgcgctccggcggcggcggcggctacgggcgccgcgagggcggcggtggctacggtcgccgcgagggcggtggcggctacggcggcggcggctacggtggccgtggaggctacggtggcggcggctacggtggcaaccgcggcggcggctacggcaactccgatgggaactggaggagctgagcggtggggcccgtgtggccaaagttatcctgtgctttctactgttacccgagttatcctgtgtcatgatctacctgtgtttggtgtctgtttcgtgttcgttgttgcccatctgtgtttttgatcgcaagctccgtcgtgctgttgtctgtcagagctatcttgatctccatcccctg

SEQ ID NO: 49396 - protein, 149 aa, Panicum virgatum
  misc_feature: Ceres CLONE 2049526
  misc_feature (10)..(81): Pfam Name: RRM_1 Pfam Description: RNA recognition motif. (a.k.a. RRM, RBD, or RNP domain)
  misc_feature (48)..(144): Pfam Name: GRP Pfam Description: Glycine rich protein family
  misc_feature: SWISSPROT Homolog: EC 5.2.1.8 Peptidylprolyl isomerase
  misc_feature: Functional homolog of the protein sequence given in SEQ ID NO 50180
  misc_feature: Useful for making plants with altered alkaloid content
  misc_feature: Functional homolog of the protein sequence given in SEQ ID NO 50185
  misc_feature: Useful for making plants with modulated flowering time
  misc_feature: Functional homolog of the protein sequence given in SEQ ID NO 50184
  misc_feature: Useful for making plants with altered lignin content
  misc_feature: Useful for making plants with modulated nitrogen use efficiency
  misc_feature: Functional homolog of the protein sequence given in SEQ ID NO 50210
  misc_feature: Useful for making plants with modulated biomass
  misc_feature: The sequence is a functional homolog of SEQ ID NO 1042 in the 10/374,780 US patent application
  misc_feature: The sequence is a functional homolog of SEQ ID NO 852 in the 10/666,642 US patent application
MEASDVEYRCFVGGLAWATDDNSLHNAFSPYGEVLESKIILDRETQRSRGFGFVTFSSEQAMRDAIEGMNGKELDGRSITVNEAQSRGGPRSGGGGGYGRREGGGGYGRREGGGGYGGGGYGGRGGYGGGGYGGNRGGGYGNSDGNWRS

SEQ ID NO: 49397 - DNA, 662 bp, Panicum virgatum
  misc_feature: Ceres CLONE 2049528
  misc_feature: Encodes the peptide sequence at SEQ ID NO. 49398
aagaataccatcaaatccctcaagaatgacataaagcaactgaataataaattggcagagctacaagcgtcgttagaggcaaaggaagatgaaatatctcagttgagaaggaacgacaatggtgctggttatggaaacaagaatttaattggtactagtacagttggtgcccctcttgaacaagatatgtcagaaaactatgaagaatcctcaacctcaagtagcatgattcaaggttttgattcaaggtcttcatgttcagtgaaatcttctacaagagatgggaaattccatgaatcttctcagataagacatacagaggagcagtttttggtgaccgaggaagactttcctgaagtgagagtgggttttcaggaaacatttttaggccataacagttcgattagccaatgtcgattttctgcatccggttcaaatattgctagttcatcagtcgatggtacagttaggatctggacgtatgattcgtcaacaccatcatctaaaaatgctactatatactgtggggctgaagtcagtgcactttcttgggaatgcagatctgacagattggcacagctaatggaggaattaaagcttggaattctgatgcaaagagagttgtttgcgacctgaatacatcaagagactttccaagtgtc

SEQ ID NO: 49398 - protein, 211 aa, Panicum virgatum
  misc_feature: Ceres CLONE 2049528
  misc_feature (122)..(160): Pfam Name: WD40 Pfam Description: WD domain, G-beta repeat
KNTIKSLKNDIKQLNNKLAELQASLEAKEDEISQLRRNDNGAGYGNKNLIGTSTVGAPLEQDMSENYEESSTSSSMIQGFDSRSSCSVKSSTRDGKFHESSQIRHTEEQFLVTEEDFPEVRVGFQETFLGHNSSISQCRFSASGSNIASSSVDGTVRIWTYDSSTPSSKNATIYCGAEVSALSWECRSDRLAQLMEELKLGILMQRELFAT

SEQ ID NO: 49399 - DNA, 489 bp, Panicum virgatum
  misc_feature: Ceres CLONE 2049532
  misc_feature: Encodes the peptide sequence at SEQ ID NO. 49400
gacctctaaaacgttcttatggatggcgcgtctcgtgggaggtgtttttcccgtgagcggcgagcctgattaccttgaccatggggaatatcgggttgatcacgatgcaacaccaaaaatgttcagctgcctgatgtgagttctcgataaattgacaagcaatggacatttctgtgtgataggtgaaacagttcctatgaaagaaattactgatgaatttgataaacttaagtaagggaacaatttgattggtgaactttcctgtatgtcttgcttgctctctcattcttgcccaatcataactgatgcttttcgggaatatatgactttttgagatgcaatagcgtcaactgtgtgtcaagctagcttatgtgtactatcagctgcatggcccaagttcgttaatggtgagataacattgcagtgacggtataaagtaattccgtctgatcccgtacctgtagaagctgcattatgttggcttgtggt

SEQ ID NO: 49400 - protein, 45 aa, Panicum virgatum
  misc_feature: Ceres CLONE 2049532
  misc_feature: Functional homolog of the protein sequence given in SEQ ID NO 51769
  misc_feature: Useful for making plants with altered carbohydrate content
TSKTFLWMARLVGGVFPVSGEPDYLDHGEYRVDHDATPKMFSCLM

SEQ ID NO: 49401 - DNA, 715 bp, Panicum virgatum
  misc_feature: Ceres CLONE 2049545
  misc_feature: Encodes the peptide sequence at SEQ ID NO. 49402
caaacccacctcgctcgcctcactccccgcgcgctcccagcgcacctccaccccccacccgcccctttccattctcgtcaccccctccgcgcccgggactccagcggctggcaaagctctgcttcccctttggtccgtccctgcgatcccgattcgaattctccgacctcccggccggcgacccgtatatataaggtcgttgatcttctggtggtgacctcgccggcggcggcgtagtacgtacgtgcgccatggctcgcggcgacggcgagctcgagctcacggtgggcgtccgcggcgccgggggccgcggcggcgcggcggcggcggcggacgcgcccgcgccgatcagcctcggcaggctcatcctcgccggcacggtcgccggcggcgtgcagtacggctgggcgctgcagctctccctcctcacgccctacgtgcagactctggggctttcacacgcccttacttcattcatgtggctatgcggccctattgctggcttagtggttcaaccgctcgtcggtctgtacagtgacaggtgcaccacgagatgggggcgacggaggccatttattctgactggatgtctgctcatctgtcttgccgttgtgatcgttggattctcatcagacattggagctgctctgggcgacacaaaggaagagtgcagcctctaccatggtcctcgttggcatgctgcaatcgtctatgt

SEQ ID NO: 49402 - protein, 154 aa, Panicum virgatum
  misc_feature: Ceres CLONE 2049545
  misc_feature: Functional homolog of the protein sequence given in SEQ ID NO 50772
  misc_feature: Useful for making plants with modulated heat sensitivity
MARGDGELELTVGVRGAGGRGGAAAAADAPAPISLGRLILAGTVAGGVQYGWALQLSLLTPYVQTLGLSHALTSFMWLCGPIAGLVVQPLVGLYSDRCTTRWGRRRPFILTGCLLICLAVVIVGFSSDIGAALGDTKEECSLYHGPRWHAAIVY

SEQ ID NO: 49403 - DNA, 660 bp, Panicum virgatum
  misc_feature: Ceres CLONE 2049560
  misc_feature: Encodes the peptide sequence at SEQ ID NO. 49404
agcatccatcccccctcacacaaattgtccccctccctcttctttaccgctgccgaccactgccgccaccaccagcaccgccccaccgcgcgcttgcagctgccacgggtgctaggtagcccgccggagccgccgccgccgcgcccatggcctccgtggcggccacctccacgctggccccggccctcgccgcccggcggcgccgggcgcggccagggatggcgctgctaccgccgcgccggggcgcggtcgtgcggtgctcgctcgaaagcaacgtctccgacatgggcgtcaacgctccaaaaggattgttcccacctgaaccggagcactacagggggcccaagctcaaggtggccatcataggggcaggcctcgcaggcatgtccactgccgtcgagcttttggaccagggccatgaggttaacttgtacgagtcccgaccatttattggtggcaaggttggctcatttgtcgataggcaaggaaaccatatcgagatggggctgcatgtgttcttcgggtgttacagcaatctgttccgcctcttgaagaaggttggtgctgataataatctgctggtgaaggaacacacacatacttttgtaaacaaagggggcgcggttggtgaacttgattttcggttcccggtgggagctc

SEQ ID NO: 49404 - protein, 171 aa, Panicum virgatum
  misc_feature: Ceres CLONE 2049560
  misc_feature: SWISSPROT Homolog: EC 1.14.99.30 Carotene 7,8-desaturase
  misc_feature: Functional homolog of the protein sequence given in SEQ ID NO 51156
  misc_feature: Useful for making plants with modulated biomass
  misc_feature: Useful for making plants with modulated flowering time
MASVAATSTLAPALAARRRRARPGMALLPPRRGAVVRCSLESNVSDMGVNAPKGLFPPEPEHYRGPKLKVAIIGAGLAGMSTAVELLDQGHEVNLYESRPFIGGKVGSFVDRQGNHIEMGLHVFFGCYSNLFRLLKKVGADNNLLVKEHTHTFVNKGGAVGELDFRFPVGA

SEQ ID NO: 49405 - DNA, 660 bp, Panicum virgatum
  misc_feature: Ceres CLONE 2049567
  misc_feature: Encodes the peptide sequence at SEQ ID NO. 49406
aagttaacagccgtcactgtttttcataacctggtttcattcttcacaggccccaagagcacaaaggggggagagagtggaggaattttcctgcctcctttgctgcaattttctattccaagcaggctcaggtggcagtcattctgtcccccctcgcccctccttttgtgttcctgcttgcttgcggccagaacacaagcatcttctttcgtgtcatttgcttgctactgacaggtcctcagagcagaggcatccggcatcccttccactgccactggcaatttggtcctgtgggaagccaaggctgctgcatgcttcttccttgccttggcctcaccctggcatgcttccatgtttgaacacgaaaaaagctcctgaacttgttgccaaggaggccccgggcttgcgctgccttggcaatggggatggttcttgctgcttcctccctggtgctgctcttgttcttctctgcttgcaggccggcaagtggcctcctctcccccaagggcgtaaactatgaagttcaagctctcatgatgatcaagaactacctcaaggatcctcatggcgtgctgaagaactgggaccaagactctgtggatccttgcagctggaccatggtcacttgctctccggagaaccttgttacgggcctagaag

SEQ ID NO: 49406 - protein, 80 aa, Panicum virgatum
  misc_feature: Ceres CLONE 2049567
  misc_feature (31)..(71): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature: Functional homolog of the protein sequence given in SEQ ID NO 50524
  misc_feature: Useful for making plants with modulated nitrogen use efficiency
MGMVLAASSLVLLLFFSACRPASGLLSPKGVNYEVQALMMIKNYLKDPHGVLKNWDQDSVDPCSWTMVTCSPENLVTGLE

SEQ ID NO: 49407 - DNA, 621 bp, Panicum virgatum
  misc_feature: Ceres CLONE 2049601
  misc_feature: Encodes the peptide sequence at SEQ ID NO. 49408
gcagtcaccaccacggcaccaccgccgccgccgccgccccgagctcccgcactccaaggccgacgccttctcccgtccacgcggcgcgcacccctccgctctcgaaaccctagcggcgcgcgccaccatggcggccaccgcggccgcgccgggggccgcgtcctccctgctcctctccccgcgccgcagccgcgccgccgccccgcgcttccgctcgccgaggtgcgtgctcgggagcgagcagctgcgcgtggtggatggggtgaagcggacgggcggggtcgagccgcggggcgcggtgtggacgccgaaggcgcccgcgccggaggccaggctcgcggcgctgccaagggaggtgcgggactcccggatgaagatcttctccggcacggccaaccgcccgctctcccaggaaattgctgcttacctgggtgtagacctcggcaagatcctcatcaagcgctttgctgatggagaaatttatgttcaactacaagagagcgtgagaggatgtgatgtgttcttggtccaaccaacatgctctcctgtcaacgaaaacctcatggaactcttcatcatgattgatgcatgccggcgggcttcagcacggtctattactgt

SEQ ID NO: 49408 - protein, 164 aa, Panicum virgatum
  misc_feature: Ceres CLONE 2049601
  misc_feature: SWISSPROT Homolog: EC 2.7.6.1 Ribose-phosphate diphosphokinase
MAATAAAPGAASSLLLSPRRSRAAAPRFRSPRCVLGSEQLRVVDGVKRTGGVEPRGAVWTPKAPAPEARLAALPREVRDSRMKIFSGTANRPLSQEIAAYLGVDLGKILIKRFADGEIYVQLQESVRGCDVFLVQPTCSPVNENLMELFIMIDACRRASARSIT

SEQ ID NO: 49409 - DNA, 706 bp, Panicum virgatum
  misc_feature: Ceres CLONE 2049624
  misc_feature: Encodes the peptide sequence at SEQ ID NO. 49410
gctttgcttggtctggttggttggttggcctcccgctcgctacgggccaagccgacggacaaatcttggtcttgggcgcgccgccgcggtaggattcggcaccgaggaccgattccttgttccctctcgcgacgattcgacgaggtttgctgccatggcggcggcaggcgtgacgcattgaggcggcgcgtgcggggccggggccgggcacatggatctggaggccgcgggcggcgcggcggcggcgcacgggaagaggtggcgtggggagtcatggcgcgcgacgctgctgctcgcgtaccagagcctcggggtggtgtacggcgacgtggccacgtcgccgctctacgtctacaagagcgccttcgccggcgacgacatccagcactcggcgggcaacgaggagatctacggcgtcctctctttcgtcttctggacgctgaccctcatcacccttgtcaagtacgtgctcatcgtgctccgcgcggacgacggcggggagggcggcaccttcgcgctctactccctcatctgccgccatgtccgcgctggcctgctgcccggtggcggcaccagagatgagctcatggaggaagacaaggtcacggggcgtcgcggcgagcggcccgtgtcaagggtcagggcggtgttggagaagtacagggtgctgcagaggctgttgctgctgttcgcgctgctggggact

SEQ ID NO: 49410 - protein, 164 aa, Panicum virgatum
  misc_feature: Ceres CLONE 2049624
  misc_feature: Functional homolog of the protein sequence given in SEQ ID NO 50430
  misc_feature: Useful for making plants with modulated biomass
MDLEAAGGAAAAHGKRWRGESWRATLLLAYQSLGVVYGDVATSPLYVYKSAFAGDDIQHSAGNEEIYGVLSFVFWTLTLITLVKYVLIVLRADDGGEGGTFALYSLICRHVRAGLLPGGGTRDELMEEDKVTGRRGERPVSRVRAVLEKYRVLQRLLLLFALLG

SEQ ID NO: 49411 - DNA, 659 bp, Panicum virgatum
  misc_feature: Ceres CLONE 2049629
  misc_feature: Encodes the peptide sequence at SEQ ID NO. 49412
atgacagcaacggtgttacagctctacataatgagctgaagaaaaacttggaaggaaaacgtttcttgttggtactggatgatctctgggtcaataatgagaatcggaagggtcgggatattctccttgatgcacttgacgctgggcaaagtggaagcataatcctagtgacagctcaaagagaagatgcagctgcagctctaggtgctcagaagcaaattttaatacctgacttggaagagaatgattatttaaaattattcatgcatcatgcacgaccaggcacaatcgaatataaaaggattggaaccaagattgccaacaagctacaccgctcacctattgcagcagtaacagtaggagagcagcttcggaagaatacaaggatcagtttttgggaaacaacagcgaacgatgtcgtactgaacgagaccatgggagctctgtggtggagctatcagcagcttggtgctgacatcaggcgttgctttgcatactgcagcactttccccagaggatacaagttaaaacgagatgagttagttcgtatctggatagcacaagggtttgtaaacaccgggggtaatgcaacagaggaaatggaagatgtaggcaatcgctactttgatgagttactggaattctcttttcttcaagtg

SEQ ID NO: 49412 - protein, 218 aa, Panicum virgatum
  misc_feature: Ceres CLONE 2049629
  misc_feature (1)..(195): Pfam Name: NB-ARC Pfam Description: NB-ARC domain
DSNGVTALHNELKKNLEGKRFLLVLDDLWVNNENRKGRDILLDALDAGQSGSIILVTAQREDAAAALGAQKQILIPDLEENDYLKLFMHHARPGTIEYKRIGTKIANKLHRSPIAAVTVGEQLRKNTRISFWETTANDVVLNETMGALWWSYQQLGADIRRCFAYCSTFPRGYKLKRDELVRIWIAQGFVNTGGNATEEMEDVGNRYFDELLEFSFLQ

SEQ ID NO: 49413 - DNA, 652 bp, Panicum virgatum
  misc_feature: Ceres CLONE 2049630
  misc_feature: Encodes the peptide sequence at SEQ ID NO. 49414
cctcaagacctcaacagtagtcaacagccaatcagccaccgcctcgatccagcagccatggcctcccgcgcaggaccaccgctccgccgccggccgtcgcagcgccccgcgctgctcgcgctgggcgtcctctcctgcctgcagctgcagctcgcggcgtcgcagctgacgtcgaccaggcctctcccgcgcgccaccgccacggcgacgacagtaccgctgcgagcgggcggagatcaggcggaggccggcggcggcgtcgcgcggcgcgcgtgcacgtacacggtggagatcaagacgagctgctcgtccccgcgcgcgtccccggacgcggtgagcctcgcgttcggcgacgcgtaccggaacgaggtgtacgcggcgcgggtgtcgccggcgtaccggaacgaggtgtacgcggcgcgggtgtcgccggcgtacgggttcgagcggtgcgccaaggacacgttccgggtctccgggccctgcggctacggcgtctgctacctctacctccgccgctccggccgcgtcgggtggacgccggagtgggtcagggtgtacgagcccgcctccggcacgccctccaccttctacttcggcgacccgctccccaacggcgtctggtacggcctcgaccgctgcctgcgccgcc

SEQ ID NO: 49414 - protein, 198 aa, Panicum virgatum
  misc_feature: Ceres CLONE 2049630
  misc_feature (50)..(195): Pfam Name: ATS3 Pfam Description: Embryo-specific protein 3, (ATS3)
MASRAGPPLRRRPSQRPALLALGVLSCLQLQLAASQLTSTRPLPRATATATTVPLRAGGDQAEAGGGVARRACTYTVEIKTSCSSPRASPDAVSLAFGDAYRNEVYAARVSPAYRNEVYAARVSPAYGFERCAKDTFRVSGPCGYGVCYLYLRRSGRVGWTPEWVRVYEPASGTPSTFYFGDPLPNGVWYGLDRCLRR

SEQ ID NO: 49415 - DNA, 629 bp, Panicum virgatum
  misc_feature: Ceres CLONE 2049649
  misc_feature: Encodes the peptide sequence at SEQ ID NO. 49416
tcatcaaacggtttgggcaaatcaagatcttcttagagaacagaccaaagaactggcaactgtcagaagggaacgtgacaactctgaagctgaaagagcccaacatcttaaacaaattcatgatctccaagagcatctgcgagaaaaagaaagccagttcattgcattagaggaacagcatagggttgcccaagagaacattctttacaaagacgagcagttgagagaagcccatgcttgggttgcccaagttcgagatatggatgttttgcagtctcaatccctacaagttgagttacgtgagcgcatggagcagtttaatcaatattggattagttcccagcagcagtatgctgaaatgcagcggggatatttacatacgatacaacaacttcaactagaattaactgaggcaagggaacggtatggtgcacaaaaagatggtccgcaagtttctcgggaggggtcagctgaatcatcatttgttcaaagcatagcgaacagcgtggcttcaaatggtagtgctacagcagacggcaaccagcaattgaaaaataatggaagtgtggatgtctctgtaaagggcaataatgcctctgctgtaccatttccgtcttctctgttgggca

SEQ ID NO: 49416 - protein, 209 aa, Panicum virgatum
  misc_feature: Ceres CLONE 2049649
  misc_feature: SWISSPROT Homolog: EC 2.7.11.1 Non-specific serine/threonine protein kinase
HQTVWANQDLLREQTKELATVRRERDNSEAERAQHLKQIHDLQEHLREKESQFIALEEQHRVAQENILYKDEQLREAHAWVAQVRDMDVLQSQSLQVELRERMEQFNQYWISSQQQYAEMQRGYLHTIQQLQLELTEARERYGAQKDGPQVSREGSAESSFVQSIANSVASNGSATADGNQQLKNNGSVDVSVKGNNASAVPFPSSLLG

SEQ ID NO: 49417 - DNA, 654 bp, Panicum virgatum
  misc_feature: Ceres CLONE 2049672
  misc_feature: Encodes the peptide sequence at SEQ ID NO. 49418
gctgctcctcctccgacctcgctacttatcgtgtctgcgctgctcctgctcctgctccggcgccatagagacgtgcatgcgcgcacgtagattggtcggagccgccgatcgagctcgagggtggggtaggtagtagtggagcaggaggtggtggcagactgactggctggtgagttgaagcttgagcgggaggaggaggtgcggactttgcctccggcgggccgcggatcggagatggtgctggatctcaatgtggcgtcgccggaggagtcgggtacgtcgagctcgtccgtcctcaactccggggacggcggcttccggttcggcctgctcgggagccccgtcgacgacgacgactgctccggcgagatggcgccgggcgcctcctcgggattcacgacgaggcagctcttcccgcccccgaccccgccggccgagccggagcgggcggcggcgccggtgccggtgccggtgtggcagccacgccgcgccgaggatctcggcgccgcgcagaggccggtggcggccgcgaagaagacgcggcgcgggccgaggtcgcgtagctcgcagtacaggggcgtcaccttctacaggaggacgggccgctgggagtcgcacatctggtacccagcctctgacctcgcctgcttcgtc

SEQ ID NO: 49418 - protein, 139 aa, Panicum virgatum
  misc_feature: Ceres CLONE 2049672
  misc_feature: Functional homolog of the protein sequence given in SEQ ID NO 51168
  misc_feature: Useful for making plants with modulated biomass
  misc_feature: Functional homolog of the protein sequence given in SEQ ID NO 51169
  misc_feature: Useful for biocontainment applications
MVLDLNVASPEESGTSSSSVLNSGDGGFRFGLLGSPVDDDDCSGEMAPGASSGFTTRQLFPPPTPPAEPERAAAPVPVPVWQPRRAEDLGAAQRPVAAAKKTRRGPRSRSSQYRGVTFYRRTGRWESHIWYPASDLACF

SEQ ID NO: 49419 - DNA, 670 bp, Panicum virgatum
  misc_feature: Ceres CLONE 2049673
  misc_feature: Encodes the peptide sequence at SEQ ID NO. 49420
attgattttggatcagcgtgcatggagggtaaaaccatctattcatatattcagagccgttattacaggtctccggaagtacttcttggttatccatatactactgccattgatatgtggtcatttggctgtattgttgctgagctgtttattgggttgcctttatttcccggagcatcagaatatgatgtcctttgccgtatgattgagattctcggtgcgcaaccaccagatgatctgcttcgtgaggctaaaaacaccgggcgattttttaagcatgttgcaagtatctatcctggtagtgaggctcggaatgacactggcagtgcatacagaattttaagtgaagacgagatcgaagcaagggagtccaagaggccaaaggtagggagatggtatttccctcgtggaaggctcgatagactcatatttacatacccgtggaagaatttgagtgagggaaccttgctagagacagaaaaggctgactgcctggcattggttgatttcttgagaggtcttgttgagtttgatccgaataagcggtggtcaccgctgcaggcctcatatcatccattcatcactggtgaagccttcactggtccttatgagcctgtccaggaaaccccacggattcctgtaggtcgtgctgcagtagttgaccacaacc

SEQ ID NO: 49420 - protein, 223 aa, Panicum virgatum
  misc_feature: Ceres CLONE 2049673
  misc_feature: SWISSPROT Homolog: EC 2.7.11.1 Non-specific serine/threonine protein kinase
IDFGSACMEGKTIYSYIQSRYYRSPEVLLGYPYTTAIDMWSFGCIVAELFIGLPLFPGASEYDVLCRMIEILGAQPPDDLLREAKNTGRFFKHVASIYPGSEARNDTGSAYRILSEDEIEARESKRPKVGRWYFPRGRLDRLIFTYPWKNLSEGTLLETEKADCLALVDFLRGLVEFDPNKRWSPLQASYHPFITGEAFTGPYEPVQETPRIPVGRAAVVDHN

SEQ ID NO: 49421 - DNA, 603 bp, Panicum virgatum
  misc_feature: Ceres CLONE 2049689
  misc_feature: Encodes the peptide sequence at SEQ ID NO. 49422
caactgtaaatcgtcattcaaggcatatacagcataagctcctctccttgatcagccttgaccttgatcattccagccatgaaaattgtgtgttatctcttcattttccacagccttatccttgccgttttgtgtaccggtgacaagcagttcgtctactctggcttcggtggtgccaacctcaccctggatggtgctgcaacagtcaccccagacggcttactccagctgactaatggaacaggtaacatgaaaggccacgcgttctacccgaccccgatccatttccgcaagaccccagatggtgctgtgcaatccttctctgttgcctttatgtttggcatcgtctctcttcatgctgacttgagtgcgcatggcatggtgttcttgatctctccgagcaagaatttctccactgcgttgccaagccagtacctgggcctcttcaacccacagaacaacggcaagatcaccaaccatgtatttgcagtcgagctggacactaaccaaaacaaggagttccatgacatcaacaacaatcatgttggcatcgatgtcaacagtctacattctgtgcagtcgcatgatgctggctactatgac

SEQ ID NO: 49422 - protein, 174 aa, Panicum virgatum
  misc_feature: Ceres CLONE 2049689
  misc_feature (21)..(174): Pfam Name: Lectin_legB Pfam Description: Legume lectin domain
MKIVCYLFIFHSLILAVLCTGDKQFVYSGFGGANLTLDGAATVTPDGLLQLTNGTGNMKGHAFYPTPIHFRKTPDGAVQSFSVAFMFGIVSLHADLSAHGMVFLISPSKNFSTALPSQYLGLFNPQNNGKITNHVFAVELDTNQNKEFHDINNNHVGIDVNSLHSVQSHDAGYY

SEQ ID NO: 49423 - DNA, 593 bp, Panicum virgatum
  misc_feature: Ceres CLONE 2049700
  misc_feature: Encodes the peptide sequence at SEQ ID NO. 49424
ttttccgcttggcgaccgccggcgcgacccctttcttccctcccgccgcgcgcgcctctccgaccacccgcctccgccttccttccccgccgtccgccggcaccagtttcaatgaactagcgtcgcctctcttcacccaatacccgcccgcttccccctgcccttctctcccggcttggatgcccatggaggccagcggcgcggcggcggcgaccggtgaggtcggctggtacgtgctcggcccaaatcaggagactgttggcccctacgcgcttaccgagctgcgagaacatcttgcagatgggtatctcaacgagagcacaatgctctgggcagaagggaggactgaatggatgccactctcttccatccctgagttacactctgctgtcacaacaaaggatcaacctgaacaagctgctccggatgccgaagatgattttgagaaatttcagaaagaggttacagaagccgaagctgaggttgaggccttgaaaggcagtgctgaagatgccgatgagcggccagcaaccccgccggatggagaggaggagtttactgatgatgatggcacccattacaaatgggaccgt

SEQ ID NO: 49424 - protein, 135 aa, Panicum virgatum
  misc_feature: Ceres CLONE 2049700
  misc_feature: Functional homolog of the protein sequence given in SEQ ID NO 51770
  misc_feature: Useful for making plants with altered terpenoid content
MEASGAAAATGEVGWYVLGPNQETVGPYALTELREHLADGYLNESTMLWAEGRTEWMPLSSIPELHSAVTTKDQPEQAAPDAEDDFEKFQKEVTEAEAEVEALKGSAEDADERPATPPDGEEEFTDDDGTHYKWD

SEQ ID NO: 49425 - DNA, 625 bp, Panicum virgatum
  misc_feature: Ceres CLONE 2049702
  misc_feature: Encodes the peptide sequence at SEQ ID NO. 49426
acctcatccccatcctcattcccctctcttccctgcaaatcatccctaatcacatcttcccgttcgtgaagtcttcgtcttctccaatattttaccacggcccgaactcctcgctcccagattcaccatggatccggtatgcccgggtcgatgtgggcagccattgcaagagcccgtgttccgttgcttctgcggtgatccagcttggtcccttacctctggaacagagcgtaatcctggccgcaaattcttcatctgccagaaggcatcagttgggaggggctgcaagctttggatttgggaggatggtcttttgagatatgttgcggaaatggtcgagtacagcgccgcatcgacgcatgattgtctccatgagcagctttcgattgcccgtgaagctttggtcaactgtaaggagaagcttgctagtgtctccgaagaagctgatgatttggtgctgaaagtccaagatttggaagtcaagttgctagagtctcaggacaccgtgcatcgtttgcatcaggatcaggcaagctggctgaagatttttgccaccttacttgtggttcttgcatttgtttcttggtgcatgatgaactatcctaagtctatagttgtcgtgctc

SEQ ID NO: 49426 - protein, 165 aa, Panicum virgatum
  misc_feature: Ceres CLONE 2049702
  misc_feature (18)..(62): Pfam Name: zf-GRF Pfam Description: GRF zinc finger
MDPVCPGRCGQPLQEPVFRCFCGDPAWSLTSGTERNPGRKFFICQKASVGRGCKLWIWEDGLLRYVAEMVEYSAASTHDCLHEQLSIAREALVNCKEKLASVSEEADDLVLKVQDLEVKLLESQDTVHRLHQDQASWLKIFATLLVVLAFVSWCMMNYPKSIVVV

SEQ ID NO: 49427 - DNA, 674 bp, Panicum virgatum
  misc_feature: Ceres CLONE 2049713
  misc_feature: Encodes the peptide sequence at SEQ ID NO. 49428
gtgtttattggattccttttagctagcgtgttccagagaccaccaccaaagcagctagccaacatggagaacggcaataagatcactagtggtagcagcaggggaggaggagaggaggaggaggccaaggtgcccctgctcgagcccagagcggcagacgaccaccatggaggtgaaggaggaggcagcagaagcttgagcaaggtggagcaggaggaggaagagcagcaagatgatgagtggtcgtcgctggggcggcgggcgtgggaggagaacaagaagctgtgggtggtggcggggccctccatcttcacccgcttctcctccttcggcctcaccgtcatcagccaggccttcgtcggccacatcggcgccaccgagctcgcagcatacgcactcgtctcgacagtcctcatgcgattcagcaacggcatcctgctgggcatggcgagcgccctggagacgctgtgcggccagtcctacggcgccaagcagtaccacatgctcggcatctacctccagcgctcctggatcatcctcttcgtctgctccgtcgtcctgctccccgtctacctcttcactgagcccatgctcgtcgccctgggccaggaccccaagatctccgctgtcgccggcaccatctccctctggtacatccccatcatgttctcata

SEQ ID NO: 49428 - protein, 203 aa, Panicum virgatum
  misc_feature: Ceres CLONE 2049713
  misc_feature (80)..(202): Pfam Name: MatE Pfam Description: MatE
MENGNKITSGSSRGGGEEEEAKVPLLEPRAADDHHGGEGGGSRSLSKVEQEEEEQQDDEWSSLGRRAWEENKKLWVVAGPSIFTRFSSFGLTVISQAFVGHIGATELAAYALVSTVLMRFSNGILLGMASALETLCGQSYGAKQYHMLGIYLQRSWIILFVCSVVLLPVYLFTEPMLVALGQDPKISAVAGTISLWYIPIMFS

SEQ ID NO: 49429 - DNA, 673 bp, Panicum virgatum
  misc_feature: Ceres CLONE 2049731
  misc_feature: Encodes the peptide sequence at SEQ ID NO. 49430
atagagacacctggatcaaatttgctaaactttgctggaagaatggtcgtactagtcaggctagatctactttagtcaaacttttacagtttgatcctgaatcttctcctgaactgacactgtatcatgcacatccacaagtagcactggcttatctcaaataccagtatgctgttggcgatgagcttaaaaggagggatgcattttctaaattacaagagttgtctgtgcagcttgctaccaccatggacagttttcctggaacgtcagcaagtcttgctaccatgtcaaatgctggagtaccactcattgctcgtgtttatttgacacttggtagctggaagagggcactctcacctgcattagatgatgattctattcaagaaattttgatttcttataacaatgctacactaagtgcaaaggactggggcaaggcctggcacatatgggctttgttcaacacagaagtcatgtcacgctataccttgcgaggccgaccagatattgctggaagatatgttgttgcagcagtaactgggtatttctactctattgcttgtgcatctacaacgaaaggggttgatgatagcttgcaggatattcttcgtctcttgactctttggttcaaccatggtgctacctcagaagttcaaatggcattgcaaaaagg

SEQ ID NO: 49430 - protein, 223 aa, Panicum virgatum
  misc_feature: Ceres CLONE 2049731
  misc_feature (1)..(208): Pfam Name: FAT Pfam Description: FAT domain
  misc_feature: SWISSPROT Homolog: EC 2.7.1.137 Phosphatidylinositol 3-kinase
RDTWIKFAKLCWKNGRTSQARSTLVKLLQFDPESSPELTLYHAHPQVALAYLKYQYAVGDELKRRDAFSKLQELSVQLATTMDSFPGTSASLATMSNAGVPLIARVYLTLGSWKRALSPALDDDSIQEILISYNNATLSAKDWGKAWHIWALFNTEVMSRYTLRGRPDIAGRYVVAAVTGYFYSIACASTTKGVDDSLQDILRLLTLWFNHGATSEVQMALQK

SEQ ID NO: 49431 - DNA, 670 bp, Panicum virgatum
  misc_feature: Ceres CLONE 2049791
  misc_feature: Encodes the peptide sequence at SEQ ID NO. 49432
aggcgcgcagcagacagactgcctttactcccgcccgctctctgcccgcgccctctcccctcggccgcccggcctgcctcgcccccgcgccgctgttaatggaaacggcgcggcgtttccgttccgcccgcagccccctcccctcctcctcctcctctcgcgcggtctcgtcttccccgcgactacccgcagctcctccgctcttctcctccgcctgcagatagagcgggcgcgcgtggttggcctggaagcgtcacggtggtggtagcctcagctctcgagggaggcgcggcgcacggcgtgcttgcggccatgctgaggtgcggggagacggtggtggccgaggaggaggaggaggacgacgagtacgccaagttggtccggaggatgaacccgccgagagttgtgatagacaacgactcgtgtgacaacgcaaccgtcatccgggttgatagggtcaagaagcatggcattttactggaagcagttcaagtccttgtcgatctcaacctcgtcatcaccaaggcgtacatttcttcggatggcaactggttcatggatggtactagtagtagttataagcctcccacttttttttctctgaatttgacttgcaacttgaaggggcatgtttggtcgtttgacttgtcaattgccatgatgaaatttt

SEQ ID NO: 49432 - protein, 119 aa, Panicum virgatum
  misc_feature: Ceres CLONE 2049791
  misc_feature: SWISSPROT Homolog: EC 2.7.7.59 [Protein-PII] uridylyltransferase
MLRCGETVVAEEEEEDDEYAKLVRRMNPPRVVIDNDSCDNATVIRVDRVKKHGILLEAVQVLVDLNLVITKAYISSDGNWFMDGTSSSYKPPTFFSLNLTCNLKGHVWSFDLSIAMMKF

SEQ ID NO: 49433 - DNA, 674 bp, Panicum virgatum
  misc_feature: Ceres CLONE 2049804
  misc_feature: Encodes the peptide sequence at SEQ ID NO. 49434
aaagcccgcacgagccctcccctccctcatccaatctgttccccgatcggacccgagccggccggccatggcgattagggctggccgctccgccctcgtcgccctcgccttcctcctcgcggcctccccctgcctccaagccagagtggatcaactttatcatggaagacaggtatccgactggagtaggcaaatcaactttgaactgcaaaatttgtcctcaagtcaaaaggatggccgtcatctcctggcaagtccaaaagagataacacacaggaaattaagggcgaggactggtgtcaggaagaaaatggaagtagtgcagcaggatgatgaagccctagtgaaacttgagaacacaggcatagaacgatcgaaagctgttgattctgctgtgctgggaaaatatagcatatggagacgtgaaaatgaaaatgagaaggcagattcaagggttcgtcagatgagagatcaaatgatcatggctaggatatattctgtgcttgccaaatccagggacaagcttgatctttatcaggaactgcttgcaaggctcaaggaaagccagcgctcccttggggaagctactgctgatgctgaacttccgaagagtgcgttggagagaatgaaagcaatggctcaagttctatcaaaagctagggatttattgtatg

SEQ ID NO: 49434 - protein, 202 aa, Panicum virgatum
  misc_feature: Ceres CLONE 2049804
  misc_feature: Functional homolog of the protein sequence given in SEQ ID NO 50281
  misc_feature: Useful for making plants with altered cell wall content and/or composition
MAIRAGRSALVALAFLLAASPCLQARVDQLYHGRQVSDWSRQINFELQNLSSSQKDGRHLLASPKEITHRKLRARTGVRKKMEVVQQDDEALVKLENTGIERSKAVDSAVLGKYSIWRRENENEKADSRVRQMRDQMIMARIYSVLAKSRDKLDLYQELLARLKESQRSLGEATADAELPKSALERMKAMAQVLSKARDLLY

SEQ ID NO: 49435 - DNA, 678 bp, Panicum virgatum
  misc_feature: Ceres CLONE 2049824
  misc_feature: Encodes the peptide sequence at SEQ ID NO. 49436
caaacgattctatattgcagcttatagggccctaagacatggctctacgaatatggatgttttagttgttattggcactaccgcttcatatgtctactcagtttgtgtgcttctttatggggcattcactggatttcatcctccaatatattttgaaacgagtgccatgataattacatttgtgctatttgggaagtatctggaggtgcttgcaaaaggaaagacatcggatgctatcaagaagcttgtagagcttgctccagctacagcgcttctgcttctgaaggacaaagaaggaaaatattcaggcgagaaggagattgatgcatcgttagtacaacccggtgatgctttaaaagttcttcctggttcaaaggttcctgctgatggtgtagtcatttggggtacaagccatgtcaatgagagtatggtaactggtgaatctgtgcctatctcgaaggaagtatccagtccagtaattggaggcacaatgaacttgcatggtgttcttcatatacaagcgaccaaagtaggatccgggacagtcctgagtcagataatctctcttgtcgagactgcccagatgtctaaggctcctattcagaagtttgctgattatgtggccagcattttcgttcctattgtcatcaccttgtccttactgacattccttgcatg

SEQ ID NO: 49436 - protein, 225 aa, Panicum virgatum
  misc_feature: Ceres CLONE 2049824
  misc_feature (56)..(225): Pfam Name: E1-E2_ATPase Pfam Description: E1-E2 ATPase
  misc_feature: SWISSPROT Homolog: EC 3.6.3.4 Copper-exporting ATPase
KRFYIAAYRALRHGSTNMDVLVVIGTTASYVYSVCVLLYGAFTGFHPPIYFETSAMIITFVLFGKYLEVLAKGKTSDAIKKLVELAPATALLLLKDKEGKYSGEKEIDASLVQPGDALKVLPGSKVPADGVVIWGTSHVNESMVTGESVPISKEVSSPVIGGTMNLHGVLHIQATKVGSGTVLSQIISLVETAQMSKAPIQKFADYVASIFVPIVITLSLLTFLA

SEQ ID NO: 49437 - DNA, 657 bp, Panicum virgatum
  misc_feature: Ceres CLONE 2049826
  misc_feature: Encodes the peptide sequence at SEQ ID NO. 49438
gcccccaccttctcaacacatcgctcgtaacctacccccccccccccccagcgaaaccccccgcttcgcttcagatcatcgttacagttacagatctctcggccgtgtcggcgtgcgtccccgcgcgtcgaaggggtggagagcgatgagggaagcggaggcgccgctcatcacggaggcagaggcggagggggaggaggggcgcggcttccgcggctccacgacggccggagggggccgctccggcggcggcaggggcgggaggcagtaccaacggcgctcggacgcgctcgcctacggcgaccggtaccagaaggcggccgccctcgtcgacctcgcagaagatggtgtcggtatccctgaggatgtcttgaatgacgcaaggttcgagagggccatacggttttatttcgtgtatcttcgattggattggctgtggtcgcttaacctatttgctttgattctattgaatttccttgagaagcctctatggtgccagaaatataccctacatacttgtgaccaaagggatctttactttcttgggcagctgccatacttaaacaaaaccgaatcacttatatatgaggggcttacccttgtcattcttgtcttggatgtcttctatccactttcctatgaaggattacatctttt

SEQ ID NO: 49438 - protein, 170 aa, Panicum virgatum
  misc_feature: Ceres CLONE 2049826
  misc_feature: Functional homolog of the protein sequence given in SEQ ID NO 51771
  misc_feature: Useful for making plants with modulated drought sensitivity
MREAEAPLITEAEAEGEEGRGFRGSTTAGGGRSGGGRGGRQYQRRSDALAYGDRYQKAAALVDLAEDGVGIPEDVLNDARFERAIRFYFVYLRLDWLWSLNLFALILLNFLEKPLWCQKYTLHTCDQRDLYFLGQLPYLNKTESLIYEGLTLVILVLDVFYPLSYEGLHL

SEQ ID NO: 49439 - DNA, 713 bp, Panicum virgatum
  misc_feature: Ceres CLONE 2049841
  misc_feature: Encodes the peptide sequence at SEQ ID NO. 49440
actagctagccaggggcatcagggcgtgggtgggttttgctcctgctcggcgctcgcttcgcctgccacacctcccgtcctgcccctacgccgccgccgggatgatgggaggagggtcgctggtgctggatcagcgcatgccagcggacgacgacaaggccctcttcggcgagtgcttcctcggcgagggcgacctcgtcagcccggcaccggcgcacgacgacatgatgatgagcttcgtccccgacggcgacgagagcgacgacgacgacgtgggcggcatcgaggagctggagcgccgcatgtggcgcgaccgcctgcgcctcaggcgcctcaaggagcagcagcagcagcagcagactggcggcaaggaggaggccccgccgcggccccggcagtcgcaggagcaggcgcggcgcaatcgcaagaagatgtcccgcgcgcaggacggcatcctcaagtacatgctcaagatgatggaggtctgcaacgcgcagggcttcgtctacggcatcatcccggagaacggcaaacccgtcaccggcgcctccgacaacctccgagcctggtggaaggagaaagtccgcttcgaccgcaacggccccgcggccgtcgccaggtaccaggccgacaacgccgcgccgggcgggggcgccgcagtggccgccgcgccggcagggccacactccctgcacgagctgcaggacaccacg

SEQ ID NO: 49440 - protein, 203 aa, Panicum virgatum
  misc_feature: Ceres CLONE 2049841
  misc_feature (42)..(203): Pfam Name: EIN3 Pfam Description: Ethylene insensitive 3
  misc_feature: The sequence is a functional homolog of SEQ ID NO 1358 in the 11/479,226 US patent application
  misc_feature: Functional homolog of the protein sequence given in SEQ ID NO 51126
  misc_feature: Useful for making plants with modulated biomass
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
MMGGGSLVLDQRMPADDDKALFGECFLGEGDLVSPAPAHDDMMMSFVPDGDESDDDDVGGIEELERRMWRDRLRLRRLKEQQQQQQTGGKEEAPPRPRQSQEQARRNRKKMSRAQDGILKYMLKMMEVCNAQGFVYGIIPENGKPVTGASDNLRAWWKEKVRFDRNGPAAVARYQADNAAPGGGAAVAAAPAGPHSLHELQDT

SEQ ID NO: 49441 - DNA, 614 bp, Panicum virgatum
  misc_feature: Ceres CLONE 2049856
  misc_feature: Encodes the peptide sequence at SEQ ID NO. 49442
gatgtttcttgctcaaggacaaatcgtcgcttatggcggcaccaacaatcaagtccatcaaccttcccctgctgatcttccccatcctactccttttccgtagagcctccggtacaggaggcattgcgtcggacacgctcagcaacggcggcaacatcaccgatggcgagacgctggtctcggccggtggctcgttcaccctggggttcttctcaccgggcggggtgccaaccaagaggtacctcgggatctggttcaccgcgcctggtgtcgtcgacgccgtctgctgggtggcgaaccgtgatgccccactcaacaacacctccggcgtgctggtgatcggcaccggcgggagccttcgccttctcgacggccctagaggccagaccgcctggtcgtcaaacacgactaccggcgcctccgccgcctctactgtggcgcagctgctcgactccggcaacctggtcgtgagcgagaagagcagcggccgccgcgtcgtcctctggcagtcgttcgatcacccgtccaacaccttgctcgccggcatgaagttcggcaagagcctgaagaccggcgcggagtggtccctcacgtcgtggcgcgcgaaggacgac

SEQ ID NO: 49442 - protein, 193 aa, Panicum virgatum
  misc_feature: Ceres CLONE 2049856
  misc_feature (81)..(192): Pfam Name: B_lectin Pfam Description: D-mannose binding lectin
MAAPTIKSINLPLLIFPILLLFRRASGTGGIASDTLSNGGNITDGETLVSAGGSFTLGFFSPGGVPTKRYLGIWFTAPGVVDAVCWVANRDAPLNNTSGVLVIGTGGSLRLLDGPRGQTAWSSNTTTGASAASTVAQLLDSGNLVVSEKSSGRRVVLWQSFDHPSNTLLAGMKFGKSLKTGAEWSLTSWRAKD

SEQ ID NO: 49443 - DNA, 633 bp, Panicum virgatum
  misc_feature: Ceres CLONE 2049897
  misc_feature: Encodes the peptide sequence at SEQ ID NO. 49444
gcgtcccaaatccgacaacgcccccaacccctctcccgcacaagcccccccttccccgcattctgctctgccggtcgcagcagagctcaacgccgggcatggcgcgcggcccgagcaccccgtcgctgctgctggcgctcctcgtggcggcggcggccgtggccgcgtccgaggcgtccggggcccccgccgccgtcggcaactggacggaggagctgcgcggggccgggaggcggggccggcacgggcgcgggtacgtgtggcgctcgcggtcgcggtcgcggcggcgcacgttcgagaacggcctcggccggacgccgcagatggggtggaatagctggaaccacttcggctgcgggatcaacgaggacctcatcaagcagacagctgatgcactggtcaacactggtctggcaaaactgggctacgaatatgttaatatagatgattgctgggcagaatctgacagggactaccagggtaactttgttgcaaatagacaaaccttcccctctggcatcaaggcactagcggattatgtgcatgcaaaagggctgaagcttggaatctacagtgatgctgggacacggacgtgcagtaaaaaaatgccaggatcacttgatcatgaagagc

SEQ ID NO: 49444 - protein, 178 aa, Panicum virgatum
  misc_feature: Ceres CLONE 2049897
  misc_feature: SWISSPROT Homolog: EC 3.2.1.22 Alpha-galactosidase
MARGPSTPSLLLALLVAAAAVAASEASGAPAAVGNWTEELRGAGRRGRHGRGYVWRSRSRSRRRTFENGLGRTPQMGWNSWNHFGCGINEDLIKQTADALVNTGLAKLGYEYVNIDDCWAESDRDYQGNFVANRQTFPSGIKALADYVHAKGLKLGIYSDAGTRTCSKKMPGSLDHEE

SEQ ID NO: 49445 - DNA, 679 bp, Panicum virgatum
  misc_feature: Ceres CLONE 2049924
  misc_feature: Encodes the peptide sequence at SEQ ID NO. 49446
tgaaaatccgctccgcctcgctttcaggcctcatggccagcgcgggactccaccactacccccccatcttcctcgccctcccgaatcttccaccgatcccacgagaggccggcgtccaggtcctctcacccgcggttcagatccccggatcgagccggcgcctcgtgaaaatccgcagcggcgacgaggggttgcttgtggctgtggatctgctgaggtggcgacatggggctggatttgggagctgttctcaaacccggcactttcggggtctcggaccacgacgcgatcgtttcgatcaacatcttcattgcgctgctctgcagctgcattgtaatcgggcacctgctcgaagggaaccgatgggtgaatgagtccatcactgcgcttgttatgggtctgatcaccggaggtgtgattctgctcgctactaatgggacaaattcacgcatcctcgtgtttagcgaggacctgtttttcatctatttgcttccgccaataatcttcaatgctgggtttcaagtaaagaaaaagcaattcttccgcaactttatgacaattattttgttcggagctgttgggactctgatttcctttttaataatcactcttggtgccatgggattgttcaagaaacttgatgttggtccactcgagcttggggactatcttgcaattg

SEQ ID NO: 49446 - protein, 151 aa, Panicum virgatum
  misc_feature: Ceres CLONE 2049924
  misc_feature: The sequence is a functional homolog of SEQ ID NO 2 in US patent 7250560
  misc_feature: The sequence is a functional homolog of SEQ ID NO 4 in US patent 7250560
  misc_feature: Functional homolog of the protein sequence given in SEQ ID NO 51120
  misc_feature: Useful for making plants with modulated water use efficiency
  misc_feature: The sequence is a functional homolog of SEQ ID NO 2 in US patent 7041875
  misc_feature: Functional homolog of the protein sequence given in SEQ ID NO 51121
  misc_feature: Useful for making plants with modulated drought sensitivity
  misc_feature: The sequence is a functional homolog of SEQ ID NO 4 in US patent 7256326
MGLDLGAVLKPGTFGVSDHDAIVSINIFIALLCSCIVIGHLLEGNRWVNESITALVMGLITGGVILLATNGTNSRILVFSEDLFFIYLLPPIIFNAGFQVKKKQFFRNFMTIILFGAVGTLISFLIITLGAMGLFKKLDVGPLELGDYLAI

SEQ ID NO: 49447 - DNA, 688 bp, Panicum virgatum
  misc_feature: Ceres CLONE 2049937
  misc_feature: Encodes the peptide sequence at SEQ ID NO. 49448
gctcgcgctcgcgctcgcttaacataaccggccggcggcgctgtgtggcggacctcgcgtacgtaggagtagcagtagctcgcacggcccagctccgctcccccgccatccatggacccctacaagtaccggccgtcgagcgcccacaacggcccgcactggagcaccaactccggcgcgcccgtatggagcaacgaccactccctcaccgtcggaccacgaggcccgatcctgctggaggactaccacctggttgagaagctggccaacttcgaccgcgagcgcatcccggagcgcgtggtgcacgcccgcggcgccagcgccaagggcttcttcgaggtgacccacgacatctcccacctgacgtgcgccgacttcctgcgcgcccccggcgtgcagacccccgtgatcgtgcgcttctccacggtgatccacgagcgcgggagccccgagaccctgcgcgacccgcgcgggttcgccgtcaagttctacacccgcgagggcaactgggacctcgtcggcaacaacttccccgtcttcttcatccgcgacggcatcaagttcccggacatggtgcacgcgctcaagcccaaccccaagacgcacatccaggagaactggcgcatcctcgacttcttctcgcaccacccggagagcctccacatgttcaccttcctcttcgacgacg

SEQ ID NO: 49448 - protein, 192 aa, Panicum virgatum
  misc_feature: Ceres CLONE 2049937
  misc_feature (18)..(192): Pfam Name: Catalase Pfam Description: Catalase
  misc_feature: SWISSPROT Homolog: EC 1.11.1.6 Catalase
MDPYKYRPSSAHNGPHWSTNSGAPVWSNDHSLTVGPRGPILLEDYHLVEKLANFDRERIPERVVHARGASAKGFFEVTHDISHLTCADFLRAPGVQTPVIVRFSTVIHERGSPETLRDPRGFAVKFYTREGNWDLVGNNFPVFFIRDGIKFPDMVHALKPNPKTHIQENWRILDFFSHHPESLHMFTFLFDD

SEQ ID NO: 49449 - DNA, 600 bp, Panicum virgatum
  misc_feature: Ceres CLONE 2049951
  misc_feature: Encodes the peptide sequence at SEQ ID NO. 49450
aaaaaaaaagctccatcacttccagctcccagctcccagctccagcccagccccaagctcccctctcatctcctctcctcctccccctcaatgccgccccgcccgtagccgcgccccgagcccccgcgcccgccgcaatgcccggcccccgcgcgcccctggcggcgctggcggccctgctcgcggtcgccgccctcgccgccgcggagcccccgcccagcgagcggtccgcgctgctggcgttcctcaccgcgaccccgcacgagcgccgcctcggctggaacacctccaccccgacgtgcggctgggtcggggtcacctgcgacagctccgggtccgccgtcgtcgagctgcgcctcccgggcgtcggcatcgtcggcgccatcccgccgggcacgctcggccggctcaccaacctccgcgtgctctcgctccgctccaaccgcgtcctgggctccatccccgacgacgtgctgcagctgcccaacctcaaggcgctcttcctgcagcagaaccggctgtcgggcgccatcccgccggggatcgccaggctcggcgggctcgaccgcctcgagctctcgcacaaaaacctctcgggct

SEQ ID NO: 49450 - protein, 154 aa, Panicum virgatum
  misc_feature: Ceres CLONE 2049951
  misc_feature (26)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MPGPRAPLAALAALLAVAALAAAEPPPSERSALLAFLTATPHERRLGWNTSTPTCGWVGVTCDSSGSAVVELRLPGVGIVGAIPPGTLGRLTNLRVLSLRSNRVLGSIPDDVLQLPNLKALFLQQNRLSGAIPPGIARLGGLDRLELSHKNLSG

SEQ ID NO: 49451 - DNA, 661 bp, Panicum virgatum
  misc_feature: Ceres CLONE 2049967
  misc_feature: Encodes the peptide sequence at SEQ ID NO. 49452
aagcacctcgccctcgatctagccaaactccccgacgcgatctggccgcgggaagatggcgactccgccgccgcctctccgccgcgccaccctcctcctcctcctcctcgccgccgtcctcgtcggcgccctcgcctccaccgcccgcgccgatctcgtcatctccagggcagataggagggttgatctgacttcgcatatcgttcgcgtcctcgcttccctcaaggttgaaaatgttggaccagaccctgtctctcaagttttactatcttttcccaacatccaagcaaagaacttagcagctataagagcatttggcactgaaggaaaagtgaagggtccaagtactgttctgtcaattgaagttgttcagccttctggagctcccccagagctaactttcttttcagcattgttacccaaacctttggaaaagggaaagattctacacttggatgtcctgactgtattcacacactctcttcaaccattcccagaagaaatcactcaagctgaagcacaacttgttgtctatcaggatagtgctcattatttgtcaccttaccctgttaaggtacagacacttgctatcagattgcccggaggaagggttgaatcatacacaaggcatccaagtgcaaaacttgtggattcagaactg

SEQ ID NO: 49452 - protein, 201 aa, Panicum virgatum
  misc_feature: Ceres CLONE 2049967
  misc_feature (33)..(201): Pfam Name: Ribophorin_I Pfam Description: Ribophorin I
  misc_feature: SWISSPROT Homolog: EC 2.4.1.119 Dolichyl-diphosphooligosaccharide--protein glycotransferase
MATPPPPLRRATLLLLLLAAVLVGALASTARADLVISRADRRVDLTSHIVRVLASLKVENVGPDPVSQVLLSFPNIQAKNLAAIRAFGTEGKVKGPSTVLSIEVVQPSGAPPELTFFSALLPKPLEKGKILHLDVLTVFTHSLQPFPEEITQAEAQLVVYQDSAHYLSPYPVKVQTLAIRLPGGRVESYTRHPSAKLVDSE

SEQ ID NO: 49453 - DNA, 748 bp, Panicum virgatum
  misc_feature: Ceres CLONE 2049974
  misc_feature: Encodes the peptide sequence at SEQ ID NO. 49454
agccggccttctctgctcggaggggagcaatggctgccaacggaggcgggtaccgggccgaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggctcagatttgggacaccgccggccaggagaggtacgctttgatctgctcttactgtcttcgctagccgtctgcggtgcactggtgtagatttgttctctactttctcgtgcgctcctccaatgaggtgcgcaaaatgtgatgtcaggagcctccttggcttgatttcgggaggttgcctaactgtttggtcgcggttgctcgttcaatagctttcttgcttgtttagggagctagatttttgggctgctatttcgggaagggtttaccatgattggtgatctggaggagattgccatttatgttatgaaacttatgatttaccgcgagtaggatcaccggagcttggcaagatttagtgaaagacgggatcttgggggtggtcgagttgttcagatgtcgattggttgtttctgctaggttggtggatggaatatttcgatctttagtgattgagatgtcgattccattcataccctacttgttggcaaatgcacgggcaaatttcactgccctctg

SEQ ID NO: 49454 - protein, 88 aa, Panicum virgatum
  misc_feature: Ceres CLONE 2049974
  misc_feature (19)..(88): Pfam Name: Ras Pfam Description: Ras family
  misc_feature: Functional homolog of the protein sequence given in SEQ ID NO 50162
  misc_feature: Useful for making plants with altered lignin content
  misc_feature: Functional homolog of the protein sequence given in SEQ ID NO 50163
  misc_feature: Useful for making plants with altered alkaloid content
  misc_feature: Functional homolog of the protein sequence given in SEQ ID NO 50164
  misc_feature: Useful for making plants with altered terpenoid content
  misc_feature: Functional homolog of the protein sequence given in SEQ ID NO 50522
  misc_feature: Useful for making plants with modulated oxidative stress sensitivity
MAANGGGYRAEDDYDYLFKVVLIGDSGVGKSNLLSRFTKNEFSLESKSTIGVEFATRSLQVDGKVIKAQIWDTAGQERYALICSYCLR

SEQ ID NO: 49455 - DNA, 656 bp, Panicum virgatum
  misc_feature: Ceres CLONE 2049982
  misc_feature: Encodes the peptide sequence at SEQ ID NO. 49456
aaaaaaactctccacctgtccgccttccgcggctccacccacacaacgcacgcatcgcatccgactggagcagacgggcagacgcgtggggactggggaggcagcgcaaaaccctcctcctcacacgccccacctcctccggccgccgccgccgccgatcgccggatgtcattgcacgtgtccctcctctctgaaaatgggctctagttcagaagacagttacgaaattagcgattctgagattgatgagcgtgaagcagaggtttatgaacgtttgaaatcaggagatataaaagtgaacgatcatgggacctacagttgcccattctgcagggagaaaaggagaaaagattacagcatgaataacctacttcaacatgccacaggagtaggttcagcagctaatcgacaagcaaaagacaaggcaacccaccgtgcccttgccaaatttttgaaggatggacctgccaggtcatctgagccacagtcgcaaccgacaatgcttatagagcctcaaaatcttggaaacagagatgatcagtttgtctggccctggatgggtgttctagttaatgtccctactgagtggaagaatggacgccaagttggccagagtggaaatcggctgaaggagcaactttcacgcttctgcccac

SEQ ID NO: 49456 - protein, 153 aa, Panicum virgatum
  misc_feature: Ceres CLONE 2049982
  misc_feature (42)..(83): Pfam Name: zf-XS Pfam Description: XS zinc finger domain
  misc_feature (112)..(153): Pfam Name: XS Pfam Description: XS domain
MGSSSEDSYEISDSEIDEREAEVYERLKSGDIKVNDHGTYSCPFCREKRRKDYSMNNLLQHATGVGSAANRQAKDKATHRALAKFLKDGPARSSEPQSQPTMLIEPQNLGNRDDQFVWPWMGVLVNVPTEWKNGRQVGQSGNRLKEQLSRFCP

SEQ ID NO: 49457 - DNA, 738 bp, Panicum virgatum
  misc_feature: Ceres CLONE 2050023
  misc_feature: Encodes the peptide sequence at SEQ ID NO. 49458
acttgtttcagacccatccagctcactccacagtccgcagcgccggcgaggcacgcaagaagaagccgcgtttcttgcagctgcagcggcgacctcgctccgtctctctcctctcgcaaacacagaagaggatggggagagcgccgtgctgcgagaaggtggggttgaagaaggggaggtggacgaaggaggaggacgagatcctggcgaggtacatcaaggagcacggcgaagggtcatggagatcgctgcccaagaatgctgggctgctgcggtgcgggaagagctgcaggctgcggtggatcaactacctgagggcggacctcaagagggggaacatctcggaggaggaggaggagatgatcatcaagctccacgccacccttggcaacaggtgcgcctctatcagacactctgctcgtctcccccaactgcttggaatttgtgtgcagactcgatcttgtgcttttttttattattcctgcattcgaaggaatttggtagcactgaacatatgtcgcacggcgtcatagttcagagttcttgcattcgtagtagtagaaaagattccgagctttctatggtacctttctataggtgatgagctcgtcagaactgacaggcaagtgaagaaccccctgaaagtttcagtctgaaacattgcgtcggttttgttgacagaaaaaattaggaaaggctgtggttaaaaaatatatatactgtgcatttacaagtagc
